United States Patent 8,781,750 (CELL-TYPE-SPECIFIC PATTERNS OF GENE EXPRESSION) - sequence listing, part 50

SEQ ID NO: 38154 - DNA, 332350 bp, Homo sapiens
ccaggaagggcagcggggcgcaccaggccgaaggctcacgccacagggagggcagctaggacatggggggaagcgcgttaaaccagggagtcctggaaggggacgacgcccccggccaggtgagggcccagacgtgggggcgtagacgctgaggggtggccgggtgggtctgcggctctgaggcctggctttcattctccatcagtccctgtacgagcggttaagtcagaggatgctggacatctcgggggaccggggcgtgctgaaggacgtcatccgagaaggagctggagacctagtggcgcctgatgcttcggtgctaggtacgccctggggcggtttgtccgcaggatccatgtcatcgcactctgttgggaagagagaggcctcattttcaaaaagcatttaatggggttggaaatgctttgtttgaagtggatttttgtttttgaaacggggtctcgctcagttccccaggctggagtgcagtggtgcgaacatagctcactgcagcctctgcttcctgggctcaagtgattctccagcctcagcctcccaaataagagatttacaggcgcaatccaccatgcccggctaatttttaatatttttgtagagatggggcactttctatgttgcccaggctggtctcagactcctggtcccaagtgatcctcccacctcagcctccccagtagctgggattacaagcgtgagccgctgcttctgccatgaattagtttttttaagaggaaagctaaggacccctatgtcccctttgcgtgatgcttccatgaagctcttgaacctctgagccgaagggcaggctcctaaaatgcagagagatttattcctgtacctcgtggtgtcgggcagcttaagctcatctgatcgcattgtttctgtgtgatcatgagagactcgatattatggaggcgtgggtgttttgggtccattttccttacattctttcctctattctagtgaaatagtatggatacctggaacacttggacagacccttcgattctaattactttaggaaaactcctcggctaatgaaacttggagagggtaaattcagagtaggagctggagaagaagggattgtttaggagcgagatgaggcaccatgcctcaggctgggaagactgctcagagcgcaggttctttgaattgactttgctgaggctgggttttggtaaaacagccatgttctctccccttgagacctaggcatttgggagatggcttaatgggcaaggtataatctttgcactctgacttaactcaccactgggaatgtttctttgttcatttattaagtaaaaatcgacgaatgcttacttcccacaatacatggtgaaaagagaggttgtactcagaagattagaacatctccacccttaaggacctcacaatgtagtagaggagactgacctgcactcagctcacttggtagaatcggatgagtgcctgggaggtgaaagcagtgttgtgggtgtgcttaatgaaggcatgattaattctagctgggaagttcagggaaggcttcctggaagagggggcatttgaactgagcccagaagtttgaataaaatttctatcactagaagctgggcacaggctcaggaggaagacattgcaggaagagggaactgtgtgagggagacatggaggccagagtactgctgacttagagggggaagaaactgatagcattaagcaggatactgagcaagcttcacccaccttctttgtcccttcttacagatattacattgtggggcatggagctgggccttctgagcatgcagagaggagagctggccaggtttctgttcaaaccgaactacgcctatggaacgctgggctcccctcccttgatccccccaaacaccactgtcctgttcaagattgagctgcttgacttcctagactgtgctgagtcagacaagttttgtgctctctcagctgtacgttgcagagcacaaatgtcagcactttatagagagacaaatgggttggtgtttttggtaattcttctagatggcctgccctgaggctgatcgtccgccactgcactccagcatgggcaacagagcaagactccatctcaaaaaaaaaaaaaaagccagctgggattttttttttgagacatgaccttgcactgttgcgcaggccggagagcagtgatgtgatcatagcccactgcagcctcaaactcctgggctcaagcgatcctccttcctcagcctcctgggtagctgggactacaggctggcaccacaacgcctggctaatttctatattttttgtagagatcatgttgccaggctggtctcaaatttctcggctcaagcaatcctcccaccttggctcttgaagtgccaggattacagaagtgagccgccacacccagccacagctgggattttgatagggattgtgttgaatctgtagatcacttctgaagtaatgaaattttaataatattaagtcttttaatccatgaacatgatttccttccatttatttaggtcttctttagtttctttcaatgatgtttatagtttctttttcttttggagatggagtcttgctctgtcacccaggctggagtgcagtggcatgatctcggctcactgtaacctctgcctctcgggttcaagtgatccttgtgcctcagcctcccgagtagctgggattacaggtgcactgtacccggctaatatttgtatttttagtagagaaggggtttcaccatattgaccaggctggtctcgaactcctgaccacagatgatccgcccacctcggcctcccaaagcgcttggtttacaggcgtgagccactgcgcccagccttatcttttcttccacacagatgcttcgtcttgggtaaactcctcgactcccaaggccccagcctccatctttacctcagagcctcctgaacctcctcctccagcctcaccttcctccagcctcaccactcctccctggacctgcagctccgcacccccgggggcctcagaactaccccttccagggcctcagaactacccctacggtttctcctgcgtaaccttctgcctaccttcctgagagtggttggtgacagcagccggggctagaaacctcgaggcgactgtgcttgagtcctctcttgctctttacatcccaaatcccatcaattgtcacgccttgtgccttccgcctctcaaatattcagaaagcagatgtatgctgggcacggtggtgactcaagcctataatcccagcacttcggaaggcggaggcaggaggatcgcttgaggccaggaattttagaccagccggggcaacatagtgaaaccccatctctacaaaataaaaataaaaattagctgggcgtggtggcgtgtgcctgtagtttcagctactggagaggctgaagcgggaggatcacttgagcccggagttcaaggctgcagtgggctatagtcgtgccacttcactccagtctgggcaacagagcaagatcctgtttaaaaaaaaaaaaaaagcagatctaaagaggggcctggcgtggtggctcacgcctgtaattccagcactttgggaggacaaggcgggcaaatcacctgaggtcaggagttcaagaccaacctggccaacatggtgaaaccccatctctactaaaaaatacaaaaattagccaggcgtggtggtggattcctgtaaccccagctactcgggaggctgaggcagggagaatcgcttgaacccaggaggcagaggttgcagtgagccaagatcgtgccactgcattccagcctgggcaacagatttgagactccgtctcaaaaaataataataattggccaggcgcagtggctcatgcctgtaatcccagcactttgggaggccaaggcgggcagatcacctgaggtcaggagttggagagcagcctgaccaacatggagaaaccccgtctctattaaaaatacaaaattagccaggcgtggtggcacatgcctgtaatccaagttactcgggaggctgaggcaggacaatcgcttgaacctgggaggcagaggttgcggtgagccgagatcgtgccattgcactccagcctgagcaacaagaacaaaactccgtctcaaataataataataatttaaaaattttaaaaataggtatagagcaggctcgtgcctccagcacccaattctgcacactgggtaacaagatgggtggcagccacccagccctaagcatcgggagctcaggtgtcaacacctgaggcaggtgcaggaccagggcaggagaaggggcttctacagaaagcgcctaggggaggtggcacacactgagctggtctgaatcagcagaggagagaaggaagcatttgagtcacactgcacggtgaagatgcccaagtgcagaggtcaggaacagtcagtcctcgggggaagagggagagcaggggagtgaaggtgagagtggggggtggagtcagatgaggggctcaagttcattctcatcccccactgcctgcgtgacgtggggtacagtacttcctactgaagcctcggtttccttatccgaaacctggggtgtggtggggtcacctccattcatgcttgtgaaagtcctttgtaaatgaaatgtacaggacaagcttaaggggggcccaaggaggggaacgcatcttacaccttgcaaaggccaccaataccaagcccaagtgcccaggctttatttttcagatggggtgaccttcactgcatgaaggtattcggtgggacttctttttttttttttttttttagacagggtcttgctctgtcacccaggctggagtacagtggtgccatcataggtcactgcagcctccacttcctgggctcaagcaatcctcccacctcagcctccccagtagctgggaccacaggcacgcaccaccacacctagctagttttttttcttttcgtaaagacagcgtcttgataggttgcccaggctgctctgggactcttggcctcaagcaatcttcctacctccacctccccagttgttgcgccatggtgcctagccaagatgagactctcattcaaacagtcaaaaacccgacttaaagtagctcagacacgcatagaatggattggctgctgttgtggactctccgagggtggctccatctgcaggcactgttggaaccagtacccaaggatgatgtcccagcatctgtctctccgggatctcacctttgtaccctgccctcactggctgcgtctcatttctgcttccctctgtgtggcttcctgttggtggcagggtgaggcccccaggacagcaggcagcctcagcctcaccctttcccagtactgagacccagaatctcactgcggactccttgagacaatcccagggaaggctttgattggcttagcttgaggcatcactgctcatccctggaccattcagaacctcggtggtgctccctgattgaccacctggtttagtgccgcttctgtgctggaggtaggagccatgtgaggaagtcctggaattgggcaagcacggtcttgggaggccaggctgggacctccttccctagggagtcctggggattctgaacagagtgatgaatcctctgtgaggggcagggagccacagatggagagggatgatgggggtggatctgggctgtgcccggagaggggaccctgccaggagtgagtgtcttatggaggcagaacgggctcctgcagttcccaaggtgcccttaggccccaacaagcccctgtccccagccttacacagagtcctgagacttcggggaaatgacttcactgtgcccgtttcaccggtgaggttcaacgactttcccaacatgatgggagtcagaggccccaggtcgcaaatcactagagcacccagccgccactcagtccagggggacttccacgggaaaccagcactgggtgtccagggccagtggcagaaccatgggcccttccttcatcgaaccaatacgtttgggtgggggcgagctcctctcgccctagttggtggcggggctgcaggagaggcacagaccttgcagggggtgggggaattggggccaacaggggccgcgaggaaggcccaggggtattgcctgtgggagtccagcggaacctgggcaggcttcccagaggaggcggcctccgagcccctgggcacccgtgatccgccagggcctggaagaaaacggacggagcaggagcagagggaggggagacgggcagtggtgcggcccccacccgggggctcggggcgcacaggggtccccgccgcccacccggccgccccgcgattcctgcacgtcagcagagcggaaacgcggagcagcgccagccggggcgggctggatggggcctggcagcgcggccggcgctccgcgggttcggttccgcccgcgtttgtgttggcagcggcccgcggctcgcggccgggcgcatgaaaggggcctctgtctgcgccccagccgccccgcttgcctttcactcttaatataatcttcatttttaacccagcggaggttctcttggaatttttccccttcttccaaaaatacatgtgcgtgcgtgtgtgtttgcaaaaggccttgacggtgaaggtcgggattgtccccgggaagggaagggaagggcgaaacctgaggcggggagggagacagaaatatctttctttcttcctgtgcccaggcctcctcggggtcgccaccgctgctaagggtcccccatcctgcgcccccccggggactgggggtgcaggacaggatgggggggtcctcctccgaccacccccacacccccaaccccgggatgaatgaatgggctttttggaaattggggtcagcagggaggggtgggcgcctcctccaggggtccctccccggagctggtcagagaatggtgtcaccaggtgtggccagcgggggctgtcctcccagagcgggtaggaagggagacaggacatcagtcctgctaggaaagaccctactcttttttatttttattttttttctctgagacagggtcttggtctgtcacccacgctggagtgcagtggtgcaatcatagctcactgcagcctctacctcctaggctcagatgatcctcctgcctcagcctcccaagtaactaggactccaggcagtgccaccatgcccagctaattttttttttttttttttttttttagagatggggtctcactatgttgcccaggctggtcttgaactcccagccttaagcaatcctcctgccttggcctcccaaattgctgggattacaggcatgagccactgtgcccagccctagaccctactctgtgttgatgcttgcttgcaggcttaaatagcctgcgacagtgtccagaaactgtcaccagtcagccctttgttcacttgctgggcagaggagcgttacacctgagggaattttccagattatgcccacagtggctgtttggagagttctcacttcaaacatctcagggctcatcacagagctttccatgcatgttcccaggcaagtctcttgtggtcagggaagtcaagtaagattatccccgcagaagggaaaaagaaggctcagagaaaacaactaacttgtccccaagttgtggagcatgagggagctagggtgggaatgaaaaagcgggtgatgggaagcccaggttctccctgctggatgcctggttttcaaactgttttctgcagagcttctgttcatattgggggtcttggaaatgtatgattctaattatttaaatatatatatttaggccagacacagtggctcatgctggtaatcccagcactttgggaggtccaggtgggaggactgctcgagcccaggagtttgagaccagcctggcaacatagtgagaccccatctacaaaagtaaccttctgccgagtgcagtggctcacacctgtaatgccagcactttgggagactcaggcagccagatcacctgaggtcaggagtttgagaccagcctggccaacatggtgaaaccccatctctactaaaaatacaaaaattagcctggcgtggtggcacacctgtaatcacaactactcaggagtgtgaggcaggagaatcgcttgaacctgggaagaggaggttgcagtagctgagatcggcacagcagtctgggtaacagagtgagacttggtctcagaaaaaaaaaaaaaaaagacttattaaaaaaaaaaaaaatagctgggcatggccatggtggcacatgcttgtagtcccagctactcgggagactgaggcaagaggatcccttgagcccagaaattggaggaggcagtgagctatgattgtgccactgcactccatcctgggtgacaaagcaagactccatctcaaaaaaatatatctaatttgtgtgtatatttggacttctggtgtgagcaatatagtagtaaatttgatagcctgaaaaccatcctactctaaacgtcttggttacaaaacaccaaccacatcctgttttttgttttaattccagagtcggggtcttggtctgttacccaggctggtctccaaccttttttttttttttttgagacgaagtctcgctctgtcgcccaggctggaatgcagtggcgcgaactcggctcactgcaagctctgcctcccgggttcacgccattctcctgcctcagcctcccgagtagctgggattacaggcgcctgccaccacgcccggctaatttttgtatttttagtagagatggggtttcaccatgttggccaggctggtctcgaactcctgacctcaggtgatcgcccacctccgcctcccaaagtgctaggattacaggcgtgagccaccgcacccggcctgttattgtttgttgacacagagtcttgctctgttgcccaggctggagtgcagtggagccatctcagctcactgcagcctccgtctccccagctcgtgatcctcccacctcagcctcctgagtagctgggactacagcctccaccaccacacccagcttatttatttatttatttatttatttatttatttagtatttttagtagagatggggtttcaccatgttagccaggctggtctcaaactcctgacttcaggtaatccacccacctcaggctcctaaagtgctgggattacaggcatgagccacctcacccagcagtcaggtggttggtaactgtctctcttaaaataataattggttgcaaccaacaccagggaaaggccgtttcccaatagatagaaagcacctggaactggtgatcagcagcttcccgataagatctcaggagctgggcgagtgggctcaagcatgtgcactaagaggcaacatggtggagtttaactggcatatgacctgggagcatttgactggtaaaggaagaatgcctcaagtgagcatgcgcacttcagtaaacacgctgcgcatgaggcccctccggagcgctggcaggccactgcgcatgcggacagaccaccccaagggaagaaccaggggaaagttaacgcaagccccggaaggatgccaacctatcaaaccccaagtccaagatcaaacagtgcacttgactctctcaagtcacctgcttgaccctcttccaagtgtactttacctcctttccttactgccctaaaactttttctttgtttggttggttttgtttttgttttgagatggagtcttgctctgttgcccaggttggagtgcagtgttgtgatctcggctgactgcaacctccacctcccgggttcaagcaattctcccacctcagcctccccagtagctgggattataggcatgtgccactatgtctggctaatttttgtatttttagtagagacagggtttggccatgttggccaggctggtctcaaactcctgacctcaactgatccaaccacctcggcctcccaaagtgctgggattacaggcgtgagctaccgtgcccagcacctgccccaaaacattttaataaactttcactcctgctctaaaacttgcctcggtccctcactctgcctcatgccccttggtggaattctttcttctgaggaggcaaggactgaggtgaatccatatggattcaccaccactaacacttcccccatatatctccccactgctgggccctgctcacctcagtccccaaggcctcagtgtgagtgagtttatcagatgcattcacgagtggcaggtgtctgggagccgattctgatgagggaagagaaagagaggggctttgaatttgaggttcacactttcttcaaggaacaggtttagctggacataatggtatacctgtaatcccagtactttgggaggccgaggcaggaggatcacttgaggccaggagtttgagaccagcctgggcaacatagagagacccccatctctaccaaaaaaaaaaagaaaaataagccaggcacagtggtgtgttcctgtagtcccagctactctggaggctgaggcgggaggatcacttgagcccaggagtttgaggctgcagtgagctatgatagcaccacggcactccagcctgggccacagggtgagaccctggctctaaaataaataaataaataaataaatagataaataaataaataaagtatcccatgtgggttgatgtgggtgaaattcaggccaggctggacagacaagggcgattttcagggcaggcagccactgtcaaacatcaccctctcctctgaggatccctggtccctcctccatgaagtggggggcacaagcagctggaaacaggtccccaccactgctctgccccggaaggaaggctgggctgcttccctttgagctccccgggcactcagttcctttgctcaattcaatgcagcatccagtccagagaagtgggtcttccaatttggctgaaaggccgggaaaggtccctcatagacactcgaagcttccaggggcctcagggttcatctgattgtacccgtcagccactgccccagtgaggctgcctaacacaccaccccaaaacccagaagcttaaaacaagcatttatcactgggcgaattggctcatgcctgtactttgggaggccgagccgggtggatcacttgaggtcagcagtttgagaccagcctggccaacgtggtgaaacctcatctctactaaaaatacaaaaattacctggtcgtggtggttcgcacctgtagtcccagctacttgggaggctgaagcaggagaatagcttgaacctgggaggtggaggttgcaatgagctgagattgtgccacactgcactccagcctgggcgatagagcgagacttagtctcaaacaaaaagaccaagcatttatctctcgctcaagcttccaggcttgctcccagccacggctgggtccaggactgtgccacatgcctctcattctccccagggccagagggctaaggaggggctggggagtgtgcttcccctggctaaaggcaggagccccggaggaccagcaccaagcacaagcccactgcaaatctctgctcaccttgtcagttacattctattggccaaagcgattcacctggccaagcctaacaggaatgggtggggaggtacattcctcctagagaggggagtttgtgggaaaggagtggttactgctgagcaataatctagtcttctaataatcgaactaactgatttttccttttttctttctttttgtgttttgttttgttttgttttttgagacagtttcactcttgttgcgcaggctggagtgcaatgctgcagtctcggctcactgcaagctccacctcccaggttcacgccattctcctgcctcagcctccagagtagctgggattacaggtgcccatcaccacgcccggctaattttttgtatttttagtagagacggggtttcactgtgctggccaggctggtctccaactcctggcctcaggtgatctgcccgcctcagcctcccaaagtgctgggattacagacatgagccactgcacccagctgaactaactgatttttcaattgctccctgcacaatggcagaaattcctggagattctctgaaaggggagggagaaggggcagggagggcttgatgtctccattgagagccagagcgcttttggttttaaggtggggagtgagttgggtgcaatggcttacgcctgtaatcccagcactttgggaggccaaagcaggtggatcacttgaggtcaggagttcgagaccagcctggccaacatggcaaaaccccatctctactaaaaataaataaataaataagaaaattagccaggtgtggtggcggggacctgtaatcccagctactcaggaggctacggcaggagaatcgcttgaacccaggaggcagaggttgcagtgagccaagatcgcaccactgtactccagcctgggcaacagagcgagactcagtctcaaaaaaaaaaaaaaaaaagtggggagcgaagggaagacgcctaatgattcatgattcatgatgtttcatgatgactcttttgcacttcgaagccatgcccttcgccttgtcagcctggagaagactgcgatttgctacagagggaacacaaagaaaaagagacaattgtggatttctgacattcaaatgtacaatttcgcctccttgataaagaatggacttaacaccaatacctcccactttctttcttttcctttttaaattctttcataaagacagggtctcgctatgttgcccaggctggtctcagactcctggcctcaagcgatcctcctgcctcagcctcccaaagtgctaggcttacaggcatgagccactgtgcctgggccagtatctcacactttgactcaggtccaggcttcatgaactggagtagaccatagggttttccagagtttatttatttatttatttatttgtttatttagtcagtttgtcacccaggctagagtgcagtggcgtgatcttggctcactgcagcctcaaccttccaggctcaggccaggcgcggtggcttatgcctgtaatcccagcactttgagaggccaaggtggcaggatcacctgaggtcaggagatcgagaccagcctgaccaacatggagaaaccctgtctctactaaaaatacaaaattagctgggcatggtggcacatgcctgtaatcccagctactcggggggctgaagcgggagaatcgcctgaacccgggaggaggaggttgtggtgagctgagatctcaccattgcactccagcctgggcaacaagagcaaaactccgtttaaaaaaacagacaaacaaaaaaacaccaaaaaaaaaaaaaccttccaggctcaagagatcctcctacctcagcctcccaagtagctgggactacaggttgtacctccatgcctggctaatttttgcttctttttttttttttttttggtagagatgggatttcaccacattgcccaggctggtctcgaactcctgggctcgagtgatccgcccaccttggcctcctacagcactgggactagaggcatgagccactgtgacctgcctatttatttaatttgtgtttggctcgtccagtgaagcagtgggagtggagaaggaacaaaaaaatctgtaagtcgttgtgatcaattaactgtaaccaccactgcactcgggccagctccatcgagttcattatgaggaaggagagaagaggggagaaccttctactttctagaccctggggtttgtggggagaggaaggccgagggaggagaggaagagattggatccggcgccctgctatgggtgtctccatctgggctgctgctagaaggggcagttgttctcttttttttcttttttagacggagtttttttgctctgtcacccaggctggagtgcagtggcatgatctcaactcactgcaacctccgcctcccaggttcaagcgattctcctgcctcagcctcctgagtagctgggactacaggtgcccaccaccaagcccagctaatgtttgtatttttaatagagatggggtttcaccatgttgaccaggctggtctcgaactcctgaccttaagtgatccgcccgccttggcctcccaaaatgctggaattacaggcgtgagccactgcgcctagccagttgttctcttaagaggggcaggattctctggccctgctgccctggggacccatggaggagacccttgcaggctgctgcaccatcctgggctgagaagcatcaaagcagatgtggggccagcatgcttacagcggggacaccacttcccaacagcctgaaaaactcccatttcaccttaaaaactcatcagacctggctgggtgtggtggctcacgcctgtaatcccagcactttgggaggctgagtcaggcggatcacgaggtcaggagttcaagaccagcctggccaacatggtgaaaccccgtttctactaaaaatacaaaaattagccaggtgtggtggcaggcgcctgtaatcccagctacttgggaggctgaggcaggagaattgcttgaaactggaaggccgaggttgctgtgagcagagatccagccactgcactccagcctgggcgaaagagtgaaactctgtctcaaaacaaaaataataaaaaaaaactcttcagacatcttttctgcaaggccccgctccccaaactctcatagacagagctagctgctccccattgtgggtcccctactccactgtcagagtcattgaaaggcctgtccctccagccaagcaaacgcagggcaggcaagggggtcacaccctaggctgtgccacatggtgtggggctgtgagagccccaggcggagactccgcggtctccttagggagcctctgggaagaggttctggacagagaagacgaaggggctgtggtggtgtcagggctggggaggagagggaagggctgcaccagggaagtgccaactcctctccctagaaccttccaccacccacccctgggcagacacagtccaggcatcattgctgcagctgtaggaaggacctgctagctaagctcatctctctgagcactgactggcaagggagccccgttcgtagctagtgttcctctgaaacagcgatgctatcagagggctggcttcaagtccctggggcctcacccttcctgggcacttgctgtttccccgcctcctctttctctgtgtgtccagagaggaggaacccctgccttgaggactggccccttgcactgcagggagaggagtagggccctgacaccaatggcgggcacctggtgtctggcctcagggatccacatgttttgagaacagatatggtcccaacttcagactgagccctgctgttctaagcatatccatatgtggctgggttgaagtcaatattccagagaaaaaatccatctgtccctaaaatttcggtttgtttgttggtttgtttgtttgtttgtttttgaaatggagtcttgctctgttgcccaggctggagcgcagtggcacgatctcggctcactgcaacctccacctcccgggttcaggcgattctcctgcctcagcctccctgagtagctgagattacaggcatgcaccaccacgcccagctaatttttgttttttggtgttttttttttttggagacgaagtttcacttttgttgcccaggctggagtgcaatggcgcaatctccagtcaccgcaacctctgcctcccgggttcaagcaattctcctgcttcagcctcccaagtagctgggatgacaggtatgcgccaccatgcctgactaattttgtatttttagtagagacagggtttcaccatgttggtcaggctggttgcgaactcccaacctctggcgatctgcccgcctcggcctcccaacgtgctgggattacaggtgtgagccactgcacctggccacctttttccttttctttttttttttttttgagacagagtcttgctctgtcaccaggctggagtacagtggcacgatctcggctcactgcaacctccacctcccaggttcaagcaattctcctgcctcagcctcccaagtagctgggactaaaggcatgcgccaccatgctcagctaatttttgtacttttagtagagacggggtttcaccatgttggccagaatggtcttgatctcttgacctcgtgatccacccaccttggtctcccaaagtactcagattacgggcctgagccaccgtgcccggccaatctcttttatcttgtttccaaaccaaatcatacctgaagacaacttcattctcttggacaaaagagcaccgatctccagctgatcctaactcacacctcccaccttctccatggctcctgcttagacaccaggacactcaaagctgtggatgcctcgggccctcccccatctgcctttcctgagactttcagaacccccaggtcaaattgacacccttacccccaccccaacatagcccactggcatcagacatgctttgctgtagtgtacacttcttttttctttttcttttttttttttttgagacagagcctggctctgtcccccaggcttgagtgcagtggcacaatctcatctcactgccacctctgccacccaggttcaagtggttctcctgcctcagcctcccgagtagcaggagggattacaggcgtccaccaccacgctcggctaactttttgtatttttagtagagatggggtttcaccatgttggtcaggctggtctcaaactcctgacctcaaatgatccacctgccttggcctcccaaagtgctgggattacaggagtgagccactgtgcccagctatacacttcttttaaagaaataaaaatgatcagaaaccataaataggcctggcttggtggctcatgcttgtaatcccagcactttgggaggctgacgagggagaatcccttgaggccaagagtctgagaccagcctgggcaacatagtgagaccctgtctctacaaaaaataataacgataaactagctaggcatgatggcacatgcctgtagtcccagctactcaggcatggaaggaggatcgcttgagcccagaagttcgggctgcagtgagctatgactaaactgctgcactctagactgggcaacagagtgagacctcatctcaaaaaaaaaaaaaattaaagccttagtttacaggcatatattatcattgcaaaggatgactgcaaaagagagttctcactgtgaccagtcatgggatctttaaaagttgtcattgataaaagatgacagagtgggaggaaagaaaaaggaaaggaggctgggcgcagtggctcacgcctgtaaccccagcacttttggaggccgaggtggacggatcacttgaggtcaggaattggagaccagcctgaccaacatggtgaaaccccctctctactaaaaatacaaaaattagctgggcgtggtggctggtacctgtaatcccagctacctcggaggctgaggcagaagaatcacttgaacctgggaggcagatgttgcagtgagccgagattatgccactgcactccagcctggcgacagagcgagactctgtatcaaaaaaaaaaaaaaaaaaaaaaaatatatatatatatatatacacacacatatacacacacatatgtatatatatacacatatatacatatatatatataatgaaagaaaagaaaaaggagcagcggggtaggcagtgggggggttggcggggggttcaccatgttagccaggctggtctcgaactcctgacctcaggagatccacctgcctcggcctctcaaagtgctgggattacaggcatgagccaccgcgcctggctgaacaagttattgttgaaataaaaatgaaaatttcaaatcctcaaggaatttgaagatctctccaaatgcattttcacgtccctgttttgagagccatccctgggaaatcacccccgcccacacacagcaagaccccagggtccagggccacctcattgtataacgtccaggacagagcaagcacttggtaaatgctaacaggtgattaagtgaaggaaggaaagatctggagtgcaagcaggggatgaagacacatgcaaaacgttggttcagaaggtgccccttcccacagtggagtggaggaatctccaaggcaggggtccatggtccccagctggtccgtgacttgttaggaatcaggttgtgcagcaggaggtgagtggcaggtgagggagcattaccgccggagctccgtctcttgtcagatcagcggtggcatcagattctcatgggagcgtgaactctattgtgaactgcgcacgtaagggatctaggttgcatgttcctaatgagaatctaatgcctgatgatctgacatggaacagtttcatccccagaccatctggctaactcctacccccaaccccacccccattcgttgaaaaattgtcttttttgaaactgatccctggtgtcaaaaaggttgggggtgctgggcacagtggctcacacctgtaatcccagcactttgggaggctgaggtgggtagatcacttgaggtcaggagttcaagattagcctggcaaatatggcaaaaccctgtctctactaaaaatacaaaaattggccgggcatggtggctcacgcttgtaatcccagcactttgggaggccgaggcaggcggatcacgaggtcaggagatcgagaccatcctggctaacacggtgaagccctgtctctactaaaaatacaaaaaattagccaggcgtggcagcgggtgcctgtagtcccagctactcgggaggctgaggcaggagaatggcgtgaacctgggaggcggagcttgcagtgagccgagatctcgccactgcactccagcctgggagacagtaagactccatctcaaaataaaaaaaaaaaataataataataataaaattagctgggcgtggtggcacatgcctgtaattccggctactcaggaggctgaggcaggagaatcacttgaacctcagaggcagaggctgcagttagttgagactgcgccactgcactccagcctaggcaagacagcaagactccatctaaaaaaaaaaaaaaagaaaaaaaaaatggggaccactgttctacgggatagaggacagggaggtggaagaaagaaagggagaagtgtgaggggcattttgtctgccctgagctctctcatacccacagcccagggcaggcagggctgggcttggagggtggaatggtctgggcagaggtcagtccgaaacttcagccctggagggagctggagctggggctttatcttgctctctttccttattttaacttaatcttgtctttattagttttatagagatagggtctcactatgttgcccaggctggtcttgaactcctgggctcaggaaatcctttcacctcagcctcacaaagtgctgtgattacaggtatgagccactgcacccagctctttcctccttttaaaaacaagaaacctggccaggcacggtggctcatgcctataatctcaataccttgggaagctgaggcaggctgatcacttgaggccaggagttcgagaccagcctggccaacatggtgaaaccctgtctctactaaaaattcaaaaattagctgggcatagtggcacatgcctgtaatcacagctactcaggaggctgaggcagaagaatcgcttgaatccaggaggtggagattgcagtgagtcagggtcatgccactgcactccagcctgggtgacagagtgagaccctgtctcaaaaaaaaaaaaaaagaaagaaagaaagaaagaaagcctgagtcacagggagaggcttctccccagcccctgggaagccgaagaagccctggccaggccggctcccaaactcaggggtcctgctaggcacctgctgtcactctcactaccgacctgggagaaggcaatggcccatttatgacactggaggcgagggccatgcaccccctaagcaggcagcacctctggagccattctgcagctggaggttcatttccttcctgatgtcatagtgctccaaggtggcacagccaggacgggagcctagggaattgtcatccaccctggagccctttctgtctctcagcggctgtcccagccctgcactcaggcaattcctgcaggaatcggtggcccctgggcgtcctggatggggaaccacagcccctgaggcagagcggcacaaaccctccagtggatcctgttctcttctcccagggatcaatgaagcccagggtgtgggagctcagccttggtgtcccggtccctgtggtcacacagcagctattgctatggggttgggatgcagggaggaaaagcccagcatccccctttccaccccaggccccaacttctctgtatttgtttatttaccttggaaaaggccccacggcccaggcaggaaatgggccaattccaggaggccaaggcggggaacaaggagctacattgtgctcgggcggtggctccccacccgggcctactgggagcccagaaggtgggggggtctgcatggggaccgggcgggaaggaggcgtggggctgaggggctgccagtgctcccagccagccggccggcctgtcaaaaggcttctgtgctgggggtgggatgggggctgtggctccctgtcccacctgggaatgaacagaggctgggcagtgggggaggcagacgctgggctggggctggcccccagtggtgacccagggcccacctggcacccatctgcctgcccaaggcagaccctggcctgggaaccccatctccttgggctgagatcccaccctggggctggggaatgttcctgccctccaccttccttctggggtctcaactcctgccaggcagctggcctgacctcagatttcccctagcccaaggctatgtcatcatgggggcggcctgaggagggctgagctctccctgaccctagactcttctttactgacaggctagtgtccatatggatggatcattcattcactcattcatttatttaatacactccctgtctgttcgatgcacactccccttctctccacttctggccccgtttcctctaatccttcattccttggttcccagagggttaaatgtagatcgatatgtcacctctggctccaaaggtctctgaagggccaggtgcggtggctcaagcctataatcctagcactttgggaggccgaggtgggtggatcacctgaggtaaggagttcgagaccagcctggccaacaaggtgaaaccccatctctactaaaaacacaaaaattagccggacttggtggtgggcgcctgtaatcccagctactcaggaggctgaggcaggagaatcacttgaacctgggaggcagaggttgcagtgagccaagatcacaccactgcactccagcctgggcaacaagagggaaacaaaaaaacaaaaaacaaaacaaacaaaaataaataatttaaaaataagggtctctgaagacttcctgctactttctgggtccatgcccctcctctccgtcctccacttcccaccgggctcttcaggctccagcctagataacaccaggttaaattttgatctcccggggactgggtgtcgggagggaaaggcggggggagtgtcagagaggggatggatttctcccaccacacttggggaggcctccggatggatatgtccttccagctgatggacctcaggattgggagaaagatcggggacaagagacgggcacaacagtcacctggtttctttttcttcctttattttttgagactgagtctcgctttatcacctaggctagagtgcagtgacacgatcttggctcactgcaacctccacttcccaggttcaaatgattctcctgcctcagccttccgagtatctgggattacaggcgtgcactgccatacccgactaatttttggattttagtagagatggggttttgccatgttggccaggctggtcttgaactcctgacctcaagtgatctgcccaccttggcctcccaacgtgttgggattacaggtgtgagccaccgtgcccagccacatggtgtcttccatgacagctccctctctgctgaaatagcatttcccacccccacccatggcatcactcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaatttttttttttttttttttaagacggagtctcattctgtcacccaggctgaagtgtagtggtgcgatcttggctcactgcaatcccgggttcaagcaattctcctgcctcagcctcccgagtagctgggattacaggcgtgagccactgtgcccggcctttatttaagatttgcctccttaaccattacacctgtaatcccagccctttgggaggctgaggtgggcagatcacctgagttcaggtgttcaagaccagccaggccaagatggtgaaaccacatctctactaaaaattccaaaattagccaggcgtggtggcaggcacctgtagtcccagctaatcagaaggctgaggcaggggaattgcttgaacctgggaggtggaggttgcagtgagccaagattgcaccactgcactccagcctgggcagcagagtgagactgtctcacaaaaaaaaaaaaaaagaagtgtcaggtgctggcagagacactgcttttccctaattgacccgtttggtcctcacattaaccatattttacagctactctcatttacagataaggaaactgggccaatgaggaggtgagaaatcgctcaaggctgccaggtacagtggctcatccctgtaatcccagcactttgggaggccaagggaggaggattaattgaggccaggagtttgagaccagcctaggcaacataatgagactctgtctctacaaaaaatttaaaaattagtggggtgtggtgatgcatgtgtagtcccagctactccggaggctgaggtgggaggatcgcttgatcccaggtgtctgagacagtagtgagctacgactgcaccactgcactacaacctcggtgatgcaatgagatgctgtctcaaaaaaaaaacacacacacacacaaaacaacaaaaaaacaaattgttcaaggcgagcctggtgtgccaagcccttgttctgggcacttggcttatattatctcccttaatccttcccaccaccccaagtgctagatactgggattaatttagttgagctgtaatacatcaatactgtgtgaaatgctatgcaacatctaaaaggaagacaggtggagcttttatttattttttattttatttattttttgagacacagtctcgctgcattacccaacctggagtgcagtggcacaatcacagctcactgtagcctcaacctcctgggttcaaacaatcctcccacctcagcctctcaagtagctgggactacaggcttacaccaccaagcttggctaatttttttttttttttaagagatggtgttttgctaagttgcccacactgatctcaaaatccttttgtttttgctttggaatggtctggaactcctgagctcaagtgatcctcccaccttggcctcccaaaggcctgggattacacgtatgagccaccgcaccaagcccaggttgagcttttaaggtattaaagatccactaggtgaaaaaaaagagtgaaagatacatatgccatttaagggaagcacaggaaaactcctattttgtttatatgtgaatagaggcgcatagatgcctagaaaagtgtctgggagggaatgaaaccagattggccacaaaaatcacctctggaaaaaggaaaagaatggggactttcactttttgcttcatatgtttcatgcacctttttttttttttttttttgagatggagtttcactcttattgcccaggctggggtgcagtggtgcaatctcagctcactgcaacctctgcctcctaggttcaagcgattctcctgcctcagcctcccgagtagctgggattacaggcatgcgccaccacgcccggctaattttttgtgtttttagtagagacgaggtttctccatgttggtcaggctggtctcgaactcctgacatcaggtgatccgcccaccttggcctcccaaagtgctgggattacaggcgtgagccaccgcgcccagccgctttttctttttaaaaagtaaaatataacagagaaaactgcacaaaacagaagtgttcaaattaaattttttttttttgagacagggtcttgccctgttgcccaggctggagtgcagtggctcattcatagctcactgcagcctcaaactcctgggttcaagcgatcctcccaccccagcctcctgagtggctggaaggcgaagggaggatcgcttgagcccaggagtttgaggctgtgccaccacacgcagctgggtttttttttttttttttaattttttgtagagacagggtctcgctatgtcacccacgctggtctcaaactcacgggctcaagcaatcctcccatctttggcctcccaaagtactgagactacaaacatgagccatcttgcccagcccctagaacgtgttatcaaataaacaccgatgcaaccctcactcagccgagaagtaaaacattgccagccaatccctaaatgcttctgcttgccgcttcccaatcctaaccaatgccttctcctgacaattatgatggtcatgtctttgcatttctctaatgtttcccatcacgatcaaactagttttgttttgcctgtgtccaaactttgcataaatgagcagcatgtgtctggtggacctggcttcttccactcaacattatgataagaagattgaccatttggtgcccatagctattgctcttgcattttcattgctctatagattcttactcaacataccttaaaattttttttattctgaaataagagcgggatgctattaaaaaaagaaaaaagaagagaacaaaaaagtcctccagtaaatttaaaatatggtagtcaaggccgggcacggtggctcacacctgtaatcccagcactttgggaggctgaggtgggtggatcacccgaggtcaggagttcgagaccagcccggccaacatggcaaaaccctgtctctacgaaaaaaatacataaatcagccaggtgtggtggtgtgcacccgtaatcccagctacttgggaggctgagacatgagaattgcttgagcccgggaggcagaggtttcggtgagctgagaactgccactgcactccagcctgggtgacagaatgagactataaaagaaagaaagagagaaagagagagagaaaggaaggagagaagggaagggaggggaggagaggggaagggaggggaggggaggggagagaaggggaagggaagggaaggagaagggaaagggaagggaagaaaattagagattaattcaggagattcaacatccgcctaatagaaattctagaaagaggaagtagagaatagagaggccaggtgcagtggctcacacctataatctcagcactttgggaggctgaagtaggaggattgcttaaggccaggagtttgaggctgcagtgagctatgattgagccactgtactccagcctggaaaacaaagcaagacctcgtctctaaaagtaataatacgccgggacggtggctccccacactttgggagcctaaggtgggcggatcacttgaggtcaggctttcgagatcagcctggccaacatgatgaaacccaatctccactaaaaataaaaaaattagccaggtgtggtgctgcacacctgtaaccccagctacctggaggagacaggagaattgcttgaacccgggagatggaggttgcatgaggcgagattgcctcattgcactccagcctgggtgatagaatgagactctgtctcaaaataataataataataataaagttaaatataaataaataaaagcaaatgaatataatgagttttattcatttgttttgctgttgttattgttttggagacagagttttgttcttgtcgcccaggctggagtacaatgatgcgatctggtctcactgcaaccttcgcttcctgggttcaagcgattctcctgccttagtctcctgagtagctgggattagaggcgtgtgacaccacgcccgggtaatttttgtatttttagtagagatggggtttcaccatgttggccaggctggtctcgaactcctgacctcaggtgatccaccaacctgggcctcccaaagtgctgggattacaggtatgagctatcatgcctggccccatttcttttaaaatcagaaggaaaaaatatatataacttttaggccaaaaatgtcttcacgtatattaatagattgatcttttcccaatgcaaccataaatatcattttttaaaattattattattttagaaacagggtctcactctgacgcccaggctgaagtgcagtggtatgatcttagctcactgcagcctccaattcctgggctcaagcgatcctcccacatcagcttcttgaatgtgacctcaggcagacgtcaccgtgcccagctaatttttaatgtaattttatttttttggtaaagatgggttctcattatgttgcccaggccagtcttgaactcctggcctcaagtgatcctcctgccttggcctcctaaggtgctggtattataggattgagccaccaagcccggcccgaatataatttttaattttttttttaagacagagtttcactcttgttgcctaggctggagtgcagtggcatgatctcggctgaccgcaacctccacctcccgggttcaagcgattctcctgcctcagcctcctgagtagctgggattacaggcatgcaccaccacacccaaataattttctatttttagtagggacggggtttctccacattggtcaggctggtcttgaactcccgacctcaggtgatcctcccacctcggcctcataaagtgctgggattacaggcatgtgccaccacgcccggcctaattttctaatttttttttttaactgaagaaggaccccaggaagtcaaaagtgcctataacccatgaaagtctaaatgaggacaacggaggctgggcatggtggctcactcctgtaatcccagcactttgggaggccaaggtgggcggatcacctgaggtcaggagtttgagaccagcctggccaacatagtgaaaccctgtctctactaaaaaacacaaaaattagtcgggtgtggtggcgggcacctatgatcacagctactcaggagggtgaggcaggagaatcgcttgaacctaggaggcggaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagagaatggagtgtgtgtgtgtgtgtgtgtgtgtgtgtgtgtgcgtgtgcgtgagtgagagagagagagaggaagaagggagggagggagggttacaggagtgtgggaaagtcaacaggaaaaggagggaaggttcgctgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccaggcgtggtggcgggcgcctgtagtcccagctgctcgggaggctgaggcaggagttgctgggcactggacacaaggatttctatcagtgtgctctcctgcacatcacccaggtctggagtgccaggaggatcaaaaacatagaatcaaagattagccaccttccaactccaagtttcccccaccccatgccaccgttcctgccttgtacaagtgaagcaagcaatctctcctggtttcaccctaggaggtggaaggtccctggccctggctccatgtggcacgtgctctggtccttctccagcagcaggcttgtcagaccctcccagtccttcagctgagtccctgcacagtcccacaggttgtctactaagtaagcagcgtggtcgtggagctggggaaggaggtgcatggggatttagtgatggcatgttaaaataccctaggaagtggttactgattaaatatcgctctccttcctacagtgtacacccccatccttctccatctgtcttttttttttttttttttttttggtagagacagggtctcactatgttgcccaagctggtctcaaactcctgggctcaaaggatcctcccacctcagcctcccaaagtgttgggcttacaggcgtgaaccaccaaccccagcccacttgtaggtcctatgcacaacagccagagttatctctgtgtatgtcaccttgctctccacaaagaaggacagcagaagctggaagaaagtcctctgggcacctgggctctggcgttgctctcttccacccatcgttcttatctcgcactcagggtagaaaagtctggtggaatggacacaaggaaagggctcagcacaggaggaaacaaggaggtgtaatgatgaccacagagggaggagatggcccaaggagatgataaaggaaaaggaggtgcagagctaaggaaagccccaaggagctgagagaggaaaagagacagcagagagacttccacggagatggggaggccttaagtagggcagcagcacatgtgggagagaaaccgagagggtggtgttaaagaaacgtaaaaggagccccactcacttccagtacagaaattcacccacagcagaggccaggcctcaattagaggcctacacaatggggtagacgctctcacagtccacgtccatcagcaccccttccatgttcctgcccacagaaaagcagaaagagtgtgtgaatagggacattgtcttctggcacaatcaaggctagaaagaaaaagaggcaaaagcaacaaggacataactcacaaaaaactcctaaatggagagtggaagacaagggagtatggggagttagagaagacagaaatattaccctctcaacatactgcaactcaggaatgacctcagtcaacctgcacagatggaagagtcagctgtgacaggtggagggagatgaccctggaagggcaaaggtctgagacactggcctcccctcttcccaggactcacttaaggataagtatcagtaatctgacggcctccactgccacactgtactctctgtccatgatcatggaaaccatccagtcctgcagaaaggagaaagtcactcaatatctcattacgcccattccaaatattctgttctcttagaatcagagcctcctaaagagagtgcctacgtagaggcagatgctgggatagccaagacatcttagagcatgaagggtagaaagatacaaggtggggaaacgggaaccacgacaaagagccaagccaaggagcaccacctgtctcaccttgaagcagccagtgaagagctccaggcgtgcggtcaggtcccggttaccgtacagccctttcagagccttcacgcacttcacgcggacttctcggtgctggtgaggagggaaaaccaagagaatggaaataagaccaaccacactctactcgcccctactgagcgtccagactcccctctccgatccctcattctagcttgggtgtcccctctactgaggactctaagatgtcagaaacaatgaacagctgtcttcatacttaaaaaaaaaaaaggatcacagcagtactcatgatgagaaggatcctttggctgccccttagcacctgcattaccatccatcaataactgtcttccattgtaaagtctctctccccgtacctcatgttttgagtcatttcatctcctgggtatgtctctctctaccttatcctaccctccccagtgctagcggagtttcaaggttcagcgccttgatgggttaatcattggtcactaggtaaaatatctcagtggcaggcccaggaaaaggtgaagtgtcctaggacaggaaaaagatgaaggaaacggaaagggaaactgactcgaatcccaccttatcatgcagagtccaaccaatatattttaaatagctgtcggtgaggaaagacgtgctgtagctttgcatccaacacccaatttcctcaatgcagatagcacggatctcaggaaggacatccctagacacagacagataagttgactcttagagccaccctctctccaaactcactttccatcctaccagttaactccctctcatggaagaatttattttcttgaaatgccatgtaccccatgcctttcatttcttcctcccgatgtaaatactatatatatagtaaaatacatgtaaatattttttctcttttttttaagggatggggtctcttgctgtgttgcccaagctggccttgaactcctgggttcaagtcatcttcccactttggcctctcaagtagctaggactacaaaaatgtgccatacccagttagtaaatattttctttctgttaccaaaccataaaatagttaaacaccagccttgtacagcctaattctccactccacctgttgcccaggctggagtgcagcggcacaatctcagctcactgcaacctctacctctcgggttcaagtgattctcctgcttcagcctcctgagtagctgggattacaggtgcaccaccacgcccagctacctttttgtatttttagtagagatggggtttcaccatgttggccaggctggtctcgaacttctgacctcaagtgatctgcccgtcttggcctcccaaagtgctggagttacaggtgtgagccactgcacccggcctccatacctcttttaaaaaccaattttgaaagttcattcaggctgggcatggtggccaaaaattagccaagcatggtggcgggtgcctgtagtcccagctacttggcaggctgaggcaggagaatcgcctgaacccgggaggcggaggtgcagtgagccaagatcgcgtcactgcactccagcctggtgacagagcaagactccgtttcaaataaaaaactaacacactgtacaactgcatgtaaggtggaaaagacaactggaattaaaatgtgctcaggtccttgtagaagataagaaatccagaggaaagcaagcaaagggggaaaaagaaacagaaaagataaaatgattgtaccaactcaatactaggccataaggctaagtctccataaatttttttttttttttttttttttttgagacagagtatcactctgtcacccaggctggagtgccgtggcacaatctcagctcactgcaacctccacctcctgggttcaagcaattctcatgcctcagcctcccaagtggctgggattacagacaaatgccaccacatgcagctaatttgtgtatttttagtagagatggggtttcgccatgttggccaggctggtctcgaactcctggcctcaagtgatctgcctgcctcagcctccccaagtgctgggatcacagatgtgagccactgtgcccagcccccacataaatttcaaacaccacattccctgactacaacacaataaagttagaaatcaaataacgaaaatataactagcaaaattctgtatgtttgaaaattttaaatattttcccagaaactataaaactacatgttaatgtggataaatctcaaacaatcttaactgaaataattaaatcacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcatttcttgagctggggctagagatctgggtgatatctcatttttattttttaaactacatatacgctttgtacactttcagatattagaacttcaataaaattataaaaaaagaaacagggaaaaaataattaagtataattgtcaagatggagctaaaaaataacacgggtgaacaaggtgccacccacatctaagcttccttcccatgtcatgcaatgcctctcctcatctgctccatcaatcaataaaggcataatcactcctgtgatacctttaagaaaagaacacgctttaagaaaagaaacgctctctcgaagccgggtgcggtggctcacacctgtaatcccagcactttgggaggccgaggcaggcggatcacctgaggtcaggagttggagaccagcctggccgacatggcgaaaccccatctctactaaaaatacaaaaattagctaggcatggtggcacatgcctgtaagcccagctacttgggaggcctcagcctcccaagaccatgagaatcgcttgaacccaggaggcagaggctgcagtgagctgagactgtgccactgcactccagcctgggcaacagaaagagactgtctcaaaaaaaaaaaaaaaaaaaaaaagaacatgctctcttattcaaggttacccttctatcactccaaggattcaccccataatcttatctttcttgatatgttacactcactaaaatgttcacatcaaatcaagtttgtagacacttgtccttaccaccttacaaaaagtgagatggtatcaacagaggtaagacactgcttttacctgcatgtcacttttggcagctttcgcagcattgaaaagatcattggctggtggctctgactgtttccggctatgacgatgtaccgcttgggaccctttctttggatattttgccacctgatacacataaaaagatcagaaatatgaaaaaaaggtaacagtgacattaacacttggtttcatcattatcacacaagtaggcttacgctgccaattccacagcagtctgagttagactcagtcctgaaataattgatttttatattatgaagtttattaacttttttccctttaaaaaaaaaattccttgagtctccttcccgtatctctataaccaaacatccttttcttttcttttcgaaatttctcttcttcctatttccgtcccttaatactttgtaaatcttgtccttttttgaaccatatcacctgaacctcttaggttttctcttttttttgagacggagtctcgctctgtcgcccaggctggcgtgcagtggcgtgatctcggctcactgccagctctgcccccggggttcgtgccattctcctgcctcagcctcccgaatagctgggctgcttcccccacaagattcaaaaacaaaagaaaactggctgactcaccggcgttgttttcagtggtcgttttgctgctttcttcttcacaccgcgattgaagctgtcctcaaatcattttcttgtcttcttgtctatttgtatgaattactgagttacattctcattgctacttatttaagcaaagtattcttagtttgttaagaacaaagaactacaaattgtgttcattttctgtcctttcctgttcttagactaaattacctgaaatacatcaaaatatatgctgtatgcttacctatatcaaaactatgttgtttaggtgccgggcacagtggctcacacctgtaatccagcactttgggagttcaaggcgggcggatcgcctgaggtcaggagttcaagaccagcctggtcaacatggcaaaaccccgtctctactaaaaatacaaaaattagccaggtgcagtggacagtgcctgtaatctcagctactcatgaggctgaggcctgagaattgcttgaacccaggaggccaaggtggcagtgagctgagatcatgccactgcactccagcctgggtgacagagtgaaactccgtctgaaaaaaacaaaacaaacaaacaaacaaaaaaccagaccatattgtttagggatacttagctgacaaaataatagagacaagcatgacataattaccataaaaatcaggccctggggtgctggtggggaaggtttaagtggaaagaatggagcggtgacaatgtgtgtcaacctgggaggtggtgaccctggggttcgctttgtaattcctcaaaatgagcatttatgtgctattcacttttcagaggatagaattctgaactaaaatgtttaagcagccatacgcaaaaaaagaaaaaatatggatagatttttattttaattaaaacatttaaaaaatagagacaaggcagctgggcgtggtggctcacgcctgtaatcccagcaatttgggaggccgaggcaggcgaatcacgaggtcaagagatcgagaccatcctggctaacacggtgaaaccaagtctctactaaaaatacaaaataaagttagccaggcgtggtggcgggcgcctgtagtcccagctactggggaggctgaggcaggagaatggcgtgaacccgggaggtggagcttgcagtgagtcgagatcaggccactgcattccagcctgggcgacagagcaagactccaactcaaaaaaaaaaaaaaaacatagagacaagggtcttgctatgttgctcagggtggtctcaaactctccgggctcaagcaatcctcccgcttcggtctcccaaagcgctgagattccaggcgtgaaccaccgcgctcgaccaggaaaaaaatatatatatatataatatacaatatattttataatatattatgtcatatattacacataatatacaatatgtataatacgcataataaaggtatatttaatatatataaagatatatatgtatataataatttttttttttgagacggagtttcactcttgctgcccaggctcgagtgcaatggctcgatctcagctcactgcaagctccgcctccagggttcaaaccattctcctgcctcagcctcccgagtagctgcgattacaggcgcccgacacacgcccggctaatttttgcatttttagtagacacggggtttcaccatgttggccagactggtctcgaactcctgatctcaggtgatccgcccgcctcggcctcccaaagtgccgggattacaggcgtgagccacggcgcccggcctgaataaatcttttaaaacataaaaatctgggtgagcccctggccggccggcacagatgccggggtggggccgcgaatcggttgggacgcactctatccggcctaggggcacccgggccagcacccggccgccgcgcgtgcgcagtgggcggggtgccccgcgctcctacctgcaagtggccagtgccaagtgctgggccgccgctcctgccgtgcatgttggggagccagtacatgcaggtgggctccacacggagaggggcgcagacccggtgatagggctttacctggtacatcggcatggcgcaaccaaagcaagagagggtggcgcgtgccagacaccaacggtcggaaaccgccagacaccaacggtcggaaaccgccaagacaccaacgctcggaaaccgccagacaccaacgctcggaaaccgccagacaccaaggctcggaatacacgccagaccacgacggagggcgaccacctcccttctgaccctgctgcgggcgttcggaaaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccaatgggagcccaggaggcggggcgcctgtgggagccgttgagggcactttcccagtccccgaggcggatccggtgttgcatccttggagagagctgagagctcgaggtgagctgggctcgcggtcgcccctctcgctcgccctctttgagaaccacggcttccgacctccctggaaatggggggaacatggccgaggcgcgtgggaggccgcctcgtggaggccccggagcggcatcctcagcgccccagcgatccggtgcccattaggtgcgccttgaagccgaggcaagctccttcggggtgctgggctgcgggcaaagaattcggccctgtgaagagttgggttcggcctgtctcaggccctgcccacatcccatcacagggccgtggacttgaagccggaacgtgaaatccccatagactgaatgcatttcctttctacctgttctctctccccttttatttttatttttatattattttatttttaatttttattttatttttttgtagagacggggatttcgctatgttgcccaagctggtctggaactccggagctcaagcagtccgcccgccttggccccccaaagctctggaattacaggcgtaatgcactgtgcctggccttttaaaaaaaaattgaggttattttggggacagtagagcgtccagacacatcctaatttgcgtagctgctcagttttaaaaaatgcaatgcatttttacctcttagggtatgtgatttctggctggtaagctacaccgaatcttggctagcacagttgaattccatgtcagatttgtaaacgcaaatttgctctctgcatttaaatatattagatatatttaggtaactacatttaaatgtattgagacatttaaatacacttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagaggttgcagtgagctgagattgcaccactgcagtctagcctgggtgacacagcaagactccatctcaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaacagtaaagaggtttgtttatttcacaagggtttattgaaggcctacgatgtgttaaatgctgtaggaaatacccactaatttctcttttcatgtaggtttcccgccttctcttaacgagtgatcaattaaactgtttactgggaacttgctaagttaatgaacacacgggatacattctttggatgagcagacattgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaactgttataaaactcttaaagtgggctgggcatggtggctcacgcctgtaatcccagcactttgggaggctgaggcgggcggatcacgaagtcaagagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagatggtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaagctgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatatacatatatatacatatatatacatatatacatatatatatacatatatatacatatatacataaatatatacatatatatacatatatacatatatacatatatacatatatatacatatatatatacatatatatacatatatatatatatatattttttttttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttatatttttagtagagatggggttttgccatgttgcccaggctggtctggaactccaggcctcaagtgatctgccctccttggcctcccaaagtgctggaattacaggcacgagccaccgtaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcaactggtgtttttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcaccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggctttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgggctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccacccacctcagcctcccaaagtgctgggattacagtcctgagccaccgcgcctggacttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaataatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaaattaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtgacaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttctttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatcccccactatggatggagacacttaggtttagcaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaaacaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctggttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctttttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggcaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcactgtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagccttccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaaatattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactgtgttgaccaggcttgtctcaaactccttgcctcaagcaatccacccacctcagcctcccaagtagctggaactacaggcgcatgccaccacgcctggctaatgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctgtaatcccaggtactcaggaggctgaggcaggagaattgcttgaacccaggaggcagaggttgcagtgagccgagagcgcaccactccactccagcctggacaacagagcgagactccgtctcaacaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctggacagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaatgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagatggtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatatacatatatatacatatatatacatatatatacatatatatacacatatatacacatatatacatatatatacatatatacatatatatacatatatacatatatacatatatatatacatatatacatatatacatatatatatacatatatacatatatacatatatatacatatatacatatatacatatatatacatatatacatatatatacatatatatatacatatatatgtatatatatatatatatttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacgtgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccacccacctcagcctcccaaagtgctgggattacagtcctgagccaccgcgcctggacttttttttttttttttgagaggggttggggagacatattctctgctagtgattctcctgcctggtctcgaactcctgctgggatcacaggcgtgagccaccatgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaataatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaaattaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtgacaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgtgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttcttttttttttttttttttgagactataatcctgtcttttttgtacacagagtaaagaggacaaataggtgaaagaataaatgaaaggctggaatcccacttcccccgctgtcccagggcattggatattgatggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatccctcactatggatggagacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattaccatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcacctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccgcatctctactaaaaatacaaaaaattagacggggccaggtgccatggctcatgcctgtaatcccagcactttgggaggccaaggagggtggatcacgagatcaggagatcgagaccatcctggctaacaccccatctctgctaaaaatacaaaaagtagccaggcatggttgcgggcacctgtattcccagctactcaggaggctgaggcaggagaatggcgtgaacccaggaggcggcacttgcagtgagccaagatcataccatttgcactgtagcctgggctacaagagtgagactccgtctcaaaaaaaaaaaaaaatagctgggtgtggtggcacgcacctgtagtctcagctactcgggaggctgaggtgagagaatcgcttgaatccaggaggcggaggttgcagtgagccgagatcgcgccatcgcactccagcctgggtgacagagtgagactctgtctcaaaagaaagaaaaagaaaaaaaaagaatatgccgcagtgcatttgttcatttctcctgctggtggacacttgggtccttccagcaccactgtgaacattgtgatgaacgttcctgcacacacacctctctagaacagtcaccaggagcggagctgctgggtcatggggtgtgggtgagtccattgctggtgctggggtttccttggtgtttgtacaccttgcattcccaccagcacatatgagagaatactttgtttcaaatctctgccaacaccgagtattcatgacactgatctttttgcaagtgtaaatcagatcatgtcactctcccgatttaagccctatttttttttttttttttttggaaacagagtctcactctgtcacccaggctagagtacagtggcatgatctcggctcactgcaacctccgcctcccgggttcgagcgattctctgatctcagcctcccaagtatctgggactattggcgcacgccaccacgggtgtctaattttttgtatttttggtagagacgatgtttcaccctgtcgtccaggatggtcttgaactcccaagctcaaacagtctgcccacctcggcctcccaaagtgctggggttacaggttggagccacccagcccagcctagatttttagcttgatgaaaatcctggtttgggaacagagtcagctccacagcgggtcatctgattttttttttttttttttttttgagacggagtctcgctctgtcatccaggctggagtgcactgggctcactgcaacctccgcctcccgggttcaagcgattcccccacctcagcctcccgagtagctgggattacaggcacccaccaccacgtatgactaatttctgtatttttgtagagatggggtttcaccatgttgaccaagctggtcttgaactcctgacctcagatgaaccacccgcctcagcctcctaaagtgctgggattacaggtgtgagccaccacacctggactgttcttttctcttacgtttggtcacctggtgcctctgaactccctcttccactctctctacatcctgatgcacaatttatttgaaaaggaggaaacattttccgtcccaagtccctttttactcctttctttcccaacaaaacctgtacagaatcctcacactactgtgttctgtagaggagcggagagggagaccagttctccactcccctggccctgctgacacctggagggtgccaggcatgttcatggaaacagcagcattgcagccttccttccttccccacagctgtatccgtgtgagtctggacaacaaggacttgtcaacacgaatctctctcttctcctggtgtaagacagaacaaaaacaaaagacgttggagtagagatcagaaaagggtgggtttgcgatgtttgggagggttgagtgggcattttgacaacttagcttctccttgggtggtatttagcagatgcccttgtggtttaaactgtagctttagatataaaatccactcctggtcaggtgcggtggctgacgcctgtaatcccagcactctgggaggctgaggtaggcagatcacgagatcaagatcagcagatcgagaccatcctggctaacacggtgaaaccccatctctactaaaataataattaaaaaaaattagccaggcatagtggtgggcacctgaagtccccgctactggggaggctgaggcagaagaatggcatgaacccaggaggcggagcttgcagtgagccaaggtcatgccactgcacttcagcctgggcgacagagcgagactctgtctcaaaaaaaaaaaaagaaaaaagaaagaaaatccacttctaatgctacctggggccctgctgcttgatggagaaactgaagaacgtaaaggatcttgtttgagggtttgtgttgttgtgttgttgttgtatatttgtttgttttgaggcagggttttgccctttcacccaggctggagtgtggtggcacaatcacagctcactgcagcctcgaactcctgggctcagatgatcctcctgcctcagcctcccaagtagctgggatcataggtgtgcactgccatgcctggctaaattttgttattttttttagggacgagttttgccatgttgcccaggctagtcttaaactcctaggctcaatctagcctcccacctcagcctcccaaagtgctggaattataggcatgacccactacacactacacctagtttttgttatttatttatttcttagagacagagtctcctctgttgctcagccaggctggagttgagtggtgccatcatagctcactgcagccttaaactcctgggctcaaatgatcctccagtctcagcctcccaagtagctggaaccataggtgcacatcaccatgccaggctaaattttaaaatttttttgtagagatggggtctctgatactgcccaggctggtttcaagcttctgggctcacatgatcctcctgcttcagccttccaagtagctgggaccacaggcatgtaccaccatgcctggcttctatatttttgtagagttgggggatcttgctacgttgcccaggctgatctcaagctcctgggctcaagcattcctcccgcttcagcctcccaaagtgctgcaattacaggcatgagccactgcacccagcctcagcctaacagatttgttttttttttttttttgagacagagtctcgctgtgttgcccaggctggagtgcagtggtgcaatctcgtctcactataacctccacctcccaggttcaagtgattctcgtgcctcagcctcccaagtagctgagagtacagggcatgccaccattctcgactaatttttgggtttttttttttgttgttgttgttttttaagattgagtcttgctctgtcgcccaggctggagtgcagtggcacgatctcagctcactgcaagctccgcctcccgggttcatgccattctcctgcctcagcctcccgagtagctgggactacaggcgcccgccaccacgcccggctaattttttgtatttttagtagagacggggtttcaccatgttagccaggatggtctcaatctcctgacctcttgatccacccgcctcggcctcccaaagtgctgggattacaggtgtgagccactgcgcccggcctaatttttgtatttttaatagagacagggtttcaccatgttggccaggctggtcttgaactcctgacctcatgtgatctgcccctgcttagcctcccaaagtgctgggattacaggcatgagccaccatgcctggccagatcttatttggaaatggtattctgcattgtaatttttgttctgttttatttttacattttctttttatgacatatctaggatttgctttaaaacatcccagccaagaaaaagaggggaaggggaggacagtttggagcacattggcaaaatcctgattgctatttaagctgggcagtgggtccatgggggttcactgtactcttctgtctacttttgtaaatgtttaaaaatgtttgttgtaaaaagttccttggttttccttatgtttctccagagaggaaaaaagatgttcagttttatatcttaaaatgtacaagctaccttgttagaataaaactaaatgtgtatgctgctgggcaccagggctcatgcctgtaataccagcactttgggaggccaagacaggtggatcacctgaggtcaggagttcgagaccaacctggccagcatggtgaaacccctgtctgtactgaaaatacaaaaattagtcgggagtggtggtgcactcctgtaatcccagctgctcaggaggctgaggcaggaagatcactttaaccctggaggagaaggttgcagtgagctgaaatcgcaccactgcactccagcctgggcgacacagcaagactctctgtcaaaaaaaaaaaaaaaaaaaaaaaaagccaggactagttcatcaagaagcaaaataatatgacaaaccctacttaaatgatttcatctggtttcaaccactgccagctggtttgatccagtttcagctggtttcaaatgacttcatccagtttcagccaggttaattcagcttcagctggttgtgaacagtttgtggctcctttcaaccagtttcaggtggtttcagccaaagtcatccaatgttggctggctccaactggtttaactcctgtttcaactggattcagctgatttccactctccttaaggctgtgctgtccaattcagtagctcctagctacatgcagctctttacatttaaattgattaaaattaaaggaaggccaagttcgctggctcaccctgtaatcccagcactttgggaggccgaggtgggaggatcacttgaggtcaggagttcgagaccagcctggccaacatggtgaaaccttgtctctactaaaaatacaaaaaacattagccaggcatggtggtgggtgcccatagtcccaactattcaggaggctgagtcaggagaatcatttgaacctgggaggtggaggttgcagtgagccgagatcacgccactgcactgcagcctgggcaacagagcaagactctgtctcaaacaaatagataaaatgaaatcaaaatttcttttctagtgttacaggcagaatgtttgtggactctccaaaattcatatgtcaaactcctaactcccaatgtgttggtatttggaggcgagaagtttgggaggtgatcacgttgagaggaggttataagggtggaattcacttgatgggattagcagccttttgagaagagtcatcagagagcttgcttcctctctccctgtcttggtccattctggcactgctataaagaaaaacctgagactgggtaatttataaagaaaagaggggtgttttgttttgttttgtttttggagatggagtttcgctgtcatcacccaggcaagagtgcaatggcacgatcttggctcactgccacctccatctcctgggttcaagccattctcctgcctcagcctcctgagtagctggattacaggcgtctgccaccacgcccagcaaatttttgtatttttagtagagacggggtttcaccatgttgcccaggctggtctcgaactcatgacctcaggttatccacccaccttggcctcccaaagtgctgggattacaggtgcaagccaccacacccagccaagaaaagagttttaattggcttacattccatgggctgtacaggacgcatgattctgacatctgctcagcttctggggaggtcttaggaaacttacaatcatggcagaaggtgaaggggaagcacgcacatttcacatggtcagagcaagaagatgagagagaggtggggaggtgctactcacttttaaacaagcagagctcatgataaccttctaccatgaaaacagtacggaggggatggtgccagcccattcatgagaaatccgccccgtgatttaatcacctcctaccaggccccacctccaacactggggattacaatttgacatgaaacctctttttttttctttttttgtttttttttttttttgagacacagtttcactctgtcgcccaggctggagtgcagtggtgccatctgggctcactgcaacttctgcctcccaggttcaaacgattctcctgcttcagcctcccgagtaactgggattacaggtgcccaccaccacacccagctaattttgtatttttagtggagacagggtttcaccatgtggtccaggctaatctcgaactcctggcctcaggtgatccgcccgccttggcctctcaaagtgctgggattacaggtgtgagccactgtgcccggtctcggcatgagatttaagcaggggacacagagccaaactatatcactccccatcatgtgaggatacagggagaagacagccatccacaaaccaggaagtgggccctcaccagacaccaatctgctggttcctcaatcttggaattgtgagagagaaatgtatgttgtttaagccacccagcctatggttttctgtaacagaagcccaagtagactaagatactcagtcacgctgctcacaattccagtgcctacaagggccaggaccacatgtgttcaagtggccagcatattggatggtgcattcatagaacatttccatcaccacagatggtccttctgggcagctctgctctcgggaggagttcagatgtagagatcatggcagcaaaagtctctcagagtcaggtgagaggcaaaaagataagtctgttattggctgggtgcggtggttcacacctataatcccagcactctgggaggccgaggcgggcagatcacaaggtcaggagatcgagaccatcctggctaacatggtgaaaccctgtctctactaaaaatacaaaaaattagctggacgtggtggcaggcacctgtagtcccagctattcaggaggctgaggcaggagaatggcgtgaacccaggaggcggagcttgcagtgagccaagatcgtgtctctgcactccagcctgggcaacagagggagattctgtctcaaaaaaaaaaaaaaaggaagtctgttattaacaccaggaatgatcattgtcacttttttttgagacagagtttcactgttgttgcccaggctggagtgcagtggcccactgcaacctccacctcctgggttcaagttgttctcctgcctcagcttcctgtgtagctacaggtgcccacaaccacacccagctaatttttgtatttttagtagagatggggtttcaccatgttggccaggctggtctcgaactcctgacctcaggtgatccacccgcctcagcctcccaaagtgctgggattacaggcatgagtcacggtgtccagcccattgtcactttttactgagcacctgctatctaccagggagtgtcaaatgtgtaaaaatgctatcagtatgccttccaacaactctatagggtgggcattatcacccatattaacagagaaggaaaatgagggttttttccttttttgtttggttggttggttttggttttggttactgagacagggtcatactctgtctcccaggctggagtacagtggcaagcctcatagctcactgcagcctcaacctcccaggctcaagtaatccccccaaggagctgggactacaggcatgcaccaccatgcctggcttttttttttttttttttttagaggtggagtctcactatgttgcccaggctggtctcaaactcctgttctcaagcgatcctcctgcctcagcctcccaaagtgctgaggttacaggcgtgagccactgcacctggctaggaaactgagttttttcagtggtagaggctcctagccagtggccaagggaaagagagagttctgggttcaggggctggcaggaagttagcaagacaccagggactcagctacactggctggatctcagagaagagcaactgccacagtggggacctggagcacaaggggaaactggggcagcagctgcaccacagggttggcggtacctgataagggaagaggatgacttccataagtaggcccacaggtgcccagggctccccatacccactgggtgccaggtctaaaaccatgagaccagtaccagcaccaaccactcaaggagctgagacggctgacccactctctgccctggctaggactggccccagcacccccagtggggaggcctcaatgatcccagctgccaggggcccaggaacactagcaacagaagaatggccaaagtgacagggaacccttgagaccctagagcagcaatgcctgggccgggcctgatccttcccaccagcccccagccattcctggccttctgccatgcttcctggttggtctgcaaagtgcctggggcaaataccttctgggagaagagtagagagggtatccaggctccatgggcctcaggattcctgaagtaggaggctctgatggggccaccctgctctggacagaaattccctagcctcagggacatgttgaatcttgtcacccagaggaaccaagtggctgggtggtagcccagtgcagtggctcatgcctgtaacctcaacactttgggaggccaagacaggcagatcacgaggtcaagagattgagaccatcctggctaatatggtgaaaccccgtctctactaaaaatacaaaaattagctgggtgtggtggtggcaggcacctgtaatcccagctactcgggaggctgaggcaggagaatcgcttgaacctgggaggcacaggttgcagtgagctgagatagcgccactgcactccagcccgggcaacagagtgagactccatctgaaaaaaaagaaaaagaaaaaaaaaagaaagaggctggacagcaaaataaaatggttccccagttcagcctttggaggtaccaaccgtctgttagcagagctctaagaccaaatgggctcccactccaggaacgtcccccttcccacaggggctggggagatggagtccggggctgtgctgccctctggagcagcaggtggaggccaaggcagcctcactgttctccggggccctgggaagccatgcagagaggcagaggtcctttatgtgccagatgaggctgctgtcaagggactgcaaatctgcttgaggtgtgacatatctgtttttagaacaagaacatcacatcaggaggagccggtggccagagcttggggaaaggggggatccaggtccaattcccatgtatctagggcacatgtgcacagcactgagggccactccagcccctccccagctctcagaggaccctgctcccacctgccttttgctctgctatcgggcagatggcattgtctctgctttgcaactgatgaaataggaactctggcttctgggctaggctgagagggtgcttgctgctgccattcctggcccaggtgagacattcggtcatgagcatctgtagctcttgcctgagcctctgagcctgccagggcagagcagaagcaaatgcatgaaggcccctcccccaggggctgctcttagccagtgactgatgaaaatgggtgtgtaaacagcttagccacatgaccccacacaggtgggacaaccatgggtttccacattctgtactgcctcccagaggtccccaccaggtttaagctcaattgcccacactggtaactggtaacttccttgatagcactcatttcttttttcattcttttggtgtttttttagatggagttttgctcttgtcgcccaagctggagtgcagtggtgtgatctcagctcactgcaacctccgcctcccagattcaagcaattctcctgcctcaccctcctgggattacaggcatgtgccaccacacctggctaattttatgtttttagtagagagggagtttccccatgttggccaggctggttttgaactcctgacctcaagtgatctgcccacctcagcttcccaaagtgctgggattacaggcatgagccactgcgcctggccatttcctttctctctctctctctctctctccctctctctctctctctctctctctctctctctctctctctggctggagtgcaatggtgcgatctgggcttactacaacctctgcctcaagagtccctctgctgggactacaggtgcacacaaccacgtccagctaatttttgtggggtttttttgtttttttgtttttttgtagagatagggtttcgccgtgttgcccaggctggtctcaagcagtcctcctaggttcaagcaatcttccggcctcagcctcccaaagttctgggcttacagacctgagccattgtgcctgactaacacccctttcttggcagccttcctgtccatatctggcctctctactcccctacctgggtttctgggatgacttgcacttaagtccttggagggaactttaagcagaaggatagaggagaaaactcagaaatggtgtgggaccagcagcttccccattgtctggtctggagtggaggtggtccagggatccggggagcctggctcaagcaggatagaagtgacatccaggctggccatcagggggtgcagttcagcagcagagtctccaggcctgctcacacttggactggtgcaggattctcttctggatagcctgtttagattgcagtaggacctgaagacttgaaattggtgttcagccctgggagaggggtctggccaggcttgcacagctgggtccaggctcaggactgaggtagaagcatagtattcatcacagctggagcaaaagtccagaagaatggacttaacactcccagtgggtcagaggagaggctagcacggggtacagacaagattctgcagacagaggccagaagattttgtaggctacaagattccgtagacagaggctcatgcctataatcccagcactttaggaggccaaggcaggtggatcacttgaggccaggagttcaagaccagcctggccaacatggtgaaaccctgtctctactaaaaatacaaaaattaaccagatgtggtggcgcatgcctgtaatcccagctactcaggaggctgaatcaggaggatcgcttgaacccaggaggcggaggttgcagtgagccgagatcacaccactgcactgcagcctgggtaacagagcaagactctgtctaaataaataaataaataaagaaataaaatcatgcagacctcatccccaggaggcagtctgaaatggctcaggaaaaaaaaaacagcaggtgaaatttgtgcagggggatctcacctgaacaaggatcagaaagacaaggggttgtccccaaacctacccaccctcctagtggcagctggaccctggaccccctcaccaccaccagcctaccccatgctatccatcaccggccagctcatgtcctaaacatctctgcatccctcctctctctccatccacgctgctgcctcactggtcctggccaccacggctctctcagctaggctgcagtcacttccaggctggattccccacccctgcccttgacctcctcctgtcctctactccacaaggcagccagaagaatctgccaatgtatccagtcttctcttgggctagagccttctggtggcttccaatctgcacccatccaagccctttgtgtcaggcaccatctcatcttcataaatcctgtttctattgcctggaggactcccccagccctaacttcccctgttcctaaatgacatttcaccacccttcagatctcaatgtcacttttgacagaaaccttagccaggcatggtagcacacacctgtggtcccagctactctgaagactgaggagaaatgatctcttgaagtcaggagttgggggttgcagtgagctaggattgcaccactgcactccaacctggacaacagagcaagaccctgtctctaggccaggtgcagtggctcacacctgtaatcccagcactttgggaggctaaggcagacagatcacctgaggtcagaagttcgagaccagcctggccaacattgtgaaactccatctttactaaaaatacaaaaattagccgggtgtggtggcatgcacctgtaatcccagctacttgggaggctgaggcgggagaattgcttgaacctgggaggcagaggttgcagtgagccaagattgcaccactgcactccagcatagacaatgaagcaagaaaaaaaagaaaagaccttgtctctaaaaagagagagagagaaaccctgcatggacctccattcatatggccgttctgttactagaagggtccagaccaacacaagagcactaggagccaaagatgaaattcacaaaagagcaattatgagaaatgggagaaagatggagggactgcaacatagggctaatggaagttttagaaaaacagcagaaaatcacagagaagcaatatatgatggacaatcaatgagaattttcaaaaactaggctgggcgttttggctcatgcctataaacccagcactttgggaggctgaagcaagtggatcaactgaggtcaggagttccagaccagcctggccaatatggtgaaacctcgtctctactaaaaatacaaaaattagcctggcgtggtggcgtgcacctgtagtcccacctactcaggaggctaaggcaggagaatcacttgaacccgggaggcagaggttgcagtgagccaatattgtgccactgcactccagactggatgacagagcaagactccatctcaaaaaaaaaaaaaaaaaaaaaaaggaaaagaaagaaaaaagaactaaagagtcatacaagtcctcaaatcaaaaacatactctaagaacaaacagcataaattaatatgtctatatagggttctatcattattaaaccacttaacatcaaggataaagaggaattttttttctttttttttctttttttgagatagggtctcactctgtcacccaggctggagtgcagtggtgcaatcatagctcactgtagcctcaaactcctgggctcaagcaattctcccaagtaactgggactacaagcctgcaagcaggcaccaccatgcctagctaatatttgtatttttttagagatgggatcttgctatgttgcccaggatggaaatctttattgttgttggtggtttttttttttttttttttttttttggagatggagtttcactcttgttgcccaggctggagtgcaatggcgccatctcagctcactacaacctccacctcccgggttcaagtagttctcctgcctcagcctcccgagtagttgggattacaggcatgcaccaccacgcctggctttttttttttttttttttttttttttttgtatttttttagtagagacagggtttctccatgttggtcaggctggtctcaaactcccgaagtgaagtgatcagcctgcctcggcctcctggagtgctgggactacaggcctgagctactgcgcccaacctcaggatggaaatcttaaaagttactaggccaggtgtggtggctcatgcctataatcccagcactttgggaggccgatgtgggcagatcagcagaggtcaggagtttgagattatcctgaccaacatcatgaaaccctgcctctactaaaaatgaaaaaaaaaaaaaattagccaggcatggtggtgtgcgcttgtaatcccagctgcttgggaggctgaggcaggataatcacttgaaccttggaggccaaggttgcagtgagccaagatcacgccactgctcaccagcctgggcaacaatctgtgaagaaggaaaaaagagaagagaagggaaggggaggggaggggaagggggagggaaggggaaggggaagggaatggaagggaagacaattaaaaaaaaaaaaaaaaaacaggcaaagaatatgaacaggcaattcacagaaggaaaacccaaatgacccacaaacatgaatagatgttcaaccacaatgacaatcagagaaattgtaaaaataaagcagcaacaatatatcattttacatttatcagctaagcaaaagctaaagtctgataatcccaattattgatgggtgtgtagaaaaaggagattctgacacatgctggtagagtgtcagttggtataagcccttggagagcaaaacagagatattcaccaccctcttatcccaaccattccacatactattctacgtaaatatcttgcagagagattccagcactagtgctatagaatacatttacaggaatgtttattgcaacattgtttaaaacaagagaaaaaaacagaaacaaagtaaatgttcaccaacaggagactggataaacaaagtataatgtataatggaatatgttgtagcagttaaaataaagaaagaaaagctacatatatcattatagtctacgtagtatcaacttggataaacctcaaaagtcattagtagtgagcaaaaaaagcaggttgcagaaggatacatacaatatgataccagttatatacaatgtttatggttcaacttttccagtctggtttattgagctacaatttgcatacagtgaaattgactagtctttgtgtacagttttgtgagtctggcagaatgcatacctttaggtagacatcatcacaatcaagatataaaagggttccatcattccccaaaattgcacactgccctattgtagtcaagtcttacccccacctcacatctcctgtaatcatggagcacatagcattttgagtctgtcttcttccacttagcataatgcctttgagattcattcatgttgttgagtatctcaacggctttttttttaactgctgaatagtagtctactgtatggatgtaccaatttatccattctgtagttgaagtgcatttgacttgtttgtactttggggcaattataaataaactgaccataaatatttgtgaaccgacttttgtttgaatacaaattttcatttctcctggttaaacacctaaaaatgggattgctgggtcatgtggtaagtgtatgttacatttatttatttatttatttattgagaccaagtctcactctgtcgcccaggctggagtgcagtggcaccttctcggctcactatagcttctgcctcccaggttcaagtgattcttctgcctcagcctcccaagtaggtgggattacagacaccagccaccatgccgggctaatttttgtatttttagtagagatggggtttcaccatgttggccaggctggtctcaaactcctgacctcaggtgatccacctgcctaagccacccaaagtgctgggattacaggcgtgggccaccatgcccggctgtatgttcactttaaatttttttcttcttctttttaatttaaaattatttttatttatttattttttgctgaggctagagtgcagtggcacaatcacagtttgctgcagcctcaacctcacaggctcaagtgatcctcctacttcagcctcctgagtagctgggaccacaggaacacaccaccatacccagctatatatattttgtagagacaaggtcttactgtgttgcccgggctggtcttgaacttctggactcacgcgatcctcctgctttggcctcccaaagtgctgggattacagccataagccactgtgttggactttttggtcattttaaatttagttattttcttactactgacttttgaggattctttacattctcaataaaagtcctttatcatttatgtgccttgcaaacattttttcccggtttgtggtttgtttttccattttcataagagtgtcttttgaaaatcagatgtttttaatttttatgaaatctagtttagcatatgtttttgtttatgcttcatggatatagaagctatatctaagaaacttttttcctaatctaagctcacaaagattttctgctatgtttccttcgggaagtattttaattttgaggttggatttaggtctatgatccattttgaaataacttttgttaagttgtaaggtagaggtggtcaaggttctctcttttttaaaaaaacatatgcacgactagttattccaatatcacttgttgtttgtttgtttgttgttgagacagagtcttcctccgtcaaccaggctgaatagagtgcagtggtacaatcacaggtcactgcagcctcaaactcaagcaatcctcccacctcaggctcccaagtagctgggactacaggcacatagcaccacacacagctgctgcttctttttttttagtgacagggtcttgctatgttgtccaggctggtcatgaactcctggcctcaagccatcctcctgcctcagcctcccaaagtgttgggattacaggcgtgagcagccatgcccagctgcaacaccatttgttgacatgactaccatttatccatttgattgtctttgccattttgtaaaaaccagctgaccctgaggtgggcagattgcttgagcccaagagttcaagaccagcctgggcaacatgttgaaaccctatctctattattaaaaaaaaaaaaaaaatcaactaaccatgtatgtgttggtttatggagtttcaaaacatggttaacaggatagagcttttcgtgttagggagaaggaaaggggaatttagatagataaaattctttaattttttcaagattttgtttgttttatttatttagttagtttagtttagtttttgagatggagtctcactctgctgctcagggtggaatgcagtggcacaatcttggctcattgcaacctccatctcctgagttcaggcaattctgcctcagcctcctgagtagctgggattacaggcatgtgccaccacacctggataatttttgtatttttagtagagacaaggtttcactacattggccagtctggtctcaaactcctgacctcaagtgatctgcctgcctcagccttccaaagtgctgggattacaggcataagccactgcacccagcctgttttgtttcaattgcaaataagaattgcacatatttatggggtacctagggatgttttgatacatatgcacaggttgtatgtgcaacctcacagatgacgttccccatgaaacgctctgagatggattgagcaagcaggatatttattaagcagtgcccttgaaggccaggcacagtggtttatggctgtaatcccagcactttgggaagctgaggattgcttgagcccaggaattggaattcaagaccagcctgggcaacatagcaagacccccacctccacaaaaaataaaaaagctgggcatgatggtgcatacctgtagtcctagctactcaggaggatgaggcaggaggatcacttgaacccaggagttaagaggctgcagtgagccatgattgcaccaccgcacctccaacctgggtgacagagcaagacactgtctctttaaaaaaaaaaaaaaaaaaggtgttcttgagagcaagaggccagaaggaagcaggagcaagcaatggagaaatggtgagaaggtaagcttccactgagcccaggagaacaggagctgaaacagccattcacacttgtccaggcttggccaaggtggttggacctccacccttccacggccatgggatattgggagaaggagttccctgtagttgagacagttcctgtggacagcattcacagaggggccacaaacccttcatggaaggtggtgtgaaccatgtgcctctgcactctgccacagtagggctgtactttgtgctttctttttatttttctttttcctttttgagacagaatctcactcttgtcacccaggctggagtgcaatggtgcgatctcggctcactgcaacctccacctcccaggttcaagtgattctcctgcctcagcctccccagtagctgggactacaggtgtgcaccaccacatctggctaatttttgtatttttagtagagacgaggtttcatcatgttggtcaggctggtctcaaactcctgacctcaagtgatccccccacctcagcttcccaaagtgctgggattacagtcacgagccaccacacctagccttacgctttgtgttttcatctgcatctgccatgaatgaggaagaatgccttttcatattcttggagggaagttctagagagggtgaccaagtggctccaggccttcgtgagacaaaagggaacccctctggagcagcctctagagtagtggaaggccaggcagacctggatctaattttagtcttttgtgacctaactctgcactccgaagggagtgactcaactcctctgagcctcagtttccctctcataaaatgacagagattgtgattgtagtggaggataaaaaaggaagggaaggagatgtcctcactttaatctaaactctgatcctgtccacagaatttaaggacatttagtcaaattcagaggcccagcaaagttgttcccatgggtcagtttgcaagagggacccaagagctaggaagaggctgggcacagtggctcacacctgcaatcccagcactttgagaggccagggtgggtggattgcttaagatcaggaattcaagattagcctgggcaacatagcaagactccatctctaaagaaaatgaaaaaaactagccaggcatggtggtatgtgcctgtagtcccagctactcgggaggctgaggcagcaggatcccttgaatccaggattttgaggctgcagtgaactatgatcacatcactgcactctagcctgggtgacagggcaagaccctgtctcaaaaaaaaaaaaaaaaaaaatagatctgaggaccattgacaacatgctgggttcagtgtggcctcctgagcctggttccagccttctatctccttaggcctggggtgcggatgatgccttacccactcactctgtttgggagttgaacagtaaattaaagtgcttcgttatctcatttgagagtggcgtaaaacactttggaaaggctggagcattcacagcaatcaagctctgaaaggttctcagttgctggaaggaatatcctctgatagattgctcttttctctgaaacgtggcttacatctcatgagcaattccagcagtgtccactgcagatgtttttggcatcttcacaaaggagttaaagagatcagactcgttcccaagagagaaaaatcatctttgcaatgtccaaaaagattccctgggcacagctccctctgctgtgacctgccaagaaattttggggctgcttaggacatggggtcattctctagctccagtatactcaccagtggtcagtcaccacctatgcatcgtgagtcactccacaaaccttaaatgaacatcatgttggggaaggccatgcttcgtctcagccctgccctccctgggcttaccatccaaacttggccctgtgtaaattctacaggattcacccctggttttcctgtccactgactcaaatgaccaacatctcaacaccttcctgggggtcagacatgcagagacttgcattttcgtgatcataaaattgaggtacaatgtatccaaaataaaccttcagaatctcagactccagtcctctccagaattagtttccagatttttaaacatttaattttatttttagagaaggggtctcactatgttgcccaggctgttcttgaactgctgggctcaagcaatcctcccatctcagccttccaaagtgctgagattacaagcatgagccaccatgcctggccacttaaaaataataataataataatttcttgctctgtcacccaggctggagtgcagtggtgccatcatagctcacagcagcctcaaacttccaggctcaggtgatcctcccacttcagcctcccaagccactgggggacgacaggtgctcaccactgtgcctggctacttttttattttttcatagggagaaggtcttgctaggttgcccaggctggtctcaaactcctgggctgaagtgagcctcccaccttggcctcccaaaatgctggggttataggtatgagccactgtgccatcccagtttccagaatattaaagagcttctgttgggttaggcttaggaacaggcaaaataataacaacaacaattttcctctgttgggcacttcccattggccagaactgtactcagaaccaacacacatcacccagaatccttataacaaccccaatttatagatggaaaagttgaagcatggaggtatgagtagcaggggtgtggagggcctgcaacctctatcttccaccaggtcaaccttttggttcttagaaactgtgcaggcaggcacgtatgtttattgcggcactattcacaatagcaaagacttggaaccaacccaaatgtccatcaataatagactggattaagaaatccatttatggattatgcagccataaaaaaggatgagttcatgtcctttgtagggacatggatgaagctggaaaccatcattctgagcaaactatcgcaaggacagaaaaccaaacaccgcatgttctcactcataggtgggaattgaacaatgaaaacacttggacacagggtggggaacatcacacaccagggcctgttgtgcggtggagggaggggggagggatagcattaggagatatacccaatgtaaatgatgagttaatgggtgtagcacaccagcatggcacatgtatacatatgtaacaaatcttcacattgtgcacatgtaccctacaacttaaagtataataaaaaagaaagaaagaaagaaagaaagaaagaaagaaagaaagaaagaaagaaagaaagaaagaaaccgtgcaggcaggacaggcataatggctcatacctgtaatcccagaattttgggaggctgaggcgggcagctcacttgaggtcaggagttcaagaccagcctggctgacatggcgaaaccccgtctctactaaaaatacaagaattagccaggcttggtggcatgcacctgtatttccagctagttgagaggctgaggcaggagaattgcttgaacccaggaggcggaggttgcagggagccaggatcatgccactgcactgcagcctgggcaacagaaaccgcacaggcaagtcctcagccatggattaagaccaaaaagaaagaaaaaaaaaatgctgaaagggcacaagctgaggagtggggaggagaggagaagaggcagatggaagtgagcccaggtgcagagagagataggagggaaagactgagtggcctcttgtcctgctgcagccttgcctatggacagcctggagctgtcatcctcaccatggtgcctagtgttccctcactgatctgactcataggtgttccttcaccacctctgcctgctcagccctggggcagccctggggagacccaaggaaagctgggtccacgtgcacctttcctcctaacctcctctagcctcagtctccccatctgtagaaagggcacatgaatccctacctctccagaggatcagacgcaacaatgtacccacgggcaccaaggagaagccctggacacacacccgtttccttcctttcctccttcataagtcaggaaagagtacagaatacaagccacaaagggagcctgcccttaagcaagactgccaaagaattgctttgtccacgcattcattcattcattcattcattcattcattcattcaacagatacttcctgagcatctactgtgtgccaggaagagcattgaggctttcctttcctaaaggcattctcttttctttcttttcttttttttttttttgagacagaatcccactctgttggccagactggagtgcagcggtgcaatcttgactcactgcaacctccgcttcctgggttcaagagattcttgtgccccaccactcgagtagctaggattacaggcatgcattgccatgcttggctaatttttgtagctgggactacaggcacctgccaccatgccgggctaattttttgtatttttagtagagacgggttttcaccaaattagcaagcatggactcaatctcctgacttcgtgatccccccacctcggcctcccaaagtgctgagattacaggcatgagccaccaccgcacccggtcttttttttttttttttttttttttttgagatagagttttgttcttgttgcccaggctggaatgcaatggcgtgatctcggctcacttcaacctccacctcccgggttcaagcaattctgactcagcctcccaagtagctgggattataggcatgcgccaccacacccagctaatttttgtatttttagtagagatggggttttaccatgttggccaggctggtcttgaactcctgacctcatgtgatccacctgtcttggcctcccaaagtgctaggattacaggagtgagccactgtgcctggcctatgtctttctttctttctttctgtttttaatttatatttgtttgagcccctcctttgacatctgtttgtttttgttgtattggtttttttttttagagatagggtctcattctgtcacccagggtggagtgcagtggtgtgatcacagctcactgcaacctccaattcctggcctcaagtgatcctcctgccttagcctcctgagtagctgggatgcaggtgtgtgctgccacacccaactaattttttttaaattttaatattttcttttagagatagagtctggctgtttcactcacgctccagtgcagtggcaggagcatagctcgctgcaacctcaaattcctatgcttaagcaatcctcctgcctcagcctcttgagttgttgaggcacctgtcatcacaaccagctgatttctttttttattattacattttgtagagatggggtcttgctttgttgcccaggctggtcctgaactactggtttcaagtgatcctcccacctcggcctcccaaagtgctgggattacaggcatgagccactgcacccggcctattcaataaacatgtattcagtctgtacctactgttctagggactgtggacagagcactgagcaagataggaaaaaaccagcatgcactctgggtgagtgtcagcagagccggtctcagggggcatgagccatgcaattacacactcggtttcatgctgtacggtggccattttgaaatccttaataatttttcaacaagagccctcaagtttcattttggaacgggccctgcaaattatgtagccggtcctgtgtgtcaggccaaactagcagataaggaaatgaggcacagagagggaaataactccaccaaggttcacacaggatgcaagccacacagctgggattgaaacccaggttagactgggtgcagtggctcatgcctgtaatcccagtactttgggaggccaaggtggatggatcatctaaagtcaggagttcaagaccagcctgaccaacacggtaaaactccatctctactaaaaatacaaaaattagctgggtgtggtgtctcacgcctgtaatcccagcattttgggaggccgaggcgggtggatcacgaggtcaggagattgagaccatcctggctaacacggtgaaaccccgtctctactaaaaatacaaaaaattagccgggcgaggtggcaggcgcctgtagtccaagctccaagctacttgggaggctgaggcaggagaatcgcttgaacctggaaggcagaggttgcagtaagccaagatcgtgctgctgcactccagcctgggcaacacagtgagactccaaaaaaaaaaggaaagaaagagagagagaaagaaagagaaagaaagaagagatgaaagaaagaaagaaagaagagatgaaagaaagaaagaaagaaagaaagaaagaaagaaagaaagaaaggagaaagaaagaaaagagaaagaaagaaagaggaggggaggggagggagaggggaagggaaagggaaggggaagggaaggggaagggaagggacccaggctaacagactccagataccagcagcagcccttgagccatgttgcctaattgtccccaaggagaaaacttcccaggtcttcggaggcagcaaaagctttcctggcacagagctagaaaagaagattctcatggtgtcccatgtggcaggaactacaggagctggggtgggtaatccatttaggccacttgacaaacacctatttttaggtcaactctgagaatagaaagatgaaaaaggagtggcctctgccatcctggagctaagcaactggtataagggaagtgacagcccccatggaatcggaccatttcaacttcatgcgatgaatgacaggtcagggcttctgggcatgaccataggaatgaccacagctaacattgaccatgggcctaatttgtgtgctgtttgcttttttttttttttgagacagagtctcactcaagtcaccaggctggatggagtgcagtggtgcaatctcagctcactgcaacctccgcctcccaggttcaagcgattctcctgcctcagcctcccgagtagctgggattacaggcgcgcaccaccacgcccagctaatttttgtatttttagtagagacggggtttcaccatgttggccaggatggtctcaatctcttgacctcgtgatccacccacctcaccctcccaaagtgctgagattacaggtctgagccactgcgcccagccatgctgtgtgctttttagcattttcttcagtttttgttgcaacctatgagtcaggaactcttattatgctattttacctaggaggaaaagagcattcacagagattaaacagtgtgttcaggccgggtgtggtggtaatcacatccatgaccgtaatcccagcactttgggaggccaaagcgggaggattgcttgagtccaggaattcaagaccagcctgggcaacttagtaaaacctccatctcttttgtaaaaaaataaataataaaatactttaggaggccaaggcaggcagatcacttgaggtcaggagttcaagatcagcctggccaacatggtgaaaccccgtctctactataaatacaaaaattagctgggtgtggtggcatgcgcctgtagtcccagctactcaggaggctgaggcaggagaattgcttgaacctgggaggcagaggttgcagtgagctgagatcacgccactgcactccagcctgggtgacagagcgagactctgtcaaaaaataataataaaaataatcataaaataagataaaaatataaataaaaaataaacaacatgcctaaaaccacgcagctagaagaaggcagtgtcagaactcagctatgtctgacatcagagaccacgattttttttttttttttgaaatggagtcttgctcttgtcacccaggctggagtgtaatgggacgatctcagctcactgcaacctgcgcctcccaggttcaagcaattctcctgcctcagcctcccaagtagctgggattacaggcgcccgccaccacacctggctaatttttgtatttttagtagagacaaggtttcaccatgttggccaggctggtctcgaactcctgacctcatgatctgtccacctcagcctcccaaagtgctgagattacaggcatgagccaccacgccccctggcctttttttgtttttgtttgtttgtttgttttttgtgtttttttttttcttttgaggtggagtctccctctgttgcccaggctggagtgcagtggcgcgatctcggctcactgcaagctccatctcctgggttcacgccattctcctgcctcagcctccagagtagctggaactacaggcacccaccaccatgcccagctaattttttgtattttttagtagagacggggtttcaccgtgttagccaggatggtctcgatctcctgaccttgtgatctgctcgcctaggcctcccaaagtgctgggattacaggcgtgagctacagcgcccggccttttttttttttgagacagtctctgtcgcccaggctgtagtgtagtggtacaatctccactcactgcaacctccgccacctaggttcaagtgatcaagtgattttcctgcctcagcctcccaagtagctgggattacaagcatacaccaccacacccagctaatttttgtatttttagtagaggggttttgccatattggccagtctggtcttgaactcctggcttcaaagtgatccgccagcttggcctcccaaagtgctgagattacaggcatgagccaccatacctggccagagaccatgatcttaacgagcatatggccctgccccaaagaactgtggacatacagatgagaggcaggtaccccacactgctgggaaaaatcacagaaagcttcccggaggaggtgatgacagaggtgaaataaatatggatctgtcagcctgtacaagggtcagaggccatgagagagtatggaagagggagagagatctttcactggagggtaaagtactaggctgggaatggtggcagatgggaccagagatataagcaaagaccacaccacagtgagccttgaatgccaagtacatcagttatgggtcttagctgcaagcaacagaatccattctggtcagtctacatagcaaagaaatgaatgaatgaatttatttatttattgagatgaattcttgctctatcgcccaggctggagtgcagtggcacgatcttggctcaccgcaacctctgcctccagggtacaagccattctcctgcctcagcctcccgagtagctgaaattacaggcatgtgccaccatatccagctaatttttgtatttttagtagagatggggtttcaccatattggccaggctggtctcgaactcctgacctcaagtgatccaccccccttggcctcccaaagtgctgggattacaggtgtgagccacctcacctggccagaaatttatttttaatatgtcaagtaaactgaccaggtgtggtggctcacaaccgtcatcccagctctttgggaagccaaggcaggaggatcacttgaggccaggagtttgagaccagcctgggcaacatagcaagactccatttctaccacacacacacacacacacacacacacacacacacagacaaaattagccggcgtgaggcttgaatgccaactgcatcagttatgggtcttagttgcaatcaacagaatccattctggtcagtttacatagcagaggaatttatttttaaaacatcaagtaaactggccaagtgtgatggctcctaccagtaatcccagcactttgggagtctgaggcgggcagatcacctgaggtcagatcacctgcggtcaggagttcaagaccagcctagccaacatggtgaaaccctgtctgtattaaaaatatgggaggctgaggagggaggatcacttgagcccaggagattgaggctgcagtgagctatgatcacaccactactctccagcctgagtgacagagtgagactgtctcaaagaaaattaatttttttttgtacactatcacagccaagaagagcccaagaagacattactactaactgtcacatggtgtcacggatgggatcttcggacagaaaaaggaaattgggccaggcgcggtggctcacgcctataatcccatcactttgggaggctgaggtgggtggatcacctgaggtcgggagttcaagaccagcctgaccaacatggagaaaaccccgtctctactaaaaatacaaaattggccagggtggtggcgcatgcctgtaatcccagctgctcgggaggctgaggcaggagaatcacttgaacccgggagacggaagttgcggtgagccaagatcgcgccattgcactccagcctgggcaacaagagtgaaactccgtctcaaaaaaaaaaaagaaagaaagaaaaaaaaaagaaaagaaaaaggaaattggtaaaaattaaggagatctaactaaagtatggacttaagttaattacaatgtattaatttcagttcattaacggtaacaaatatactataccagtgcaagatgttaataaaagggggaaatggtacaggatatatgcgaatcctactgtcttaacaatttttctgtaaatttaaaaccattgtaagatgaagagtctatttttagagtactgagtaaattgtatggaactaaacacacacgcacaattacatgtaaaactggtagaacctggataagttcagtggatggtatcaaaggcaatttcctggttgtgagattgtactacagttttgcaagctgttaccattgggggaaattgcatgaagggcacgagggctctctgggtattaatgtcttacaattgcaagtgaatctacaattatcttaagataacaagcctaattttatttatttattttatagagacaggctttcactgtattggccaaacttgtctcaaactcctggcctcgagcgatcctcccaccttggcctcccaaagtgcggagattacagacatgagctatatagtacccggccaaaaagcttaattttaaaacattgaacagagaacaggatcttttggaaagctgaagaaataaagtctaggcttaaagttataggacccttacccagcaccatggggcagaactgtcctgataagaaaatgaagctgtgggccaggcacagtggctgatgcctgtaatcccagcactttgggaagctgaggtgggtggatcacttaaggtcaggagttcgagaccagcttagccaacatggtgaacccccatctccgctatacaaaaattagccgggtgtggtggtgggcgcctgtagtcccagctacttgggagtctaaggcatgaaaatcacttgaatctaggaggcggagattgcagtgagctgagatcacaccactgaactccagcctgggcaacagagcaagactctgtctcaaaaaaaaagatagagagggagggagggaaggagagagggagggagggaggaaggaaggaaggaaggaaggaaggaaggaaggaaggaaggaaagaaggaaggaagaaaatgaagctgtggcagcttccacagccacaccttctgcaggacttcacctttctaaatgtcaagttgtattttcccaaaatggctacaaaagtaacttcatccaacatgctcttctgcaaagtaactttgtcctcctccatcaagaagcagggtctatgaccctgtcttagtctgtttttgttgctataaaggaatacctgaggctgggtgatttataaagaaaagaggtgtatttggctcgtggttctgcaggctgtacaagaagcatggtgccagcatctgctgctagtgaggaccgcaggaagcttcctatcatagtggaagatgaaggggggccgacaagatcacgtggtgagcaacagacatgccaggttctttcaaagatccagctctttgaaagaatgagtgaatagagcaagaattcactcattaccacagggagggcaccaagccattcatgaggcatctgcccccatgacccaaacacctcccacttggcctcatctccaatactggggatcacatttcaacacgagatttagaggggacaaatattcagactatatcagccccctcccctaactcaagctggggttgtacctgtttcaacccagagaataccatgcaggtgacatccctatgatttctctttttgtgtgttgttttgagatggagtcttgctccgttgcccaggctggagtgcaggggcgcaacctcggctcactgcaacctctgcctcctgggttcaagcaattctcatgcttcagctcccgagtagctgagactgtagacatgcaccaccacgcctggctaatttttgtattttcagtagagacagagtttcaccatcttgaccaggctggtgtcaaactcctggcctcaagtgatctgcccacctcagcctcgcaaagtgctgggattataggcacgcaccaccacacccagctaatttttgtatttttagtagagacggagtttcaccatgttggccaggctggtgtcaaaatcctggtctcaaatgatccacccacctcagcctctcaaagtggtgggattacaggcttgagccaccgcgtccagcagccaccgcacccagcttgatttctgaggttaggtcataaaaggccatgtggcttccagctgactttcttggcacatttgctctccagactctccctgcgatatcctctctgggaatccagctgccaagctgtgagaagccctagccccatggagagaggcacccgtcaaccaggcttcagacacagagtaaagaagcttccaggcgaccccagcccccaggcatccaaatcaccgccagcattcaggtctttccaagtaaaggccagataccacagagcaaagacaaactgttctcacaggccctgtctgaattagcaacctatagaatttgtgagttcaggccaggcatggtggcccacacctgtaattctaacactttgggaggcagacgtgggagaatcacttgagatcaggagtttgagaccagtctgggcaacatgatgaaactccatctctaccaaaaaatacaaatattagccaggtgtggtggtgtgtgcctgtagacccagctacttgtgaggctgaggtgggaggatcgtttgaggctgcagggaaccgtgatgacgccactgcactccagcctgggtaagagtgagaccctgtctcaaaaaaaaaaaagaattctcccagcactttgggaggccgaggcgggaggatcacctgagatcaggacttccagaccagcctggccaacatggtgaaaccccgtctctactaaaaatacaaaaaaaaaattaactgggcattgtggtgtgcacctgtaatcccagctactcgggaggctgaggcatgagaattgcttgaggcagaggttgcagtgactgagattgtgctacggcactccagcctgggtgatggagtgaggcttcgtctcaaaaaaaaaaaaaaaaagaagaattaatgagttaatataatgtcatgtcctattttccttccttcctgctttttctttcttctttctttctttctttcctctttctttctttctttcttttctttctttctttctctttttctttctttctttctttctctttctctctctctttcatcttttctttctttcgtctttcttttctttctttggcctttcatttctttcttttgtctttcttttctttcattctttctttttgacagggtcttgcctggctgcccagacaacagtgcagtggtgcaatcacagctcactgcagccttgaactcctcagttccagtgattctcctgcctcggcctcccaagtagttgggacaacagacgtgcgccaccatccccagctatttttttaaaaaaatgttttaagacaggatcttgctagtctcaaactcctggtctcaagcaatcctcccatctcagcctcccaagttgttgggattacaggcatgagccaccgtgcttagaggcataagccactgcaccgggctattttgtcatttttctccactaagtgtgagctatgtagtatacagtaattgttaccagacaaatccctgctgccttctctgaaatcccatccatgaaccttgtgctcacttctgaacctgagccatacacagttctgatgtgcctgcatcttagccacagggaggctgcagaagctcaccttgtgaagacaaggcttgtgacatgggaaatcatcaaaatctatgccgggcggccgccatgcacagaaggccactaggtcagaccaagtgtggactaacggtagcctgtaacagaagagacctcccctcatcgcacccagccccatcatgatttgaacctctctagaacctgccatgttgaattgggtgctgacttcactctgctattttttttttttttttttttgagacagagtctcactctgtcgcccaggctggagtgcagtggcatgatctcggctcactgcaacctctgcctcccaggtttcagcaattctcctggctcagcctcctgagtagctgggattataggcgcccgccacaacaccaagttaatttttttgtatttttagtggagatggggtttggtttcaccatgttggccaggctggtctcaaactcctgaactcaagtgatccgcctgcctcgacctcccaaagtgctgccaaaatattagcattttgaccaggcacagtggttcacatctgtaatcccagcactttgtgaggctgaggcaggcagatcacctgaggtcaggagttccagacaagcctggtcaacatggtgaaaccccgtctctaccaaaaatacaaaaattagctgggcatgatgacgcgcgcctgtagctccagctactcaggagcctgaggcaggagaatcgcttgaacccgggaggcagaggttgcaatgagccaagatggtgctgctgcactccagcctgggcgagggagcaagactccatctcaaaaaaaaaaaaaaaaaaagttggtgcgggggctcacgcctgtaatcccagcactttggaggccgaggcgggcagatcacttgaggtcaggggttccagactagcctggccaacacagtgaaaccctgtctctgctgtaaaaaaaaattagctgggcgtggtagcgcatgcctgtaatctcagctactcaggaggctgaggcaggagaatcacttgaacacaggaggcagaggtggcagtgagccaagattgcaccactgtactccagcctgggtgacagagtgagactccatctcagaaaaaaaaaaaaaagtgtttcaacatataatcaatatttttaaattattaataaaatactttgaagttttttcataataatctttgcaatccagggttcattttacacatgatagcacatctcagtttggatgcttaattttcattcacaatactcgatctgtatttagagttcatagatttacataagtaaattgtttcaaagtcctgtgaccaatttgtcttcctggagaatgtcctggtttcaaaaatgaaagtcttacatcttgaaattctccttggtcccaggaaaatcagggcagttggtcaacctcttccaaacatacttggagatttttcttttcttttttttttttttctttgagacatagtctcactcactctgtcacccaggctggagtgcagtggcgccatcttggctcactgcaaccgccatctctcaggttgaggtgattctcctgcctcagcctccctagtagctgggattacaggcacatgcgaccattcccagctaatttttttgtaattttagtagagacgggatctcaccatattgaccaggttagtctcgaactcttgacctcaagtgatctgcccaactcaagcccctcaacatgctgggatgacaggcgtgagccactgcacccagctgggttttgttttttggtttgtactgtgtttgttttgtttttttgagatggaatctcactctattgcccaggctggagtcagtggtgcaatctcagctcactgtaacctccgcctcccaggttcaagcgattctcctgcctcagcctcccgagtagctgagattacagtcactcaccaccatgccctgctaacttttgtatttttagtagaggcagggtttcaccacgtggaccaggctggtctcaaatttctgacatcaggcgatccacctgcctcagcctcccgaagtgctgggattacaggcataagccaccatacctggcctgttttttgtttgtttgtttgtttgtttgttttttgagacagagtctagttgcccaggctggagtgcaatggcatgatcttggctcactgccacctccgcttccccggttcaagcgattctcctgcctcagcccctcaagtagctgggattacaggtgcatgccaccatacccaactaattttttttttgtatttttagtagagatggggttttcaccatgttggcctagctggtctcaaactcctgacctcaagtgatctgcctgtcttggcctcccaaagtgctgggattacaggcatgagccatcatgcctggccagcaagcaagacatagggtttattgaggggacttacagggtagtccagacatggcaggtggaacaggagaaccacacctgcttataaaaagcatgcagttgggcccagcacggtggctcatgcctgtaatcccagcactctgggaggccaaggcgggtggatcacaaggtcaggagatcgagatcatcccggctaacacagtgaaaccccgtctctactaaaaatacaaaaaattagctgggcgtggtggcgggcacctgtagtcccagctactcaggaggctgaggcaggagaatggcatgaacctgggaggcggagcttgcagtgagccgagatggcgccactgcactccagcctgggtgacagagcaagactccatctcacaaaaaaaaaaaagcatgcagtttatagagcatttccacttagcaccctccccctagcaccctccctctggcaaccttcatttaaccccaaacaaaggccaccatcccctagatggtccaggggttcagatgttcctcatagataagaaatgaatctccgggttggccactcctggattccttagcttagaactttcaacacatactcttcttagaccatggggtcattttcaaggtatgctgatgttactgttgccagatgtgtttgccatgcatcatagctaaccactaggaagttctataagtgagggagggccttaagaacatactctgagctggaagtgtcaagttggaggcccttgacattagaagccagagactgggtacacccacatagtgagagaaggtgagggctgcggggatgtgtcagctatatccattgctacccaacaaaccattccaagtcttaatgacgaaaaataactttttttttttttttgtcagaggcaggttctcactctgtcacccaggctggaatgcaatggtgcaaacacggctcactgtagtctcaacctcctgggctcaagtgatcctcccacgtcagcctccgaagtagctggaactacaggcgtgcgtcaccatgcccaggtaatttttgtatttttttgtagagaaggggttttgccatgttgccccgcctggtcttgaagtcctgacctcaagggctccacccgccttggcctcccaaagtgctgggattacaggtgtgagccactgtgcccagacaacagctattttttgggggggcgggggacagagtctcgctctgtcacccaggctggagtgcagtggcgcaatctcagctcactgcaagctccacctcctgggttcatgccattctcctgcctcagcctcccaagtagctgggactacaggtgcccgtcaccatgcccggctaattttttgtattttcagtagagacggggtttcaccatgttagccaggatggtctcaatctcctaaccttgtgattcacctgccttggcctcccaaagtgctgggattacaggcgtgagccattgtgcccagccaacagctatttttttattcatcgtgtttctattggttggctggatagttctggtttcacctgggctcatgtgtgtggctgcactcagttagacagtcagatgcaaagtccaagatggtctcgttcacatcttagcatgctctagtagttggtgctagctgttggcagaggcctgacacagctggaacacctggacctcttcatgtgatctttcttgcaagcttctttacagcgtgatggtctcagggcagcattctttccgagagggcaagtcccaatgcacaggacttagggagcagatttgccaataccccattggccaaagccgtgaaaatcacatagccagacctagagtcaatcagtgaaagaccagaaaagggcagtgctaaggaacccaaagaggagggaattctaccaggacggtgcccatccaacacttgtgttaccttgggagccagtacctccttaaattcagggcccaaagtgcctcaacttgcttcaccccaattccagcctgaatcctcaggacttggcaactcagaggtcaatttccttaacaccccaacatgaatttcggaagttagtttcacagaaatcttaagcaccaaatacaactgagcgaaagcaattctgcaagtcaaaaacaaggtggtctaaatttgcaaactttatggcagtctggcttgatgaaatataaagcccacaatgcttttaaacagttttggccaggcacagtggctcacgcctgtaatcccagcattttgggaggctgaggcgggcagatcacctgaggccaggagtttgagaccagccttgccaacatggtaaaaccccgtctctactaaaaatacaaaaattggctgggcgtggtggctcacacctgtaatcccagcactttgagaggccaaggtgggtggatcacgaggtcaagagatcaagaccatcctggccaacatggtgaaaccttgcctctactaaaaatacaaaaatcagctggcatggtggcacatgcctgtagtcccaactcctcgggaggctgaggcagaagaatcacttgaccctggtaggaggaggttgcagtgagctgagatcatgatgctgcactccagtctggctacagagtgagactctgtctcaaaaacaaacaaaaaaatacaaaaattagccgtgggtggtggcgcgcgcctgtaatcccagctactcgagaggctgaggcaggagaattgcttaaacccaagaggcagaagttgcagtgagctgagatcatgccattgcactctaccctgggtgacagagcaagaccctgtctcaaaaaaaaaaaaaaaaaaatatatatatatatatatatatatatattttttttttttttaccaagacccacagtaaaacatacctttatatcaagttctagtgcacataggcagacacacacaggcacgcaccccttacacacatggacaagattaaagtgccctggggtatagaaaagatgatagtaacctacccattttatatgcaacactgtgtcattttctagtctatttaaaattttttttgtgtttttttttgccgggaatttttccattttgttgaagagacgatgtcactctgttactcaggctagagtccagtggtacaataatagttcacagcggccgggcacagtggttcacgcctataatcccagcactttgggaggccgaggcaggtggatcaagaggtcaggcgttcaagaccagcctggccaacatagtgaaaccccgtctctactaaaataaaaataaaaataattagctgggcatggtggcaggcacctgtaatcccacctacttgggaggctgaggcaggagaaatgcttgaacctgggaggcagaggttgcagtgagccgagattgtgccactgcactccagcccggggaacagcgtgagactccatctcaaaaaaaaaaaaaaaaaaaagaaagaaagaaaaaaaaaaacaataatagttcactgcagctccgaactcctgggcccaagggatcctcccacctcagcctcctgagtaactaggactacaggtgcacgccaccacatctagctagtttcttatatttttatttttgtagagatgagcagtcttgctatgttgcccaggctggtctcaaactcccggcctcaagagatcctcttgccttggcctcccaaaatgctgagattacaggcatcagccactgtacccagcctgtttaattatttttttaaataattgccatgccctgctaaattgatttcaccatccactacatgggtcatacacagtctgcagattgaaaaatgctaccttaggccatccagagcagaagtcagaaaactagccaaatcttgcctttagccttgttttgtttcacctgcttttttttattgttgttgttttgttttttgtgttttttttttttttgaggcagaatctcattctgtcgcccaggctggagtgcagtagtgcaatcttggctcactgcaacctctgcctcccaggttcaagtgattctcctacctcagcctcccaagtagctgggattacagatgcacaccaccatgcctggctaatttttgtattttcagtggagacggggtttcaccatgctggccaggctggtcttgaactcctgtccttgtgatctgcctgctttggcttcccaaaatgctgggattatagttgtgagccactgcaccctgccagttgtttttttttttttaagaaactgaattttatgccttcaggcagacttcccttcacctgtaccatttccaacatttttttttttttgagatggaggctcactctatcacccaggctggagtgcagtggcgcgatctcagcttactgcagcctccacctcctgggttcaagcgattctcctgcctcaggagaaggcaccaccatgcccagctaatttttttgtgtttttagtagagacgaggtttcaccatgtttgtcaggctggtctcaaactcctgacctcaaatgatctaccctccttggcctcccaaagtgctgggattacaggcgtgagtcaccgcgcccagccacatttccaactatctgatagccaactgcttcacacatctgtgtaatctgtctggcccctgaatgcatttctgtttgggatttctggatctctagattctaaaggcatagataggtgcattgatgcattccacaaatattgaatgagtgtctctcataggccagtcactattgctgacaatgggaacacagcggagaacagacaaaaatcactgcctttgtggagttgagattgtgtaggggagagacagataagctttaaaaaaaaaatgctgaggctggaggatcacttgaggctgggagttcgagactagcctgaacaacatagtgagacacccctctctacaaaaagtaaaaaaaaaggccgggtgtggtggctcacgcctgtaatcccagcaatttgggaggccgaggcgggcggatcatgaggtcaggagatcgagaccatcctggctaacacagtgaaaccctgtctctattaaaaatacaaaaaaattagccgggtgtggtggcgggcacctgtagtcccagctactcgagaggctgaggcaggagaatggcgtgaacctcggagggggaggttgcagtgagccgagatcgtgccactgcacttcagcctgggtgatggagcaagattccgactcaaaaaaaaaaaaaaaaaaaaaaaaggccaggcatggtggcttatgcctgtaatcccagcagtttgggaggccgaagtgggtggatcacctgaggtcaggagttcaagaccagcctaggcaacattgcgaaaaatacaaatattagccagccgtggtggccagcacctgtaatcccagctagctgggaggccaaggcacgagaatcgctgaaccaagggggaggaggttgcagtaagccaagatcgcgccatggcactctagcctgggcgacagagcaagactccatctcgggggggaaaaaagaaagttaaaaaaaaaaaaaaattagccaggcataactgtagtcccaactgctggggaagctggggtgggaggatcttttaagcccaggagttcgaggctgtagtgagctatgattgcgcccctgcactccatcctggccaacagagcaagaccctgtctctaaaaaataaataaataaaagaaaaagagtaaaagaaaataaagtgggagggggatatgcatgctctaagatctatctaccacagattacaggcttttcacccttttgtggaaatgacaaaacctagtatgttcctacctaacagaggagggctgagggaaggtgagggagcacaactgcaattttcccctgaaaaagagttctcagcctgccctggcagatagatctcacccatcgcgtccccagattactctgccaaaggtggaagcaccaatcactttaacccagaacatttcaaaaccagacagccatgaaggaggaacctctgtggtccgggcgcgtgggccctggggttggaagtgcctcagacgcactttacattttccccgaattcacccttcgcagtccccatcaccccctctccagtgggataaatggccacctcattagctctgcacacatgaccctcccgacctgactcctggtgactatgcctgccttatctcttttctctcctccctcacattttccgctgcaacaaagccaaacacagcaccgtgggggctttcacgcttctgtgccctaggacacgctgttcctgcagcttggaaggcctctgtcctccatccgcgcgccctcactctcttgctaggaactcccattcatccttcaaaacccagcctgagtgtcccctcccccgggtcaccccctttgacctgtcaatcccctccctccgggtccccagcaagcttttcggtttggcttctccgcactctcatgaccgattgccctacatcttggcgctcccagactcgggccttctccagcaccggagtcgtctggtttgctcgctttacactccaagcacctagtaccgagcctgactgggtgccagagggcgcgcctaggctcaggctggctccacccgccccgtgcctcccctcggccttccccttagtcctgagggtgcccgcgctcctgcatttcccgtgcaccgggctgccggtagctccggccgcccagcccccgcggcagcaacagcagcaacagcagcagcagcagcagcaccgggggagcccccccaggcggactacaagtcccggcaggccgcgcgcgggccgcgcatgcgcagcggggaccggcgtttgagtggcaagttgtttgttacagcgaacaccagctgctccccccgcgccgggcgccgcgcgccgctgctccgccgctcggcccctcggctgctgctctgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccaggtaagcgcgcggggacgcggcgccggccggggacagacaaagggggcgcaccccgggccgctgtcctcgccgccgcgcctcggaaaacaacttcgggccccgggagcgcccccgccccgcccccgccgccgcttcgctcgcgtctgacaaagccggagccgcagggtcctggctcccggacccctcgcaaccttccaccccccggtgcgccaccccccacctctgtcgtccccccatctcccaccccctcccccatcgcagccccctccccgaaatccggggggctggggcggctgcagtgacggatccgtgaatggatgaaggaacgaacgaatgaatgaatgaaaaacaggtgtggggacgaggccgtggaaaaaacaaacgcccccatccccccatccctcggttgggccggccccgtcgccacggcggggggagggattccgctgagcgcggttacccagagcagaaaatcataaaatcattagtgggtgtttatctcaaggtgcctacgaggcttgctgcggacggcctggaattgcgggggggaaacggggggtgggcgagggccagggaggggctgcagaggacgtgattctttctccttggggtcctggaaagggggtgggggggtgttttgcccaaccgtagaaggggaggagcaggcatgtttatgcatctgccttgaggctgggcttggatgctgcagggggaaaaatagttgaaggccttggaaggtaaaagagggaatcacacacacacacacatacacacacacacacacacacacacacacactctctctctctctctctctctgtctgtctctctctctctctctctctctctctctctctctctctctgtctctctcacttggattttccctatgccaggtaagggtttgacattgtgagccccggtgggtgcttgcattagggttttgttgttgttgtttaaggagcctgagccgaggggagtgtgagtgccagctagctgctgtaacttaagtctcatttgcccaccattgtgactgttaaaaaggaatgataaagttgttactggttggtttttcgcggtttggggcggtggtggctctccctcactgcaaaatgaatgaatacttttcgggtcaaggttagcgtgaaaatgacagcccccttaggctgccccctttggcactgagctctagggacacagggaaataattccagcctgttatctgcctgtgaaaagttcttgcttggaaatctcactttgatgtgtgtgtctgagccgggtgctcagtccggctattgtttgcgagatggagccagacctgccggtggcatcttgtttactttcgtctccggctgctcagtaggggatggagatttgaaatagtcgccaagcctctgccacggagcctgtgctccccgttgattgcaaagggtaatgattaaacaggtcatttgaaaacaaaagccaacagctcggattctgaaccgcgcccccacccctcacacaaagccccctctggctattgacaccttcagatcctgcttctgcctgccctctgccccccactccctagccgggcttgacgttccaaagcttggaggtaacagaacagccttgtttttcctagccttggccctcagccctgggcagccccctggctgatttctcggccaccattcaaatgagaatgatgactcaggctgcggctgtgcacagggcctgggtgctggaagcggggggcatttgggggcttcttagaaaggcagcaaagggcagggtccctcagcccctttcccttggtggagagactggccttcttccagcccccaactcaggatcccctttgggtactcatggataggcgtgtctctggggtcaagcccccctgctggcctctgggaacacaagaagacctgtccctcagtgggtcccccttcctccctcctgcagaaagcagcctgtcctgtcccaggcccaggtgacccagctgactagtccagtttcaagatgactcagaggccaaaggccatcgctgtgtttccatggtccggcctcagaaggtgcggaacattcgtcaaatgcctgaggacctgccaccccatgcactctgagcccagatcatggcttcaggtcatgtgtgaccacagccccctgcctgcctggctgaggcgaagtctgtctcctctggctcacacttcgtccgtctgtaaaatagagatagcactatttggccccctcatggacacagaactgctgtgtggatggtgtgggacgattgtgggaaatggctttttagcaagtgttaatgggttgcagcctgccgacatagcatttaaactgttttcaataatcagccatccaggtagaaccccttagattgttcctgcaatacctgcccctaggtggtgacccatagctctgtcacctccctctccaaaacctaagtttagcccagactagcacagcatgccctgagggtccctgtgccacctgtttactttttttttttttttttttttgagactgagttttgctcttgtccgggctggagtgcaatggcgccatctcggctcactgcagcctccacctcctgggttcaagtgattctcctgcctcagcctcccgagtagctgggattacaggcatgcgccaccacacctggctaatttggtgtggagacggggcttctccatgttggtcaggctggtcttgaactcccgacctcaggtgatccactggcctcgacctcccaaagtgctgggattacaggcgtgagccaccgcgcccggcccgtttacagttttgtcagtcactctatagcatcaaatcattgacatggcattcgaggccctttgggatctagatcctgaatcctcatctttattttttttattttttatttttctcttttagagacagagtcttgctctgtcgtacaggctggagtacagtggcgccatcatagatcaatacagcctccaactcctgggctcaagcaatcctcccacctcgacctcccaaagtcctgggattactgctcctggccttgaatcctcatctttagccctcccccagcaaatacacaatttcccttattgttccctacatacctctgtgcctttgtatctacctctcttccatttgcctggaatattctcccccacccacccctagtaaattcctattcagtcctcaagagctaatgatagcgctaatgatagcatgctgaaaccttcctgaacttttccctccgctccttagcaggcttaagtcacttctctctcgtggagtggagttgtggaaagggaatggcattaggaaacattcactctgtgttggggtgtggctgggtccaagggatgcagagataccttgccccttcctctgccaagccctagagcctggtggaagagaaagaaagaggccatcattctacagcagggtggagtcagggaagggctggtctagcagggtacctagaacgccgggtgcctacctgtaggaggtggcactagatcttagagcttttttttgtttgtttttaagagatggggtctctgttgcccaggctgaagtacagtggcaccatcatagctcactgcagcctcgaactcctaggctcaagcaatcctctcacctcggcctcccaagcacctgggactgcgggtgcgcaccaccacactcagctaatttttaaatttcttgtagcgatgggggtctcactgtgttgcccgggctggccttgaactcctggcctcacatgatcctcccacctcagcctgtcagaggtgcgtgcggacataacatttaaactgttacaggcatgagcttacaggcatgagccattggcccttagggcttttgaagtaggaaagccagtggctcacatttggagttaactagttggaagagaggatctagaccccaggacccccaggtacgttctgtgtattaggtattaaacctgctttgcaaaccaggaagctggggttcaaagattaagtgacttgctcaaggtcaggcaagaagtgatagatccgggatttaaatgtgccaatctgcacctttctggcacaagctctgagattttgctattgcaggttgcaagagatgcccccattgaatggttatgtccagcccttctgtctacagcacagtgttctgaaaggcttaggagcacagaactgaaatgctggcctttctgtattcctgcctatttggctttggtgggccttttctttttttttttttttttttggagatagggtcttcttctgtcacccaggccggagtgcagtggcgtgatcacggctcactgcagcctacacctcccgggcttgagtgatctgctaccagagctgttttcttctcccagggatacttggtccttatcactcccatctagacggttacttccttttttttttgaaacggagtcttgctctgtcacccaggctggagtgcagtggtgtgttctcagctccctgcaacctccaccccaagaagctgggatcacaggcgtgcgccaccacgcccggtaaatttttgtatgtttagtaaagactgggtttcgccatgtttgccaggctggtgtcgaactcctgacctcaagtgatccacccacctcggcctcccaaaatgctgggattacaggcgagagccaccgcgacctgcttagacattctacttcgttagagccttagagcctatctcagatactttcttccgggcaccttgcgtatttctcaacttttgccgataacaacatgttattggcttgtctttttctcttacctagattatcaaccttcaagttttttgtgcatgatttgatccaccccttcccaccacatcaccacagtacctaccagtggtgatgagagctaccgttgactttgccatattttgcagagcggtgaagacactagctttggagaagtacaatggcaaggtcgcacagctggaaagaaacagaattgggatttgaactaggtcccgtctccgctgcgtgtagcaccctgctttgtaggcacttagtaaacgtctgtttgatggatttctgaccatcagagtgacccagatttcaacccaagtatttgccagagtctcataggagtgccctggggctggaagatatgtcgttgtagaaggcaggatcacacctgctagaagcagagcccagcgaccctgtcccgggtctgctgaaccaggcctctgcccaggacctttggaggagcatctgggtgtggctggactaggcgaggaatgtgcttacttattctcagcataaagccagaaggcaagaccctgggtaggtctgtccgatgagcttcccttgtcctctgtggtaaccctgaggctctgtgacctagctgagggccctctgtggcccacctcaccttgtctctccagcctcacctcgaagcttccagccacaccctagcgtgcctccagccttcaggcctttgttctttctgcccagagtattacttcttgccttacccctttcttccccgtgcatccttctagattccatttcagcttccctgagggcacgttgggctcactcttcttctggtaggacgggcttaactcaaaacgataaggccagacccagtggctcctgcctataatcccagcattttgggaggctgaggttggaggatcccttgaagctaggaggttgagaccagcctgggcaacaaagcaagaccccatctccacaaaaaaaaattttttaaaataactttttaaaaaatagccaggcatggcggtgcacacctgtctcaggaggtttgggtgggaggatcacttgagcccgggaatttgaggctgcagtgagctatgatggtgccactgcactccagcctgagcgacagagaccctgtctctgaaaaataataaaaaaagaagaagaaatgtaaccaggggctatcaacaaggatgctttgtggtttttgtttgtttgtttgagatggagtctcacttggtcacccaggctggagtatagtggtacaatctcggctcactgcaacctccgcctccctggttcaagcaattctcctgcctcagcctctggagtagctaggattacaggcacccaccaccatgcccggctaattttgtatttttagtagagacggggtttagccgtgttactcaggctggtctcgaactcctgacctcaggtaatcctccctccttggcctccgagagtgctgagataacgggcgtgaaccactgcgcccagccagcaaggatgctttgagctacaaacaacagaaagccaggacataaccaataagaagtttgaactttgtgtgatcagagtttatgggttgggctgccccaggcttggataacttaaaggcttgatgaggtcatcaatttatgcttggctacccatggcacagaagcatagccccactgtgatggctggggtggctccgggcatcctgggcagtcaggaggaaactccatgaaggaaggagctaacctttctgggggtacccctatcccagcacagacttcctcatctcattggtcagaactgggtcacatgaacatgcctcagcctatcacaggcacagggaatgagaccatcatggaccaatcaggattcaccactcaaggtggggcctgccatccggatggatgctctccgccacagggaggtgggggacccagaagctgtgggcaatggccatgtgcacagtaggactgaggcactcagtcccgtagctgacctacctgggacaggcctggaggctgacttaggtgtgaggggcagagagattactgtgcacagaccgctgtgtgaccccagatctaggtgggatcccggtgtgccccatctgcctggcttaccccaacccctctggaacctgaacctactcccagagtcccctctgtttttttattaatattattatggagacatctctttatttatttattttggagacaagctctattgcccaggctggagtgcagtggcaccatcatagctcactgcagcctcaaattcctgggctcaaggtatcctcctgcctcagccgcccgaatagctgggactccaggcatgcagcaccacacctggttaatttattttactctgtttttagtagagacaaggtctcactgtgttgtccagactggtcttgaactcctggcctcaagcaatcctctcacctcggcctcccaaagtgctaggattacaggtgtgagctaccatgcctggctaatttttgtatttttagtagagatggggtttcaacatgttggccaggctggtctcgaactcctgacctcagacgctccacctgccttggcctccccaaagtgctgagattacaggtgtgagccaccatgctcagccaagcagcactctcctttttgcccatgaaatgctgttatctttaaattccattctagaaagtccattggattggcaaaaactacacaggcaagtatgcagtaagcatgggcccatggaaacttcctgctgccttcctgggccggatctgctgaatgcaggtctctggtttgttttggcctgcactgggtcattcgtgttcctacatgcaggaaatcttgcaaacgagccatggtgaacactaaagtcttttgtttttttttgtttgtttgtttgtttttgagacagagtcttgctctgtcgcccagcctggagtgcaatggcgcaatctcggctcactgcaaccttcgcctcccaggttcaagcaattctcctgcctcagccttccgagtagctgggattacaggcgcatgccaccacacccagctaatttttgtatttttagtagagacggggtttcaccatgttggtcaggctggtctcgaactcctgaccttgtgatctggccgtctgggcctcccaaagtgctgggaggcgtgagccaccatgcccggccagtgaacactaacgtcttacgaggtatttatgagagaaaagcttaaaattgcaaaaagtccatgcagagccctcattcctcgcaacacattgggctgaggccactgtctaattgcagtttagggaaagacaggctatcccaagggagttagagccctgggacacctgggctggaatcccagcactgctcatcctggctgtgtgaccttgggcaagttgcttgacctctctgtgctatgtttcttacctgtaaaacagagatgatgatcatgcctgtaacgtaagtggttgtgagggcttgatgagataaaccacgtcaagcactctcaagagtatctggtccactagaagctccagtaagctttttttttttttttttttttgagacagagtcttgctctgttgccccggctggagtgcagtggcatgatctcagctcactgcaacctctgtctcccaggttcaagcgattctcctgctttagtctcccaagtagctgggattacaggtctctaccaccatgcctggctaatttttgtatttttaataaagacacctggaactccaaaagtgctggattacaagtgtgagccactgtacccagccattaagcattaactgggaaggccctggggccactggccagcaccagtttgtgagggcagagccagaaaagcccaggcttagaagactacacacacacataatcgcatcctgattctggaaagtggagatgctgtcactgctctcgcagaattaagccaaggacctcacctgtcatttaggtgtcaggcctctggcaggggcagccaaaatgctctaggaccacagagctgcaagccagtaaggcttcctagaggaggcagcaccatctgagccaagaatggggtgatggctggcatgagaaaatgtcaggaggtgctggggttaaagcaagatgagcaagcagggaacaggagtgggtggctacagatggatcaggggaggggtataggtgaagagggtacggggtgagccccagagccttgcgtgtgcccactcaggacagccatagtctgctgctgcccagagaaaggggctggctcaaccctagctcccaaatctttttcctatgcctttttcctttttcctcatctctttcctgaactatccagatatcttcctgcctcctgcctcctgcttctagggcggctcaaatgctcattgctgccccatccctctgggctggaggagcaaacgcctggaggctgaaagagtaagttgtctgcagggaacaagccactgtcctgtggcgggtgcaaattggtatgctctgttcactgagaaaccccgcagtgtatacctgcggtaggcagggcctgataggaagcgcgaaaggagtttctgtcccatgggaggaaaagacgtgagtcctgtatgttctccagcaaaggtagagggtgagaggaccagaggcccacacagggggcatggctgggagtgcaggggcagggggtagtctgggaggatggagggacacaactggagtgggtgctgggtggacttcatgcattccttcagaagccctggccacatctctgccttgttggttttgtttgttttttgagacagggtctcactctgtcacccaagcgggaatgcaatggcgtgatctcagctcactgcaacctctgcttcctgggttcaagtgactcttgtgcctcagcctcctgagtagctgggattacaggcgtgcaccaccatgcctggctaattttgtgtattttaatagagacggggttttgccttgttggccagggtggtctcgaactcctgacctcaggtgatccacccaccttggccttccaaagtgctgggattacaggcgtgagccaccactcccggcctgaatctttcttgatcagatgtcttctgtctatccactctggctctgtctactcccttcccaacacatgccctattttaggtaaccatggtagttttgttttgttttgttttgcttttgtttttggagatggagttacactctgttgcccaggatggagtgcagtggcacgatctcggctcactgcaacctctgcctcctgggttgaagtgatgctcctgcctcagcctcctgagtagctggggttacaggtaccaccaccatgctcagctaattttttgtatttttaatttagatgggttttcccaggttggacaggctggtcttgaactcctgacctcaagtgatctgcgcgccttggcctcccaacgtgctgggattacaggcatgagcactgcgcctggccaaccgtggtagtttttagattttttgtacagagggggtctcactctgttgtccacgccggtctcaaactcctgaccttaagtgatcctcccgtcttggtttcccaaagtgctgggattacaggcatgagccactgctcccagctgctggtggttttaaaagctaggattggctgggcgcagtggctcacgcctgtaaggtcaggagatcgagaccatcctggctaacacggtgaaaccccgtctctactaaaaatagaaaaattagccaggcgtggtggcgggcgcctgtattcccagctactcaggaggctgaggcaggagaatggcgtgaagccgagatcgcgccactgcattccagcctgggcgacagagccagactccatgtcaaaaaaaaaaaaaaaaaaacctgggatccctccacccccctctcctttaaatgtctgtcttggctactttcttctaagtcactaggagatggtaaaagcaataccatgagacttccgaggctagggcacgaaaggatggcttctgcgtggtgctccctctctcccagatcccttgctctgtaggaaaccaacccccaaggcctgaagacacccaagcagccccatggagaggcccatatggagaggaactgaggcatcccacccccaaccggcagctcggggctttgaaaacagatccttccgccccaggcaagccttccaatggattgcagccccagccaatgccttgaactgccaagttcagccacacctaaattcctaacccataggaactgtgagagataataaaagtttgttgttgtttcaagccactaagatctggggtaatttgttatgtagcaacagataaggaatgaaatgaccctgccatttatcattgagatgggaataaactttttttagaatagcaggaagtactttaaataattactagattggccaagcacagtggctcacgcctgtaatcccagcacgcctgtaatcccagcacttcaggctgatcgcttgagctcaggaattggagaccagcggaggcaacatggtgggaccccgactctgcaaaaaatacagaaaaattagctaggcatgatggcgcctgcctgtgatcccaactactcaggaggctgaggtgggaggattgcttgagcctaggaggtagaggttgcagtgagccgagattgcaccactgtactccagcctggacaacataatgagaccctgtctcctcctcctcctccatcgccatcatcacaataataacaacaacaacctgcagacaataaggcaaacctgaccatgtgatcaccctacctttagtccagccagagaagtcttgtgagtccttaaacctaacacagacacttcttgaggtcggcttcagcatcctctcctccaggaagccaccctggtgcctggtgagtggcttcctgggatcacccatgcctcagtgtgcaggatgagagggctggtcctgatccccttctgtcctcacccccaggtccatgtccagggcttaggactggtcgtcccttggtgttgactcatctcccagggatcaaaaaagtcagttgtagctgggcgcagtggctcacgcctataatcccagcacctgtgggagggccaagcgggtacatcgcctgaggtcagtagttcgagaccagcccggccaacaaggtgaagccctgactctaccaaaaatacaaaaattagccgatgtggtggtgggcgcctgtaatcccagctactggggaggctgaggcaggagaatcgcttgaacctggaaggcagaggttgcagtgagccgaaatcgtgccactacactccagcctgggtgacaagagtgaaactccatctcaaaaaaaaaaaacaaaaaaacaccttgtaaaaggtttaattggtctctcttctgagcctgcacacggctggaaaggttttctcttataacagatctgcagtatgagaaaccagcccagttgcatccgttctgggccagtgggattctgggtgtccaaggtccctgtgggccatctacggtgctaaattgaaactttttgaaaagcattttttttttgagatggagtctggctctgtcacccaggctggagtggagtggtgagatcttggctcactgcaaactctgcctcccgggttcacgccattctcctgcctcagcctcccgagtagctgggactacaggcacctgccaccacgcctggctaatttttttgtatttttagtagagacagagtttcactgtgtgagccaggatggtctcgatctcctgaccttgtgatctacccgcctcagcttcccgaagtgctaggattacaggcatgagccaccgcacctggcctgaaaaaaattcttgagacagggtctcactgtgtcacccaagctggagtgcagtgatgcaatctcagctcactccagcctcgatttctcaggctccagcaatcctccctgcctcagccccactgagtagctgggactgcaagcactcgccactacacccagataatttttgttttttttgtagagatggggtctcgctatgttgcccaggctggtctcgaactcccgggcccaagtaatcctcctgcctcagccttccaaagtgctgggattacaggtgtgagctacagcgcctggcctaaatggaaaactggtgtctaggtgccatattctcaggcttgccctcaccataacacattgaacatactccaacctctgagctagatctctgcatctctgcttaaaagcctgaggttttgcttgcacaccccaatttttttttttttttttggagacagggtcttgctgtcacccaggctggagtgcaatggtgcgatcttggctcattgcaacttccatctcctgggttcaagcaattctggtccctcagcctcccgagtagctgggattacaggtgcacgccaccacgcctggctaatttttgcatttttagtagagacggggtttcatcatgttgcccaggctggtcttgaactcctgacctcaagtgatccaccagcctcggcctcccagagtgctgggataacaggcatgagccaccgcgcctggccatgcacccacatttacagcaaccttattcactaaggcctaaagatggaagtgacccaggtgtctactgatggatgaacagatcaacaaagtgggatgtattcacacaaaggaatattattcaggggggaaaaggaaggaaattctgacacatgctacaacatgaatgaaccttgaagacatcatgctgagtgaaataaactagtcacaaaagaacaaatactgcatgagatcccacttgtatgaaatacctggtgtagccggagtcatagagacagaaagaatggtggttgccaagagctggggagttggtgtttagtgggtatggagttcctgttgggtaagatgaagagttctagagatggatggtggcaattgctgtccgtattgaaaatgtgcttaacacgattgaattgcacacttaaagatagttaagatggtaggttttgttgtgtgtattttaccacaattaataaaatttgaggccaggtgtggtggctcatgcctgtaatcccagcactttgggaggctgaggtgagtagattggttgagctcacaagtcggagaccagcctgggcaacatggtgaaacctcatctctacaaaatatacaaaatgtagctgggcttagtggcgtgcacctgtggtcttagctactcaggaggctgaggtggaaggatcgcttgaccccgggaggtagaggctgcagtgagccgagattgtgccactgtactccagccaggcagtagagccagaccttgtctcaaaaaaataaaaataaaaattaatgtttaagattttattttattttagattcaagaggtacatgtggatgtttgttacatggatatatggcatactggtagggactgggcctctagtacgcccattacccaaatagtgaacattgtacccgataagtaatttttttaaccttcctccccttcccaacctcccctctattggaatccccagtgtctgatgttcccatattttttttttttttgagacggagtcttactctattgcccaggctggagtgcagtgcaatctcggctcagtacagcctctgccacctgggttcaagtgatcctcctgcctcagcctcccgagtagctgggactacaggcatgtgccaccacacccagctaatttttgtattttttagtagagatggggtttcaccatgtaggccaggctggtctcaaactcctgacctcaggtgattcgcctgcctcggcctcccaaagggctgagatcatacgcgtgagccgctgctcccggccatggcagatccttcttgaacacccactatgcatgaggcctccgctgggagttcccatcattcaccctcatagcagctctacaggaaggagctgtctgcccccaagtcacacagtggacaacagcagtttgggggtcagccttggcccccccactccgaactcctcgccgcctatgccctccactcctttccactgttaacccaagatggaaaagcttatgccaagggtcatttctcaggatatgcacataacaggaaaatgtgtttttatccaaattcccacaacccaccagccatgtgatcttgggcaacttagaacctccaaggagggtctggctctgttatctatgctagagtgcagtggcatgagcatagctcactgcagcctcaaccttccaggcataagcaatcctcctgcctcagccttccaagtagctgggactacaggtgtgcaccgtcatgcccagctaatttttaaaaaagatttttagtagcaacagggtcttactatgttgcccaggccagtctcaaactcttgagctcagacaattctcctgccttgaccttccaaagtggtagaattataggcgtaagccaccacaccgtggcctggtttcatctttaaaatagggataaggtgaggcatggtggctcacacttgtaatcccatcactttggcaggtcgaagcgggaggattgcctgagctcaggagtttgagatcagcctggacagcatagtgagaccccatctctaccaaaaaataactgaagataacactatcaacatcttgggtggttgtgagaattaaatggggaattttatgttagggacttagtgaggtgttgattacatagtgaacctattattcacagaaattcaatggatgttttgaggtgccctctacttgatgcaagcctcagcgaggtggcagtggtggcctctgtccccatggcacggatggtctgttctgctttggaagcactggaagggcacatctgacaattgcaggatggctggtttttattggaggaagggaagctgtttatttgtttcagattggctgagctgtggggatgcgggaggctggcaggaggggaggggtctatagtaaggagactggagaaactctggggaccaggcaggcagccccctggtaagagctgcttcttggaacacaaagagccgttgcgtcctccagccggccttgaggaaggtgtgacttctctgctcccagcaatgtcttgggcacccttctctgccctgcacaccagctctgcctgcagggtgcctggacactctgggtgtctactgtgtccccatatggtgcttgcaagtcttcctcccagactgccccctgcttctgtgtcccctccctggtgcacagcaccacatccagcccccctcccacccagcccacccaggtcctgcccacgtgacccccagtctttctccagtcgcacctcctctgcacgctgaccgccatgtcttgtcctctttttctttttttttgagacagagtcttgctctgtcatcccggctgctggagtgcaatggcgcaatcttggctcactgcaacctccgcctcccgtgttcaagtgattctcctgcctcagtcctccctgggactacaggggtacaccaccatgcctggctaatttttatattttcagtagagtcagggtttcaccatgttggccaggctggtctcgaactcctaacctcaggtgatccacccgcctcggcctcccaaagtgctgggattacaggcgtgagccaccgtgcccaggctgtgtgcttctattctagctccccgactcctgatcccctgactctgaggcctcaggacgaaggtctcatcccctccaggcaggccctccttggcagggcagcttcaatttgtataggaatcaaatccatcctgttggggttttaccatgttccccaggctggtcttgaactcctgggctcagacaattctcctaccttggcctcctaaggtgctgggattacaagtatgagctaccatgccgggcctattttttttttaataattttttttttaatgtgggagagttcaaatgtgaaatcaaggcccggtgcggtggctcacgcctataatcccagcactttgggaggtggaggcaagaggatcgcttgaggccaggaattcaagaccatttggggcaacatagccagaccccgtctctacaagaaattttaaaaattagccagacgtggtagtgcacacctgtagccccagctactctggaggctgagacaggaggatcactggagcccaggagttggaggctgcagtgagctatgctcacaccattgcactccagcctggttgacaaagtgagacccagtctcaagaaaaaaaaaaaaaagtgggaagaagcataccccaccacacttcttctttggggttagaattttgggcctgcactggaatgtggaacgctgataggggatggggacaggtggaggtgtcaggggcgccctcagactctaccctccttcattgccttagaggtgaggctggggaacgaccctggggtaaggggttgcccgtgcccactcccctgcatgcaggagctggatctctgcttcactcttcccctttcctgatgggaacttgctcctgcatttggcccctgggcctctgggtaacctgccccagccaccgagggcttggccccaggcgagtgcatctgtaagggcagatcccgcggcgaatttcctgggtgactcctttgcacacacccaggctggactccctccaccccctcccaactgagcaatgctttggggctgtttcgtccactagagcagcacagtcaagaatgagggggtgtatgggctgggcgtggtggctcacgcctgtaatcccagcactttgggaggctgaggcaggcggatcacaaagtcaggagttcaagaccagcctggctaatatggtaaaaccctgtctctactaaaaatacaaaattagccgggtgtggtggtgcatgcctgtagtcccagctactcgggaggctgaggcaggagaattgcttgaacccgggaagcggaggttgcagtgagcagagatcacaccactgcactccagcctgggcaacagagtgagactctgtctcaaaaaaaaaaagaataagggggtgacacctcagagaacaagctgcaggcctggtgtcacctgcagatgacaaggctaccgtatccattcctcaagccaggcctctgaggagccctggtgggtagggtgctggagggagaactcgagcttgcaggcagtaaaacgcatttttttttttttttttttggtggcggggacagagtctcaccctgccgcccaggctggagtgcagtggcgcaatctcagctcactgcaaactcttgactcctgggtttgagcgattctcctgcctcagcctcccgagtagctgggattacaggtgtgcaccaccacactcagctaattttggcgtttttagtagagacagggtttcgccatgttggccaggctggtctcaaactcctgaccttgggtgatcaacctgcctcagcctcccaaagtgctgggattacaggcgtgagccactatgcctggccacatttctttctttcttctttttttttttttaatctgtgcttttctccaccctcttcagactttgttctagtctacaatttccctcctgcagcttctctctgatgacgtccccacccagcccgtcagtccaaattagcctggtttaactgcgtttgtcagtttctgtagaagaatgaagaaggtgatagcacccacgttatagggctgttcacgggaggttgaagtgagatcttacagagaaagtgcttagcaggtgccccaggtccagagtgtggggttggctgggagtcgtgtgcatttcctgccctgaccccctctgcaagcttggttcctgagtgcttgagtgaggcacacttgacctgcttatgtgattcccatggcaccatggtgtggggaatgtctcccaacaagacaccttatcaagcgctctctctccactctgctgttcctaccacatattcccaggcaggtcaccctacctttcttgttttcttttgaagacagggtctcgctcggtcacccaggccagagttcagtggcaaaatcatagctcactgcagctcctggactcaagggatcctcctgcctcagcctcctgaatagctggggccgcaggtgtgtgccaccacacctggctaatttttacaatattttgtagagacagggtttcactttgttgcccaggctggcctcaaactcctggcctcaaacgatcctcctgcctcggcctccaaaagtgctgtgatttcagacgtgagccacctcacctggcctgacccggcctttctgagccttcagccctcatctttgtctgggggcattctaaaaaccaaggaatagaataccagggtcagactcagactttgcgttcagtaggccatgaatacttgggttttcgctcagtttctggggcattgagactgatagaagcaactgacccccttagctaaggcaggcaggcaggtattgtcaccaagagaccctggagatcaggagaggttatttggggttggggatctccaaggaggggcagggaagttagtaccatcgtcgggctggaaatgggaagcgtttggctcgttggaagtggtgaggctggggtgtgggaccctcgccatgtgacctacgtggggtgatctcagtagaaattgggacctgccaaccatggttgcctgggagagttgcctgggcacctgcctgtgatcccaactactcaggaggctgaggtgggaggattgcttgagcctaggaggtagaggttgcagtgagccaagattgcatcactgaactccagcctgggcaacagaacaattctctgtctcaaaaacaaaaacaaaaacaaaaacaaaaaaacaaaaaaaaactatttacccaatttcccttgcttatgcatgcttaaattttgtataagcttaaatatcttttccatctaagctgtactctatccccttttataactttaggtggctgtctttattaaaagttttttcttgaaagtcttaaaacaatatagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcggtaagttctcagcgaacgacgtgaccttttccttcatcttctggattctcagtgtgactgataaatgttgcaacatgctctgcagggggaaaatgctttagcgtctattactgcatcataatctcatctttggaaagccaggagcattttgaaaattacattacagacattgtttaaacatagtttggatttaccaaagcataggacattgtcttgtctgatgttaattagtcagctcaagattagtgctaaagacttagtaatttagttatttctcttagctttaaaatctttatttcagaactatttcacctcttggttttcttttttttttttttgctctgtgttactgcagctgctaatctgtgagctctcaatggatgatgtatcctagcaagggactgaatgagatattagcggcaaattatgttgatgattcatattttgaataaatggaatattaagcttgtatacatcttgaaaatagtactttaatattctactgtgtcatagtcacaatgattggatatgaattgaatttttgtactttttaaatatgtttttgttctttatttttaatttttattattatttttttgagacagagtcttgctctgtcacccaggttggagtgcagaggcacgatctcagctcacagcaacctccgcctcccgggttcaagtgattcttctgcctcagcctcctgagtagctgggattacaggcgcccaccaccatgcccagctaattgttgtatttttagtagagatgggatttcaccatgttggccaggctggaatcgaactcctgacctcaggtgatccgcatgcctcagcctcccaaagtgctgggattacaggcatgagccactgcacttggcctgttctttagcattttaagttgcaactatatatccgtaaagtcttatttccacacaactaacacatgttttaggaagtttgctaaaagacccctggagacctttatcgtggtctcccttttgtcgtgtttcatttgcttgatcttttctgccctcctgcttttcagaaattaaaaggctaaaaagaggtgctaaatgttaaaacttctcgtgtagtctcccatgagactattaaaagtaatggcaaaagccacagttacttttgcaccaacctactaattctaagaaccaccaaaaaggggaaagttcttggaaagcagtaaaatgatatggacagttgggatgtaaaaatgtagaaaatatgtcattgtatgttcagtcatcccaagaccctagtgctgccccgatggtagggacttcttaatgagaattaacttttgctcaattttcagagaaatggaatgctcgcatcactgatctacgtaaacaagttgaagaattgtttgaaaggaaatatggtatgtctaaataggaaaattcctgtaatactttgttcatgagcatttacacaatggcgttactgttcatcatgggggtgatgtggacaagcccagcccagggctgccagtgaaccgtgccacactttcttacacgtctctcattgtaaggtccttagtagtgtctgtctaaatattagaaacagtctttgtttctagattacagtaaagctaaggaaaagttgtatttctgtagttatcagctaacatttcttttaaacttccagcatggatatttgggaatttatttacatatttattacaaagctctggatcttgggggtttcattaaaaattatttttttaactgatagtttctgttaatctactttgttaaatccagtatttgctgagatccccctattgtctctacttttatcttttttttttttttgagacggagtctctgcattgcagtagtacgatctcggctcattgcaacctccgcctcccgggttcaagcaattctcctggctcagtctcccaagcagctgggactacaggtgcccgccaccatgccctgctaatttttgtatttttagtagagacagggtttcaccatgttggccaggcttgtctcaaactcctgacctcaagtgatcctcccgccttggcctcccaaagtgctggcattacaggcgtgagccacccttcccggccactgcttttatcttgatgtataactgagttgatgctagatttcaattccttctttgtccttttactattctgtcctatagccacctttatataatgatcaaagaaattcacaatttgttatcatttttattttttataaaatatttaaaatgatttaaaataaaaatcattttatttttatcatatttattatcatctgttatcatttttatttggatgactatttactttgccattaactagcaagcggtaaaattgtatgatatgcagttttaactgaattgctataagtgaaaatttaaatgcaataaaccatattgatggtatttgtgttaacaaacttaaaatgagcattttttcttcatcatgagtaatataacctacccctcaatgaaaatctacaattagagtaaatttgctaatgaattcagtaacttttccatatttttagtggtttacttaaggttctcttagtgtttctcccagtttttaatagcttacaccttttttgcccgtggttttttgttttttgtttttttttttttttttttttttgagatagagttttgctcttgttgcctagtctggagtggcacgatctcggctcactgcaacctctgcctcccaggttcaagcaattctcctgtctgagcctcctgagtagttaagattacaggtgcccgccaccatgcccagctaatttttgtatttttagtagagacaaggtttcaccatgttggccaggctggtcttgaactcctaacctcaggtgatccacccacctcggcctcccagagtgctgggattacaggcgtgagccgctgcgcccggcctcatgttttctattggttcattatgaagcaaaaacttcatagcatgtgctacctggaagcactgtgacctagtggtaagatcataggctctggggacacagtgccttgccacgtctcttctcctgtctgagtcttagtatcctcttttgtggtcatgagaactgaagatctatcctggagattgataagatagtaaagtgcttcacgtaatacctggcatacatgtaataaatgcttcctgtgtgtatatatatacacacatatacatatatatgtatatgtacatatacacatatacatatatatatatatacataaacacatatacatatatatataacacagtgaaacccccgtctctactaaaaatacaaagaattagctgggcgtggtggcgggcacctgtagtcccagctactcgggaggctgaggcaggagaatggcgtgagcccgggaggcagagcttgcagtgaaccgagatcacgccactgcactgcagcctgggagacacagcaagactccatctcaaaaaaataaaaaaaaagttaaagagcactacagattcaatgatttattattcttttctacaaattgtgtttaaatgatatctctttctctttttgtccttatagctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaagtaagactcttggattcctgttgaactcttgtctcttttctgagtaatacgtcttttttattgttgaccaatattcattcaccactagggttctatgtgatgaagtttgagttattttatgtatttttatcttgcactttttaatttatctgggtccagcattgcatcagtcatgcagtgttggcattcgaagcatgaacagtgcccgcactggattggcatgcaactcacattttctttcacaattttctgctacttttgctaaagaacatagaatccacgccttgtttttaggcctgatatatatatatatatatattttcgagatggagtctcacactggaacccaggcttgagtgcagtgtcgcaatctcagctcactgcaacctctgccttccaggttcaagcgattctcatgcctcagactcccgagtagctgagattacaggcgtgcgccaccatgcctggctaatttttgtatttttagtagagacggtgattcaccatgttggccaggctggtcttgaactcctgacctcagatgatctgccaacctcgccctcataggcctgagatttttaaagcatgcgtgggaatatatgattgtttttatagatgtgcagaggaagatagtcttgaatgcaatatgacattaaaggatcccatttaagatttttgtaatatgcttcaaagacctgtgggttgcaaagttacctctttacttgtgaggatacatgctccatgaagcaccttatgagacaacttgcaattattagtttgctttttactctgtagaaacctcaaattaagatttagttgtgggctgggtgtagtggctcacacctgtaatcccagcactttgggaggccaaggcggctggatcacccgaggtcaggagttcgagacaagccaggccaacaatggtgaaacactgtctctactaaaaatacaaaaattgaccaggtgtggtggtgggcgcctggaatcccagctacttgggaggctgaggcaggaggattgcttgaacccgggaggtggaggttgcagtgagtcgagactgcgccattgcactccagcctgggaacaagagcaaaactccgtctcaggaaaaaaaaaaaaaaaaaaaaagatttagttgtgctcaagcatccagattatcttttcttttcaaaaccagccttactgactaaatgttaaatatgtactagtcgttattagtttgctgaatattacctagtgattattgagtatttattctcacctttcagacatgagcttctgagttcaacacgtgaagatttacagcttgataagccagcttcaggaggtaggtcttcaatctcgaggcagatcagaagattatgtgcaataattatttcacgcttaacattgatttcttctttatgttaccttccacatgaaataatatgtctctaactattaattatgtgccattacaggagaattcatgttgtcaaaattctaataatttctagaagaataaacgcatcttctttttattaacccattgtaaatacttataaatattgcatttatgggtagacagaagtaaaagaacaatatttgttctacttttgatgcaagatttatctggcataatgcattgaacagtttattattgaagtctacacgagtcaatggaacaagcattcattgaatgtccatgatatgcaggacataagaaggtttccttttagagcatggagccatttatatcatctcttaattgttagatgtattttgttttgttttgttttgttttttgagagggagtcttgctctgttgcccaggctggagtgcagtggtgcgatctccgctcactgcaacctcccgcctcctgggttcaagcaattctcctgcctcagcctccctgtagctgggattacaggtgcctgccaccatgcccagctaatttttgtatttttcgtagagacagggtttcactatgttggccaggctgatctcaaactgctgacctcaggtgatctgcccacctcggcctcccagagtgctaggattacaggcatgagccaccgcgcccagcctgttagatgtgttttaaaataaatagaaatataattgattttcttgcttgcttttgctctggagtggagtggagtgaggataaaacagaatggaatcaccctgttgatatttactaagatagaaggactgcagcaagatcatagccctaatcttcctgtagcaagtgttacctgctagctgttcctgaatacactgagttttgctttttcctagctctaatgaatgtttcgttcttcctctttttgtacagtgtcagcattgttttagaaataaatacattctagaatcttaggaataattttattattgtctttttttttttttgagacggaatctcattctgttgcccaggctggagtgcaatggcgcaatctcagctcactgcaaccgctgcctcctgggttcaagcgattctcctgcctcagcctcatgagtagctgggactacaggcgtgcgccatcacgcctggctaatttttgtatttttagtagagatggggtttcaccatgttggccaggctggtctcaaactcctgacctcaagtgacccgcctgcctcggcttcccaaagtgttgggattacaggtgtgagccattgcacctggccacgaatcttagaaataattttggccataggaaaaggaaaagttatacctcttattttatagtaataatgtttaataatcaagttattaaacccattaaattgagaacacttgtattactgttattttgacagtaaaggaagaatggtatgccagaatcactaaattaagaaagatggtggatcagcttttctgcaaaaaatttggtaagtctgttttttttaattaccccttcaactaaaatgtattactgagtaacatttttttaaatgttgttttattttaggaaagtaaatacagtgaataggactcagctttagttttccctgttttttttttgggttttttttttttttcttgagaaggagtcttgctctgttgcccaggctggagtgcagtggtacgatctcagctcactgcaacctcctcctcccgggttcaagcaattctcctgcctcagcgtcccaagtagctgggattacaggtgcccgccaccacgcctggctaacttttgtatttttagtagagatggggtttcgccatgttggccaggctggtctcaaactcctgaattcaggtgatccacccgcctcagcctcctaaagtgctgggattataggcgtgagccaccgcgcccggcccccattctatgaattatctgtggaaagttatttcctttaaaatggcatgctcgtgaggttgaaggggtaaagaacattgatctggttgccacgcagatgaaagtgtagtcggaaatgtgttaccagtttgccatagccgatggaggagggtaattacggtcctgaacagttagtagcaaaaggctgcttccagatagtatttaggttgtgtcctctattgtccatgatgattttctttctctcttttcttcctaaggatattgaaaaacaaactttaatcttttaaagatctcagagctattaagattgtcttaggaccaggacacttaaatctgcccaaatctggctgttgatgatcggtcatctctacttgtctttgctgtattaagtctattcaatagttaataaatatgtttctagaaagagtttttttcaagtaaaacaaaattgacctgtgcctttctttggattgtactaaaatctgatttcaatacaaatgtagtctcccgaattgctttgatttttgtccagcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaaggtaagatgataatctgtagaaatagtttcagtgtcttccctgagaagaggttaatttgatgaagaagggccttttgtttaccttatgacttatttctattgacaatgaaggcattaatatttagattcacttagtgaacaaatattagtataagcatcagatgtgcaaaattgggtctaacaagaacactgtccttggggccttcatacaaagaaaaatgcactgaaggccgggcgcggcagctcacgcctgtaatcgcagcactttgggaggccaaggcaggtggatcacttgaggtcaggagttcaagactagcctggccaacatgatgaagccccatctctagtaaaaatacaaaaattagctggaagcggtggtgcgagcctgtagtcccagctacttgggaggctgaggttggagaatcacttgaaccctagaggcggaggttgcagtgagccgagatcgtgccactgcactccagcctgggcaacagagcgagactccatctcaaaataattaaaaaaaaaaaaaatagaaaaatgcaacgaagtgttattgagcgtttttaagggagaaggcaaggatggcacacctagctcggtcacttgtgcatccagaagagatggaaggtgtttcaagtgaaggaaatcatatgagtagggggaggaggtggcaaatatgcctgcgtatccacagaactcacccaccgtgtgtggagtgaggactgccacgtgggcgtggtggggttgcatggatcgacttgggtgggcaagtggaggaaggcctgagatcctacgaacacagaggcagtcacgaagtggtctcgaggcagatgcctctgaaaataatgtggatccgccctttagaaaggtaattctggcttgattttgaaggataacacaatggttagtttgggtgcggggttaggaacagaaggcctctctccactcattgacgggatgtggaagggtaaaccttccttactgattggggtcatgcctctgtgtgtttgttgggactgagttataagggataggaaacgtttaagatgctacagcgagctgcttctggctgtgctgtgggacagttcatctaagattcagaaacagaattgagctggtttgggggaaaagtgactttcgcctgtttatcttaaatataggatgattttgaaggtctcacccgaatatctgaaaattgccattttcaaaataaactcgtcaccaaaatgatttttttttcactataaaatgaaggcaggatgaaccatatttataactaattggcaatgaacagctggtgagaaaggcctgtgagttgcttctaaatgctttattactaatatcaactctgtttctacagaccagaacttctgactcacagtaccactgaagttactcagccaagaacgaatacaccaggtaaactagttgtgaaatccttttttaaaaacacagatcagccaggctcggtggctcacacctgtaatcccagcactttaggaggctgaggcgggcagatcacaaggtcaggagatcaagaccatcctggctaacatggtgaaaccccatgtctactaaaatacaaaaaaattagccgggcctggtggcgggcacctgtagtcccagctactcgggaggctgaggcaggagaatggcatgaacccaggaggcggagcttgcagtgagccgagatcacgccattgtactccagcctgggcagcagagcaagactctctcagaaaaaaaaaaaaaaaaaagcacagatcaatactttgtaagcttttaaaagttaatcttttaaaattatggaagtcccccttcccctgcctccccaaaaaatcatttgcagaagctcaatccagccactccttgatttatcaatgtgaacacctgcagtgcacagataactcaagctttgaccgtagaccactgctatccatgagaaaggcagtgtgccccacaaatgcaagccacatgtgtaatcgtccacgttctagttcagcctgtaatcattataaagaaatacacagggaagtatttcacggtctttatcccatgttctttatttgacagttggcgcgtctttcatactcacagcatatttcagttccaagtagccacatttcaaacatttcaactgctcggggatagtacctgctatatgcatttagaccttaatgtttattcatatgtatcgtgttcctaaaatggcaaagactgtaactctgacctgcacacaaatatcacagcctaatagggaagatctaagaagtctctgttcaatgaatgatgttattttctttattagagctctaagtgtgcctttatttctttcctatcttttttttttttttttttttttgagacggagcctcactctgtcatccaggctggagtgcagtggtgcaatctcggctcactggggcctccgcctcccgggttcaagcagctctcccgcctcagcctcccgagtagatgggactacagctgcacgccaccacacctgggctaatttttgtatttttagtagagatggggtttcaccatgtcagtctggctggtcttgaactcctgacctcaggtgatccacctgccctggcctcccaaagtgttgggattataggcatgagccactgcacctgacctctttctttttgtttgccgttgtgtaatgtcagaggaagtgaccacactctgtagatcatcagccaccttaggaacttctgttgccaagaaccaataaatgcccataccctgtagtgtgtaaatgcccataccctgtagtgtgaagttttctgttgttagaaataagtgttaggaatcaagtatgaaatttgtgtgtgtactaggtgtatacagattggtgcagttaatcatgctcacgactactaaggtgaacaaatgtttcaagttgggttcctgggtgtgccctaaaatacttctccttcagctctcacagcaccttgtggacatgagtgaaggtcagtcagtgtgccaaatagattttgtgtggattatggcatggaaagtggctgagaaattctgtagcagggtaacaaaattatcttggtccaggagtcctgtagtggagaagataaaagtcaatgcttaactcataggttaacctcagcatgcttttgatttggtcaagcaatcaaagtactggtgaagaattgaagattggaagtgacacattttttgctcagggaagtaatggagaaagaaaaatcttcctggaggtagatcttcagtttggattagtctgaacatgatgaaacctgtagaaaccttcatttctcaagacaaagctcaaattcaaggttgtgaggaatgcagtcaccacttttgttaggggcagttgtgacagtgagtgactgcaaaaactgagaatgcgaagcctctattgtaaaaagaatgtgcaagtgccatagaagtcactgcaaggattgggtgctggagcagtgccggacctgccatcgtcaccagagtgcagcagattcaccagaaggagaatctccactcttgtcgtcactaacagcacttgactttgtcccattcataaaagatcttggaaggaattaaaggtgcttggtggttcctcattccaacaacaccttacttggcctgcccgtggaacatgcgttagtctttggacaggacaactcgagtcacagaccacaagagaaaagaattttgtggccatcagaattgtctgcttaaacacaccacgggtgcacagtgtcctcagcttggtgaaagggagatgtcacacgcgagaaggcagcggagccaggcatgtgatggagtgggaggtggcacctggctctgtgaggaggctgtgaagtcctgcatgggaggagcaaggtgggggaggagggggtgggggtggggcagaagaggaggctgagcagttaatagaggcgctcgaccttagaggaggagagtccgaggtctttattggtagtattcaaatgtggttcatccagagttattttctgtggctgaatggcctactctgaaatccacagggaaaaaacaactcacattcaacccttgagatgctaagttttcttttaaagtaaaggaaatgttataagattttctgaaaccaccaacctttagcgatattgtcagaccttctccaacattttccactgcatttgtcagcaatcagagatgacctccacaccgaggcgaaccctccaccccccgacccgtttcctctttctctctttccctcctttgctcatccagaaacacttcagtcatcctgcattgtctccaagttgacctccctcctcatccgcaccttgtccacacctgaatactctgtccacatcagtgatattctacatgtctttgtaatagcttttttgtttgtttgtttgtttgttttttaaattttgatgcttaaaaggcaatggttgtcttagggataggaaaacacaccccactgtcactgtgagtgaagctgaataacgtctctaggtcttttaccattgctttcttttttttctgaagtgatttttccttttatgtccattgctttaagccattcgtgaaattgcacagtgatttctggagtggggacagaaggaaggcggtagtaaaagtcattggtgctgtggcccagttggctggaggaggtgcagggcagggcggcctgcgctggggcagctggaggagcacagatgtccccacgggcaggtggatgagttctgagagctggagggccggtacagtgtcctccatggttccagcttgtgggcttgatcaggccgtcacctgcggtggccactgagctggcgatgaactccgtggccttggagtcgccctcggcagagatgatggccgccgtcttctgctgctcagcccttgccaccacagatctggccctctcttcttcctgctgagccacctctttggttccactgcttctgcaaattccttcccgaaggtcagatccaaggtcacagcatccaggaggaacccaaaggttgctgcttgctccgaagttaattgctcacctgtctggagcccagctctccctgcgtgatcagttctccagcgtcagcctgagccgcccccagcttgaggagctccgcagtgatggatggcagcacattcttcattggcttctccagtaattggaagatgcaaggacctggccagcaacaaggcgggaagaggacgcccagtgtgatggtgacaatctttgctcacagtgatgattggtgcataatgtggtcaagagcagcagtcaaaaataattggtttcttttcccatgggatgagaaagtgcgttccttcccctatcacagtgtcctgaatgccatggaattggtcgaagatgacagacagctctctgtgcagcatcacattgtagaaggcagagttccccacacctcctgcagaagctaaggacagggcagacttggcagctgtgtttccatctgctggacccactcacgcctgcgtccactccaaccccccacatgaattccgtccctttatcattgatttctgatgcgaaaagtcactttgattagtgaagtgttgctttatgtagatttttaggcacacatctgttagataaaacgaggattgcctgtagagaaagcaaataaaagcaaagtccctcttgttgaaactggtgtgggagcccttgaacctcatgcagctggcctccctgctctgaccgagttccctgagggacttctccaaggaggaatgtgtgagaagcactgattttgagcactctttcatgtggacaaatttcactttatttacaatgtaaacttaaatttaaattctgtctttctaggctgggcacggtggctcacgcctgtaatcccaacactttgggaggccgaggcgggcagatcacttgaggtcaggcattcaagaccagcttggccaacatggtgaaaccctgtctctactaaaaatataaaaattagccgggcgtggtggcggctacctgtaatcccagctactcgggaggctgaggcaggagaatcgcttgaacccaggaggcggaggttgctgtgaactgagatcacgccactgcactccagcctgggcgtcatagcaagactctttctctaaataaataaattaattctgtctttctgcagtttttctgatatttggcaagtactggaaattattattttccttaagaccccaaattttcacaccaacatggcacatgtatacatatgtaacaaacctgcacgttgtgcacatgtaccctagaacttaaagtatgataaaaaataaataaattaattaatttaaaaaaaagaccccaaatgtttgcttttaacaaaactgaattaagagaatcactgcaggccgggcatggtggctcacgcctgtaatcccagcactttgggaggccgaggcgggcagatcacgaggtcaggagatcaagaccttcctggctaacaccgtgaaaccccatctctactaaaaatacaaaaagaaattagctgggcatggtggcgggtgcctgtagtcccagctactcaggaggctgaggcaggagaatggcgtgaacctgggaggcgaagcttgcagtgagccgagatcgcgccactgcgctccagcctgggcgacagagcaagactctgtctcaaaaaaataaaacaaaacaaacaaaaaagaatcactgcaaacaagagtactttctagcaaaatccattctgatttgcaacagcactgataaataacatggttattgggtttctttttgttttccagtcaaagaagattggaatgtcagaattaccaagctacggaagcaagtggaagagatttttaatttgaaatttggtaagtaaaagccagtatttatgtctttaataacatatcaacaaagggccatgtctgaatgaagtatagaagttcgggaccagccgggtgcagtggctcacgcctgtaatcgcagcactttgggaggccaaggcgggcggatcgggaggtcaggagatcgagaccatcctggcgaacacgatgaaaccccgtctctactaaaaatacaggaaaattagccgggcgtggtggcgggcgcctgtagtcccagctactcgggaggctgaggcaggggaatggcttgaaccccagaggcggagcttgcagtgagccaaaatcgcaccactgcactccagcctgggcgacagagtgagactctgtctcaaaaaaaaaaaaaaagaaggaaaaaaagttcaggacctaaagaaggaaggtcccagaaactgggtttctgtttctttctaccactacacttgctactgaaaccaagcagatgacttcatttctcttggattccactttctcacgtgtcagaatgggagaggaagggaggtgttgggataagtttcagttccactgtttgtacttctcgtctggctaacacccatgtggcaaataggtttcatcatttgtttcagcttagatttgttgacagcggtttcctggagtgctgtcttgagaacgattctgaggaggctcagcaagaaagagtgtttcagttgattgggtgtgtctgtcatggagaaggaagtaaggagtgggcagtgctagcaaaattcccggggcacttctgtccattatctcaatacctggggttgacatttcctgtctcagatcaggagtcctgactaccctgcctctgaccactcgaactgagtgctgcttagctgtatcgtagacaccgcctgtttgtgaacagacaccctgcttcttgataacacaaaggccagcagggtccactgctgtgtggaatggccttcggtcatttctgcccagagcatagaggtcattttcactaataacataactctccttttgattgaaagtgttaaaatgttcctcctaaaagcacttattttttaggctcgttcttcagatttgccccatatcctaagcaaaatgccttcaatatgaagtggatattgcttgaccgtagggagcttgtccatactgtactcgagaatgtagacacaaagaaagaatgtctgtgtcaaatgttatcctccgcaacttaacgttctcttgcactttcagctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaagtaagttctttttgccactgtagtcgtttctggaatcaaaacaataaaatgacatttctgttaagatgtttttcaagctagaggtgacaggcgtggctgtaagtccttgatggcaaagcctggctgtgagctgcagtccgggtactgtccattgcccctgcccatactcaatcatcttcatccgtgcaaggaaaatagtgacaatcgcctccgcggagtcaccgtgaggccccgtggtgactcgcagtatgcctgagtacttgaatggaagtttaatttgctggtttttatctgctctgttattcctggtcaatcttgagagcgactaaatattgatgattgagtttctttcttttttttgagacggactcttgctctgtcgcccaggcttgagtgcggtggcgcaatctgagctcactgcaacctccgcctcctgggttcgagcaattctcgtgcctcagcctcccgagtagctgggattacagacttgcaccgccacgcctggctaatttttgtatttttagaatagatggagcttcaccgtgttggctaggctggtctggaattcctgacctcaggtgatccacccgcctcagcctcccagaatgctgggattacaggcatgagccaccgtgcacggcctaatgattgattttcttatctacatttctgcagaattttagtggctaaagaaagtacactagtgttttttttttcttttttaatgaaaatagtcacttatttactcttcataaaatggcttaccagtcatgggaaggaaaagtcagggtcttttgtccacaacactaggaattattgtgttacaggatgattctgtgaatgcctttagaaaaaaaaaccctgatcacatcacgaccgttttactagctgtgaggccaccactgtactggctactgtaacacttcttggttttctttctagacctgaactagttatttcctacttgcctcctgggatggctagtaaaataaacactaaaggtaagagactacgtgtactccgtatcctatttgagcgcattaagacactctttatccgcattccttaaatcatacggaatcggccaatatctctgtggggcttggagttgtttactttgctttctaaggtattttatttaatggaactatttttctttttttttttaaaaaaaacaaaacatttcattggaaatgtcacatttgcaatcccagttcattcatgttttcacagctttgttgagcccctgtggaggattacactacaagtttaattctgcaggtttctttgaaaagaaccaaactgtatgaattttaatactctgctcttataaagcatctccttctgtatttttttttccctacaatatacaaaaggaactctgcttattttacagctttgcagtcccccaaaagaccacgaagtcctgggagtaattcaaaggttcctgaaattgaggtcaccgtggaaggtaagggccagtcctcggtatgtttctgttcattctctagtttactaattatgtcagttcactagctatgtgtttatacaggtttatacagatgacgttaaccaaactagcttttaactgtgaacagctgcctgtgataaagctaaatttctgaatgcttctaattgaaaatttttaaatccttaatagaaaacagataacatggatcacatcataaacttcccccaagaaaagtcctaaaatgcttttcctttatcataacaaataagggtgcagagtcatgtggaatgttttatcttttttttcctcttcatttttttctattcttttaaggaaagaaagtttagggtggtttaaacagcagtgccttgaataaaagtattttctttttcttttttgagacagagtctggctctcttgcccagggtggagtgcagtggcacaatctcggctcactgcagcctccgcctcccgggttcaagtgattctcctgcctcagcctcccaggtagctgggattacaggcgtccaccaccaactccagctaatttttatatctttagtagagatggggttttaccacgttggccaggctggtctcgaacccctgacctcaagtgagccaccacgcccagctggttcttgtcttttcaggctcacagtgttaaaatactgcatacaatactaaagacaatctccaaccaactgtcaagtatggatatttcttccatctcttcataaatgcagaaggaaatcactgcattaggatcattctctacatcccaggtgtcaagtttttaaataagagtttgccgtactggtgttgagtggcgcagaagtccctatttagtcatgtggcacactttcagagagcctgctttctcataagatagccaacaggcatccatggacaacttacacctgattaattatttctgttcaaaaatgccaagaattaaaaatatattgaacccttgactttcctccttccggaagagatcagaggaagatctctcttatatacaagatgccagcctttcctaaagggcagagccaagttcacggggcctgggaggcctgctttaagaatacaaaattagggccaggcgtggaggctcacgcctgtaatcccaacactttgggaggccgaggcaggcggatcacctgaggttgggagatcgagaccagcctgaccaacatggagaaaccccatctctactgaaaatacaaaattatctgggcctggtggcgcatgcctgtaatcccagctactcaggaggctgaggcaagacaatcgcttgaaaccaggaggcagaggttgtggtgagccgagattgtgccattgcactccagcctgggcaacaagagcgaaactttgtctcaaaaaaaaaaaaaaaaaagaagaagaagaagagaagaaaaatgggtttctgtagaaatagaaaaatggtttctgtggaactcgccggaatgacaagaatacccatttcaatttgaacctagctttgttttctggcacaggctggacttgaagattgtaacctagagacacttacgtcattaaatgtgtgttgattatcattattttttctgtcttttaggccctaataacaacaatcctcaaacctcagctgttcgaaccccgacccagactaacggttctaacgttcccttcaagccacgagggagagagttttcctttggtaagtaagcgttttatttttctttctttcatagttttaaatagaatacgttcattatgtttcattttaccaggtgaattgttcctattggtgagtcagtatatatcaaaggttaaaggaatagcccgtagagccaggctgcctgagttcagatctgagttcaaatccgatgccacttgggcaggcgaatacaccctgcctcagtttccctttgtgcaaaatggtaataacattactttctttctcatgaggttatggtgaggattataaatactgtcatttaaagtacttagaaccatacctcgcatgtagtagagactataatttgtgggggcattttgggggttttcatttgttttttctttattttagcatttgttcacttatttgtagtcaacataaaaacaatgtactaaaacagtttgcttatgtatcaggatgggagtagttgtcaagtcatatcatggtaaaagattatgcattttttatttcttcttaaagatgcacaaataaggccaggcgcagtggctcacgcctgtaatcccaacactttgggaggccgaggtgggcggatcacctgaggttgggagttcgagaccagcctgaccaacatggagaaaccccgtgtctaccaaaaatacaaaattagccaggcatggtggcgcatgcctgtaatcccagctactcaggaggctgaggcaggagaactgcttgaactcaggaggtggaggttgcagtgagcagagatcgcaccattgcactccagcctgggtaacaagagcgaaactctgtctcaacaaaaaaaaaataagatgcacaaataagatgaaacactcctgcctgtgaatgtgtattgataagtactgtgataagtattgcaatttaactctcttatgttttatatgcagaggcctggaatgccaaaatcacggacctaaaacagaaagttgaaaatctcttcaatgagaaatgtggtaagtctattttgaaaccttcttactgccacgcagggtgccttcatgggagtaggagggagcagagtgggatactgagcgttggagtatccctgtcattggcaacgtgtgggtttttcgggattgaatggcgtcatttcgcccatgttctgtttcgtgtacgcggctgttttgcaggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagtaaggaaactggatgaagtgggattagcatgagttgattgtgtttgacactgggagatgggtatgtgggtttgtgtttgtggcagggctgaattagctctggagtcagaaaaactgctttttaagctgcactcttgtatatgtttaaaacttctggccaggtgcgatggctcacacctgtaatcccagcactttgggaggccaaagcaggtggattacctgaggtcagaagttcaggaccaacctggccaacatgatgaaacccatctctactaaaagtacaaaaattagctgggcgtggtggcacgtgcctgtaatcccagctacttgggagactgaggcaggagaatcacttgaacccagcaggcagaggttgcaatgagccaagatcgtgccactgcactccagcctgggcagcaagagcaaaactccatctcaaaaacaaaaaaaaaaaaaaaagaagaagaaattttccttatgctgctggtagaagggaaggaggactccaccatactagagagataacgacttttagttgctaaatctacacagctatgttgttactatttgatgctgctggaatctgagcagctgtttagtttttcaagtccttttatttctccaacttaatagaatattttcaatttctcctgtttgcttgaacatctgtggattaggctaacataattgaaatagataggaatgggccgggtgcggccataaatcccagcactgtgggaggctaaggcaggcagatcacttgaggtcaggagttcgagaccagcctggccaacatggtgaagccccatctctacttaaaatacaaaaaaaaaaaaaaaaaaatagccaggggtggtagctggcacctataatctcagctactcagggaggctgagacaggagaatcacttgaacccaggaggcggaggagatcgtgccattgcactccagcctggatgacagagtaagactctgtctcaaaaaaaattaaaaaaagaaataagaataattggaattttatagtacatgctaatgcacatgaattatttgaaatcaattgaaatgaattttaggtttcatttgcttggtgtcaggcttaattttgagtcacccagggatgctctcaagcaaagctggccactttttttttttttttttttttttgagacagaatctcgctctgtacccaagactggagtgcagtggtgtgtgatatcggcttactgcaaattccgcctcctgggttcaagcgattctcctgcctcagcctccaaagtagctgggattacaggcatgtgccaccatgcccagctaatttttgtatttttagtagagaaggggtttcaccatgttggtcaggctagtctcaaacccctgacctcatgatccgcctgcctcggcctcccaaagtgctgggattacaggcgtgagccaccgcgcccggccaatggccaccttttatgcttttggccaggtctgcagaggtttggcagcctctaagccctctgcttctgcttccggagtgagagcctcaagtgctcctgttttcacagcccatcttgtgtttccatgctgcgtttgtggggcgttttctctttccatcctcaattctggcgctgattcttttcaggatacattctaaccttggaaagaagatgccaataaaaccagtgtaggggaagggcagccaatgagaggcagcaatggatgttaaatttacaattgtggtttgtctttttggctgtggttctttagataagcatgtgatttctgttcttcatgactaagaattgaatttagactttacagagttactggtttgtaaatctttgagttgtttaaattttaatgttagagttttactgtttgatcagcacattttttttctcttttgtctataggcccgaaatgtttgagacggcgattaaggagagcacctcctctaagagccctcccagtgagtgtattttctgtattttcattgctatagaacacacgctcttaggcatgcattgtgcagctgtggtttacaaacattgtttaaagaatagccattgaggccaggcatggtggttcacgcctgtaatcccagcactttgggaggctgaggtgggtggatcacctgaggtcaggagtttgagaccagcctggccaacacggcaaaaccctgtctctactaaaaatataaaaaattagccaggcgtggtggcaggcgcctataatcccagctactcaggaggctgagacagcagaatcacttgaacccgggaggcggaagttgcagtgagccgagatcgcaccactgcactccagcctggacaacagagcaagactcatctcaaaaagaaaaaagaaaacccattcaaagttgtagttcaggctatttcacaatttttagttatttaataattgggtggctctgtgagtgtgtgatgatctcctaagtacccccaggaagagaaaaacagtgaaaggcagcccttcagggggcatcatgtcttcttgaaatgatctaccatggaaagaaagaaccttgaacaggactgagataaaacagtctcagacagcatgattattagagatgttgaccgtgttttctacaaattctgattttaaatgtatattttcaggaaaaataaattcatcacccaatgttaatactactgcatcaggtgttgaagaccttaacatcattcaggtgacaattccaggtatgatttctctgcttccatcagagtttttgggggtctcttcagggcctcttggactttcccaactagagaggtttgctcagctcatccggggactcggatacattacacgttgcctggtgctcctcccagactcctacagcagttgccttccaaatacagttgctctccaaacagcaacggcaagttttggcacttggcatgagctaaatcctgttaaccacccaaatgtctagtctgttccttaaaaaaagtctatatgagaccgggcacggtggctcacgcctgtaatcccagcactttgggaggctgaggcaggaggatcgcttgaggtcaggaattcaaaaccagcctagccaacgtggtgaaaccctgactctactaaacatacaagaaaaattagccaggcctggttgtgtgtggctgtaatcccagctacttgggaggctgaggcaggagaagtgcttgaacccgggaggtggaggtcgcagtgagccgagatggggccagtgcactccagccttggtgacagagccatactccatctgggaaaaaaaaaaaatctatataaaacagcaggtaaaggtctttataacaagaataaatttgtagcatttttagttaggcattattttaaacaatttcaaatttaattagctcaaagtgctcaaatacttaaatcattaaaaaatggaaaatgcttgaaaacattacacagagctcctaaaaattgggattaaaagtgcatcattgagcagcggcttgtacctgtagtctcggctacttgggaggcttaggcaggaggatcgcttgagcccaagagttcaaggccagtctgggcaacatcgtgagataccatctctttaccataaaaaaaaaaaaagtagtatttaagttttgggttttctctgaactgtttcagatgatgataatgaaagactctcgaaagttgaaaaagctagacagctaagagaacaagtgaatgacctctttagtcggaaatttggtaagttttgcatttgcaaagtacagttgctataagcaaagagatttgttttaataagatcttttcagcagatgatggttagatggttgtaatcctatataaaaggagttaaaatttaaaagtgagttgtttgtgctaaatttatttaataagataccattagtgttacactattgattgtcagtatgaaagttaatgaatttaaggttcaccatctggcagtgtggctcacacttgtaatcccagcattttgggagcccgaggcaggtggatcagttgaggccaggagttcgagaccagcctggccaacatagtgaaaccctgtctctactaaaaaattcaaaaaattagccgggtatggtggtgcacacctgtaatcccagctactcaggaggctgtggcacgagaattgcttgaacctgggaggcagagattgcagtgagctgagatcaagccaccacactccaacctgggtgacagagcaagactctgtctcaaaaaaaaaaaaaaatttaaggttcatatttaaatttgtttgaagtgtacaaagaccttagttaacagcagagacagtctttaaaataaatgttgatcttgtgcttttgacaggctgtttaaggcggtgggttaatctgtgctgttgtgctgtttgtctcactgtccctgtaggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacagtggctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaacctcgcatcagccatttgttagccaggtcactctgttctttgtctgtaaatgagattgatcgttgttcccactgagagtgtcagctccttcccatagagcaggcatgatgattgtactcacctctgacaccattgtgagtgccacattccttcccacgtccttgtcaccgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccacggtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcatggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccgtgagtattttgtgaagtgttttgtttttgttttttcctggggtctgacgtgtgtgcgtgtgagtgtgtatacatgcttaacgtatatcacgttacttcacctatgtcagtaaccaggccaaatacttgttttagccctcagtaaaaacaccaggcacttcctagttgtaaaattattcaagcttcttaacttcctatcctcgatgcacttaatcataaaatggtaataatagcaccgattttgggggagtcgttccagtagatggaaagcatctggaacaggtgtcagcaagctcctgccgacgtgtatgcataaagttttattgaaaccaccatcgtgtccatttgtttatggcagaactgagagatggcagcagcaagtgtgtgcctgcaaaacctaaaatatttactaattggctctgcaagaaaagagtttgcatccccctaacctagaacagtgtctagcctctagtatgtgtttagcctacagtatgtgctcagcgaatacaatctatatttattactgcttttatgactgttataattactgtgcttggatttcgttacaaagtaagtcacaatgtgcctgcttctgttagtatttcagcacagtgcctggcacacatggggctctcaaatattgctgagcgagtgaacaaatgtcctttcaattccttaacgttgatgtcattttcaatagtattttgagccaaacttaattttgcgagtgtgttttgttttcttaactttattattaaaaatgtataaaagtgaggccaggcgtggtggctcacgcctgtaatcccagcagtttgggaggctgaggcaggcggatcagttgaggttgggagttggagaccagcccgtccaacatggtgaaagcctgtctctactaaaaatacaaaaatcagctgggtgtggtggcgcgtgcctgtaatcccagctactcaggaggctgaggcaggagagttgcttgaatcctagaggtggaggttgcagtgagctgagatcgtgccattgcactccagcctgggcaacaagagcaaaactctgtcccaataaataaataaataaaatgttctcttttgttcctgttcttgtgcggtagtgtggtatagagttttatggtaattactgtgaattagtgattctgagggacatatcagaactctgaggtttgtttccttctcatcttgagggaaacagcaaatgtatgttaaaatgcttttccaagggaacaacacatccttacattatttaaaccaatctgcttcattttcagagctggttgatcagagtgagtcaaaaggccccgtgatacaaggtgagcgaggcaggggagggcccggagctactcctgcctgcacagtggcacacatggcgtgcctgcgtgtggctttggctctcagtcacctgccctgaggggactcagttacacagcacacacatgcttctctgtggttttcactcctgggtttgacagctgatcaaaacataaattcaagctgtgggtcctgattgagaactgggggctgcagaccatttgcaccccctatcccagctcaggcctaacatcaggaaccccaggattaatgggtaggatgaaatggcagagcaagagggccgtcactttaacctgactctgccatccatttctaatgtctgccataagtcagtgagcaaaatgttcttcagtagaaatgtacagattgtgctcttaaaaaattccttaaaaaacaagtggaatggcctggtgctgtgtgagtcattgaaagtaatgagactgggcgcggtggctcacgcctgttatcccagcactttggaaggctgagaagggtagatcacttgagatcaggagttcgagaccagcctggccaacatggtgcaaccccgtctctactaagaatacaaaaactagccagacgtggtggcgtgtgccggctactcaggaggctgaggcaggagaaccgcttgagcctgggaggcggaggtcgcagtgagccaagatcgtgccactgcactccagcctgggcaacagaaaggagattctgtctcaaaaaaacaaacatacgaagaaaaacaaaaaaagtaatgaaaagcttttattaaagggagtaaacagaaggataagggagaaagcataactaaggagcttgttttcatggtagagctatgttaagactctgctctttcaaacttcagttgtatatgtgaacttaggaccacatttgaaaaacagaaatttgaaagtacacttggataatcgtgtgctccatctcaagaccgtgagcattgtttcatcatgcacctgtgtttgtacagagtctagagggcttttctcctcttcctcctcctgggttctttacatagtataaagcagctgttgaacaatgtggaaatcagtctctgtgtttctctttagaatcagctgaaccaagccagttggaagttccagccacagaaggtaaaagggtggggtggtcctgcaagtccttaagacttcttctttcttcttcttcttttttttttttttaaagacagagacttgctctgtcacccagggtggagtgaggttgcgcgatctctgcaacctccgcctcccgggctcaagcagttctcctgcctcagcctcccgagtagctgggattacaggcctgcaccaccatgcttggctaatttttgtatttttagtagaaacggggtttcaccatgttggccaggctagtctcagacttctgacctcaagtgatctgccagccttggcctccaaagtgctcggattacaggcgcgagccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtcattgctctctcggctgttttcatggtcctgtctggggaagcttgggggtggctcggcgtaggtgggacgcagaccaaggccgaggctggcgctgggcagagcccgccgggcctcccggggacagcgccacttgcggtgtttctcagaccgctgctgcccatctcctctgagcgggccagggcccccacccttccatctgggccatgccagctgtgtatggagagccgctcacatacgacattgggtgccaaaagcccctgccatcgagagctcatgcagcagtccctcctgcctgagcccacacactgactctgaggctcttctgttctcagcgtggtccctgcctctgccgtgccctatccgcgtgtgccagaaagggaaactgatctcacgattcacctgcctgctaacctgggaggagactgcttctctgatagcatctcacagttcttttaacatgttcttaaaatgtgtcctgccgcgccaccctcagccacacctcccagcacccatcctggagaatcagggccatggcaaggctgccgttggcaaaagcccagctctgccatgaatctccgttcagttactggtttcacactcatttgtgaggtcacagacttgccaaggatattcatgattcaatccattacaacaattctgtgtgtacataacacattttttcctttcttttttttttttttttcctgagacagtcttgctctgttgcccaggctagagcacagtggtgcagtctcagctcactgcatcctccacctcacaggttcaagcaattctcctgcctcagcctcccgagtagctgggattgcaggcacccaccaacacacctgactaatttttgtatttttagtagagacggggtttcagcatgttggccaggctggtctcaaaatcctggcctcaggtatatacacatatttttacacacacacacacacacacacacacacacataaaggatttaagccaggtgctgtggtgtacaactgtagtcccagctactagggaggctgaggtgggaggatcacttgagccactgcagtgattacaccactgcactccagactgggtgacagtgagaccctgtctcttaaaagaaaaaagaagaggccttagctgcctgcattaattaatgaacaggcagtgtatttctgttcttttttttttttttttgaagacggagtctcactctgttgcccaggctggagtgcagtggtgcaatcttggctcactgtaacctccgcctcctgagttcgagattctcctgtctcagccaccccagtaactgtgattatggccacctgccaccatgcccggctaatttttgtatttttagtagagacggggtttccccatgtcggccaagctggtctcgaactcccaacctcaagtgatccacctgcctcggcctcccaaagtgctgggatgacaggtgtgagccaccaaacccagcctcaggcagtgcatttctaaaaggcagatagtgtgattgttcagagggtgaaggggaagttaaacttgtccagtaaaatcttcgttagcccggtattctggattgaaaaagcaaaatatagttcaagtaggtctcttcagtgtatctaataagctcttgtttctgaaacaactgattccttggccgggcgcggtggctcacgcctgtaattccagcactttgggaggccaaggagggcagatcacttgaggtcgggagctcaagaccagcctggtcaacatggtgaaacctcgtctctagtgaaaatacaaaaattagccgactgtggtagtgcacacctgtaatcccagctactcgggaggctgaggtaggagagaattgcttgaacctgggaggcggaggctgcagtgagccaagatcacaccactgcactacagcctgcgtgacagagtgaaactctgtctcaaaaaaacaaaaacctcctgatttttttttttttttttttttttgagatggagtctggctctgtcgcccaggctggagcgcaatggtgcgatctcggctcactgcaacctctgccttctggattcaaacgattctcctgcctcagcctccagagtatctggaactacaggtgcctgccaccacgcccagctaattttttgtatttttagtagagatggggtttcaccatgttagcctggatggtctcgatctcctgacctcgtgatttgcccacctcggcctccgaaagtgttgggattacaggcatgagccgccacacccggccgcctcctgatttcataataattcaagggacaaacataattacttcccaggtaaggcagtagagtgactaagaacaaatccacttctggacagccattatataggggacatttttatcagaaaaacagtaaaagcaaggaaatgtctccctcccaggactgtatgaattaaaccctgcctgctgattgccaagtgacaactcccattccaagcccctggtcctcagtggggaggaaaccaaagctttgtccctggagggaggtcctgcgggaatggccagggacgcatccgctctcaaatgctagagctggcagttgtcatctgctcgtgagaaggtttcgcctttgcctgtccccacccccgtccctcccaggccatcagcgcacatcagagttagcacattacatgatgccttaatcttctaattggtttaagtcagctgacatgtaaagtgaggtctgggagactgttctggaactgtatagatgaggacgttgttgccccagtcttattcagaagcttgaggatgcaacttggacctgggtctgtggtcccctaggacctgaaactcatatagagccagccgccagttccattttgaagtaggttggtctctctctctattttttgagacagagtttcgctcttgttgcccaggctggagtgcaatggcacgatctcagctcaccgcaacctccacctcccagttcaagcgattctcctgcttcagcctcccgagtagctgggattacaggcatgtgccaccacacctggctagttttgtatttttagtagagatggggtttctccatgttggtcaggctggtctggaactcctgacctcaagcaatccgcccgccccagcctcccaaagtgctgggataacaggcatgagcccctgtgcctggctgtagtttggtttttctgagcctcctcctggttcccatttctgtttttttgtttttgtttttgttttttctccaaagaccaaaagttccaccagagaggaagatcgagggaccaggcctttctagtttccacattacactctaagtgctggtcttagtaaattcaaggcacctggtgggcttgaccattcgggggcagataattgttacacaccaaaggggcatcttttggaaagtcactgcccagtaaccacttccatcttctggaaggtcgctgctcatcttcctaaatggaagccccagtttctggacttggatgtgttttgaggatctgatgttctcccaaagtgcctcagtttccctatgatggggaaagaggaaggggacggattttaggaatggaggtgacctggaggccgctgtccctgtccttagacctgcgagtccagggggatgaccgcaaacagggctgtggggcctttctttactctcaaaagcatcacttcccctgcctggagttcagatcctgcctggatccacggtgggaagggagccctggctctctgtacttcacccacggctgcccactcacctggctcacagggcagactggatgcagctttcagccagttgtagaaatcacaggtccctggccgggaacggtgactcaggcctgtaatcccagcactttgggaggccgaggcgggcggatcatgaggtcaggagatcgagaccatcctggctagcacggtgaaaccccgtctctactaaaaatacaaaaaattagccgggcatggtgctgggcgcctatagtcccagctactcgggaggctgaggcagaatggcgtgaacctgggaggccaagctggcagtgagccgagatcgcaccactgcactctagcctgggtgacagagcgagactccgtctcaaaaaaaagaaatcacaggtccctagggtcctagtggcccatcggtgacaaagggcaggtggacctggtgtggctgcaccagaggggccttctcatcctgggaactgggctaaaaaccaagcccagactgaggcccatgcttttgtccccccagccgcctcgaggtccctccttacctgccccctgcacccctaccccatcttaactcttttttttttttccaagatggagtctcgctctgtggcccaggctggagtgcagtggtgcaatctctgccccctgcaacctctgcctaccaggttcaagctattctcctgcctcagcctcccgagtagctgggattacaggtgtccaccaccacacccagctaatttttgtatttttagtagagacgggtttccccatgttggccaggttggtctcgaactcctgacctcaagtgatccacctgccttggcctcccagagttctgggattacaggcgtgcgtgagccactgcgcctggcaccgcaccttaattttgaggaagtgttgggaaagctggctctgacatctcttgtgaggcaagcccagctggggaaggtgtttcctgcctgacttcctccccagaagcaatagcagggcttgctgtggcatccgcttcctgcgggggctcaaggttgctcgttcctcaggctacataaagcagtaaggacccacccaggaggacccctccagaggtgtgagggcgatttggtggacacaggtagggccagcgacagagcagagggcacacctcccagagccccaaatgccacaggctgagaaggtctagctctagctgcatccaaaggacctgttgaactcctgtcccgattgacactaaaactgtcccctcctgtatggtgcccacacccttcaggggaaacccctggataaacagcagtcactgcaggtctccaaaaagacaaggccggaacagggaacctggggtgcatgttcaggaagctgtggcaagtgttgacaccacagccccaagtttctttttctggcccgcggaagatgagcttcagtcccatggaggtgacaaggttgtcctcctgcatgatggggctctgcggtgcctctgcgcctgggtaacccctcaccgagaaagccacgtctacaggtcccacctgtctgcaggtgtgccgcccccaactccaggcctgtgtgacttagcgactgtcccagatctctcctgggaagtggcacaggggcctggccctcagtgagtcccagagggaccgcaccaccactgacttcactgtgctgcttggagctggggagatgtggaaacggccactccagacccagtgactggctggtgcttaggatgtgatttcctcattactgaaatttgtttcaagtgtacagaaatcaccatcggccacgtgcagtggctcacgcctataatcccagcactttgggaggccgaggcgggcggatcacctgaggtcaggagttcgagaccagcctggccaatatggagaaatcctgtctgtactaaaaatacaaaaattagccgggtgtggtagcggaaacctgtaatcccagctactcaggaggctgaggcaggagaattgcttgaacccaggaggttggaggttgcagtgagccgagactgcgccattgcactgcagcctgggcaacggagtgagactttgcctcaaaaaaaaaaaaaaaaaaaatttcaccaaagcccctgggggtggtggtgcactgcggagtttatagccttcctgggtggcagagggcaactgggcccctgagcacagaagtggggctcccgcggggggtggggctggcttggaaggtccccattcctgtggtgcatatttgatgagggcccatgtcgtgcctggagctgggccagaagccacagtgcagtgcagtggggacagacccagcctgtccatgggcttggttactgtcagcctggccgtgtcagggaaggcttccaggccacccacacagctgcaccacacccagacaagctctccaagggacatcatgagactgctccactgtcagagccccgggccggtggtcccagcaacttggggtgcctgctgtccttcatgtgacattttcttcattcaaagctcaatttaaacagcaagaagcctccctgcctcctacctggcaatttccctgccccgcaccttggaggcagcccctgcgcagtttgcatctggtgatggccaacgtttgccaccctagtacttgaccctatttaatcctcacggcagcccatgaagtgggtacagtggtcagtgccatttcacagatgaaaagacagaggctcagggagcttcagccacgtgcacagctcagccgtcagcctgcacgtctccccacggggcctgggtctccgtctgactcccctgagttgaatgcctggggcctggagcccattctcttgtgtccctaggccaagggctggagatcaggtctaggggagaagggaattcccaggggtgtggttcaggtgtgtcctgggacagtctcccaagggcaggtccctgattcccctctgccgaggcctcagggtccacccctgccaagcagagcccagcgcaggtgatttggctgataaaggaagatgggtctctggggaggcagcgagtggcccactttcttctttgctttttttttttgagatggagtctcactcactctgtctcccaggctggaatgcagtggcacgatctcgggtcactgcaacctccgcctcccgggttcaagagagtctcctgcctcggcctcctgagtagctgggattacaagcacctgccaccatgcccagctaatttttgtattttttgtagagatggggttcaccatgttggccaaggctggagtggccagcgtttctgcctattgacacctgcctgccaatacagggtcggtcacacagagccagcgtcataggtaccttggggcccatcctgctgccctaggcaggagggagagctggtcctgtgggctggcccaggagacggtcacccagggctgtccaaggggatggatcctggctgtcactcgctcaagaagaggcagcaggagaggcttaggttagatctgggaaagaactgtcccacccaaaggctgatttgctccagtcctgggaactgctagattccctctcctgataaaatgtcccagagggcactgcgtgggtcccatgccctgatgccaagtcgcctttctcctgatatggtacccactggcctggccttggggatttcctggttaaagaaatagcgagctcagcccatctggggaaagccaagtggcctgagggcggagaaggtgacatttggaaaaaggccaggactggcagctcagacctggaagcccccactccctgccagcctggcttgaggtgagagccttcctcatgagccccctacccccactcattcattcattcattcattcacattgttcaagggcaaggcatgagagtgcaacagttaaatcatgggcctgggtccagactgcccaagttcaatcgcggttctagcctggcgcgatggctcatgcctgtaatcccagcactttgggaggccgaggcaggcagatcacttgaggtcaggagttcgagaccagcttgggcaacatggtgaaaccccatctctacaaaaaatacaaaaattagccgggcgtggtggcacgagcctgtaatcccagctactcgggaggctggcacagaatttcttgaaccagggaggcggaggttacagtgaggcaggattgcgccactgcactccagcctgggtgacacagcaagactctgtctcaaaacaaaaacaaaacaaatcccagttctgcatataccagctgtggcaatctgttttcctctctgttttcccatctgtgaagtggggaaaattgtacccactccctgacagcctccttgtgaggagaagatacggtcataaatagaaagcacctagaatagtgcctgacgtagggcagggcggcggggtgcggggggcccttcctattagcactcgggacgtgggggaattcttggggccctggtattgttctaacacccagtgatggttcaccagctgtctcctttataataattaggtaagagatgtggttttctacatatttcacaatacaaacatttttagaaattctatttccttcccctgaaaaaactctcttatctctttattacttccttccttaactttattttattttattttatttatttattttttgaaaccaagtctactctgttacccagcctggagtgcagtggtgtgatctcggctcactgcaacctctgcctcccaggttcaagcgattcttctgcctcagcctcccaagtagctgggattataggcttgcaatgccatgcctggctaatttttttatttttagtagagacccggtttcaccgtgttggccaagctggtcccgaactcctgacctcagatgacccacccaccttggcctcccaaagtgctggaattacaggcatgagccactgcacctatctttttttttttaattaaaaaaattatttggtaccttgtttcatccatgcattaaattaaatcctggccagacacagtggcttatgcctgtaatcccagcattttgggaggctgaggtgggaggaccacttgatactggagcttgagaccaggccgagcagcatctcgagaccccgtctctacaaaaaaaaaaataataataataataataataaataaaaagtggaaaaaatcctatgtcatcctgaaaaaaggctgtaagcctgcttacagaggtcattacaaggtcaaactcaagttcagagcgcttcctgcctctgctcatccaacaaacttgctggatacctcctgtctgcagagcactttgagggaacataacagggtcttgggaggccacaggaggagagttgaaagatcacagccaggggctcagggtgtccacaggacaagtacccttggccaggcagttacgcaagtgtggaaagaccgctagaggaagggaaggaagtgccgagagcccacaaaattctctgcttacaaccagccccactagaaccttcctctgccctgcctcgacatgcccaggagagcaccgctgcaggtctggcctctgtgctgagcctttttttttttttttttcctgagacagaatctcactctgcttcccaggctggagtgcagtggcaggatctcggctcactgcaacctccacctccctggttcaagtgattctcctgtcttaccctccggagtagctgggattacaggtgtgtgccaccatgcccagctaatttttgtatttttagtggagactgggtttcaccatgttgggccagctggtcttgaactcctgacctcaggtgatccgcccaccgtagcctcccaaagttctgggattagagctatgagccaccatgcctggctaccatgctgggcctttcgaggaggcatttgacagggaagatgagagacaaattgagtgtcagggaaggggtgttgatagaaaaattacaggagagcacacaactttcagcgggtgagcccagtgcctgagctgcgggaccaccctaccaatgaccttgaacttatctgactgcagccttgaactcctgagctcaaggagtccttctgcctcagcctcctcccaagtagctgggactactggcacatgccaccatgcccagctaattattttatttattttattttattttattttattttattttattttgagatggagttttgtccttgttgcccaggctggagtgcaatggtgcaatctcagctcgccgcaacttctgcctcccaggttcaagcgaattctcctgcctcagcctcctgagtagctgggattacaggcatgtgccaccacgcctggctaattttgtatttttagtagagacggggtttcaccatgttggccacgctggtctcgaacccctgacctcaggtgatccacctgcctcggcctcccaaagtactgagattacaggcatgagccaccgcacctggccccacttgtggaactagcatctatctggagaggaggcaaacatcgcccaccacctcccgctctctcctgtcaccactgtccccaccatcattccagaggtcaccctggcttccaacaccacagcctggcttgggcagttttcaagcctcgtataaatgacatcctccagaacatgtgctctgtgcctgccttccttccgtcagtgatgtatctggaagattccactgtgtcgccctgtgggacaggtccttgtcattgctgagtagatcctgttgcaaatgcctatctctcttcatggaaagatccaagatacacagatggaaatcatcataggaagggctggcaaggccgttcacacccagggctggggacctcagggtggaggtgggggacagtaaggaccagaaggagcaggtgccggcgggtgatgtgagctttcttctctatagagaagtgaaggccgggtgcagtggctcactcctgtaatcccagcgctttgggaggtcgaggcgggcagatcacttgaggtcaggagttcgagaccagcctgggcaatttggtgaaaccccatcactataaaaatacaaaaaattagccggacgtggtggtgcacgcctgtaatcccagctatttgggaggctgaggcaggagaattgcttgtacccggaaggtgaaggttgcagtgagccgagatcatgccactgcataccagcctgggggacagaaagagactctgtctcaaaaaaaaaaaaaagaaaaaaagaagtgaagcacttgccaagcaaatctttcagagcaggtggagtggaccctacacctcttggataataaatgcactggataataaaagcaggaacaggccaggtgtggtggcatgtgcctgtagtcccaacctactggggaggccaaggcaggaggactgcttgagcccaggagttggaggctgcagtgagttatgaccaggcaactgcactccagcctgggtgacagatagagaccctgtctttaaaaaaaaaaaaaaaaaaaaaaaaaagggccaggcacagtggctcatgcctgtaatcccaacactttgggaggctgaggcgggtggatctcctgagctcaggagttcaagaccagcctggccaacagggtgataccccttctctactaaaaatacaaaattagccaggcgtggtggcgcacacctataatcccagctacttgggaagctgaggcaggagaatcgcttgaacctggaaggcagaggttgcagtgagccgagattgtgccactgcactccagcctgggcaacaagagcgaaacttcgcttcaaacaaataaattaacgcccagcatgtcttggctttcatctgccagacctcaaccctcacccccaggagatcaggtccggaccacgagctgaccctggactcaggcaagggtgagttggtgcagccctggcctgctgggaggcacaggctgcagcaggctgcctggggctgaggcccaccactcatgaactcatgaccttgaatgagctccaaaagctctgggcctcccaggctctagggggagtgggagagagaggcctcagcctgtccctgggcatgctgccccctcctcacctctttgtcccaaatccccttcctggcaaagctgacagtcttaatatcactctggagaaaactgagtcagccctaaggaacaattcaatgaaccatttgcttacttgaggattggaactcaagtctcactcaaagtctgtgccattttcgtcccagctgtcactggccctcatccacacacacccaaggatgagcatctaacgcttgcatgcacactcccatgcccgcgttcattcactcattcattcattcattcactcattcattgactcattcattcattcactcactcattcattcactcagtgaatgttgcagtcacgatccaaatatttatggcctctgtgtgccaggcactagctggaggggctggggctagagcccctgataacccggtcatgccctagctttcctgggacacacattgtggtaaggggagactaaaaaaattaagtcaggccaggcacggtggctcatgcctgaatcccagcactttgggaggccgaggcgagtgaattacctgaggtcaggagttcaagaccagcctggccaacatggagaaacccagtctctaattaaaaaaaaaaaaaaaattagccaggtgtggtggcacatgcctgtaatcccagctactcaggagactaacgcaagagaattgcttgaacccaggaggcagaggttgcggtgagccgagatcgcgccattgcactccagcctgggaaacaagagcgagactccatctcaaaaaaaaaaaaagtgggaggcagaggcaggaggatcactagaggccagtagtttgagaccatcctgggcaacatagcaggaccctgtctgtacaaaaaaattaaaaaaaatttaaccgggcatggtggcacacacccgtagtcccagctactccagaggctgaggcaggaggatcgctggagcccaggagttggaggctgcagtgaactgtgatcccaccactgcgcttaagcctggataacaaagcaagaccctgtctcaaataacaatagcaataataataaagaaaaattaaatgcaatttgcgatgcatcagtgataagtgctctgcagaaaaaggaggcaggaagaggctgagaaaggtatgaggtttgctatgcaatgtgaagttatcaaggaaggcttctcggaagaggtgacatttgagcagagaaatggaggagagttatggagggaagatggtgaatggggggaacatggtcaagaccaggaatatggtcaaggggggaaagatggtcaaggggacgcagcaaatgcaaaggccctgaggcaggagcagcttgattcacccccaaaacccgtggggcccgtgcaggcgacgggaaggacaagtgtaaacccttttccttgtccctgcaggtgtgtgtgaacatgagtctgcccatgtttacaccctgcaagcctgaagagtccccagaaactgaaagaagaagcaaagccctttctgtaccctccctgccccctgtcccgaccgcgacaaaagcgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgagtagctggtggagggcatcccgtggggggaatacgggagggacagcacggccacccttgcagtcccagggccaaccagctccagtgaggactaacggggcagggtcttgggcacctggtccctggtctttgagcctggatctacccctctgatccctgggaagacagttcccttggacccgccctgggccccagccctttactgtccccgcctgtgtccccagccaggccctcagccttagccaggagtcctctttctgctcccctgccatggccaggcagcccagcgctctctcaggtccgaggcccactcctccaggaagccttccctgactagcccagctatcagagagtggccctcccaagagggaggcctggaaactaaagctctctctctccccagctgcctgtagtgtcagttagagtcttatcctctccagtagggtgacaccatgacaggggccaatagagtcctcccatctgtccccaaggaggctggacaaatgcctgctcagacacacaagtccactgggtcccctaatcccataggaaggccagggaggaactacatttaggaaattgaagcttgtatggaacatttagtcctatgtgccaagacctttctcttttttgttatttttttgttttttgagacagagtcttgatctgttgcccaggccagagtgcagtggcacgatctcagctcactgcaacctccgccttccaggttcaactggttctcctgcctcagcctccagagtagttgggattacaggtgcccaccaccacgcctggctaatttttgtatttttagtagagacagggtttcaccatgttggccagactggtctcaaactcctgacctcaagtgatccacccacctgggcctcccaaagtgctgggattacaggcatgagccaccgtgcctggcctgtttttttgaaatgaggtctggagtgcagtggtgcgatcatagttcactgcagcctcgacctcccaggcccaagtgatcctcctgcctcagccccttgagtagctggggctacaggcgcacaccaccatgcctggctagtttttaaaatttttgtggagatgaggtttcactatgttgtccaggctaatcttgaactcctcggcttaagcaaccctctggtctcagcctcccacagtgctaggattacaagcgtgagctaccgtgcctagtcacttttctccttttctttgtaactttcagttttgaaatttcaaatttacagaaaggctactgggtgtcaaaacggtaccagtcactccaatagtctttcactcaccttcatccacacctctctttctggggatattttctgaattatttgagagtgagttgaagacgtgtttctttacctctaaatactagttgttgggcatttcttaaaatcaaggcattctcttacataatcacaacacacgtgtcaaaatcaggaaattaacatggacaaaacaccattatccacccacagactttactgaggtttccccgattatcctgcttgtcctctgcagtgaaaacttttttcaggtctaggatccagtcaaggatcaatgtcatagcctttaaccttctttaatctggatcagtcttttttctttttctttttctttttttggacacggaatctcactctgtcgccagactggagtgcagtggtgcaatctcggctcattgcaacctctgcctcctgggttcaagagattctcctgcctcagcctcctgagtagctgggaatacaggtgcgcgccaccacgcccagctcgtttttggtagagacagggttttgccattgattctggatcagtcttttttttttttttttatgagatggagtcttactctgtcacccagactggagtgcaatggcacaatctccactcactgcatcctccgcctcccaggttcaagcaattctcgtgcctcagcctcccgagtagctgggattacaggcatgcgccaccatgcccggctactttttgtatttttagtagagacagggtttcaccatgttagccaggctgatctcgaactcctgacgtcaggtgatctgcccgcctcgacctcccaaagtgctgggattacaggcgtgagccaccgtgccagcggattctggatcggtcttaatcagtctttgtcttttgcaactttgatgttttgcagagagcagaccagttaccttgtagaatgtcccttagtttgggtttatcttcattagattcagtttgtgtatccagggcagtggatcttagatgcaattctgtcttctttttaatttttttgagagggagtctcgctctgtcacccaggctggagtgcagtggcacaacctcagctcactgcagcctccgcctcccgggttcaagcaattctcctgtcccagcctcccaagtagctgggatcacaggtgcccatcaccactaccgggtaatttttgtgtttttagtagagacagggtttcaccatattggtcaggctggtcttgaacgcctgacctcaggtgatccacctgccttggcctcccaaagtgctgggattacagacgggagccaacatgcccagccttcctgcccctcccgtcccctcccctctcctcctgtcccctcccttcccctcccctccccacccaagctggagtgcagtggtgcaatcatagctcactaaagccttgacctccaagtctcaagcaattctcctgcctcacctggggccacaggtgtgcggcaccacacccggacaatttttgtgtttttagtagatatgggggtctcgctatgttgcccaggctggtctcaaactcttggactcaagcgatcttcccacctcggtactaaaaagtgctgggattccaggtgtgagccaccgtgcccagcctaggtcctacttttatctccaatttacagatgagtccatttgagagaagctgaccctcttgccctgggtctcaaggctggggcgtggcagcacttgggtccacgtttgtgccctttctgcaatccaggacaactgcaaagatggtcctcaccccaatcctctgggcttcctccagtgggtagtgggatcctgggtgcacacagcaaagcctctttggaggctgaatggggtcccccgactctggctttcccccaggtacatgttcctggtgaaatggcaggacctgtcggagaaggtggtctaccggcgcttcaccgagatctacgagttccatgtgagtgtggggacggaggagggacagggacccaccgttccagctccaccctttgggaaggaccttagcccaggtgatggggaaactgcagaacccagaatcccctcccagaccacagttaaaggggatttatttatttatataaatttttgtgacagggtcttgctctgtcacccagggtcttgctctgtcaccactctgaacacctcatgttctctgattacaggcatgagcccccacggtcggccttttaggtggttttgagaggtatttaggtttgcagtgcaggggcgcaatcatagctcactgcagcctcaacctctggggctcaagcgatcctcctgcctcagcctcctgagtagctgggactataggtgcgcatcaccatgtgtggctaatttttgtattttttataaagatggggatctcactatgttgcccaggctggtcttgaactccagacctcaagtgatcctcctgccttggcctcccaaagctaagggggcattaaaagaaaaaaacatttttccccctgaaacatttaagtagtcttactgaaaacaataaaacacagaaacaccagattctcattttaaagtaaaacagacaggatctcccagaaccttcctagaatggaaccattcttgtcgcttttgaaaaacaaagccaagttctagatcccaaataaatgcacctgctggtgaacattctccttgtggttctcgtccctatgttagttattttcctaaattttacatttgtacctttttaagaatgagttatcagtttttttatatttgcttttcttttgagatggggtcttgctctgtcacccaggctggggtgcagtggtgcaatcacggctcactgcagcctcaacctccagggctgaagcgattctcccatctcagcctcccatgttgagatcacaggtgtgcaccaccacacctggctccttttcctgatttgttttttgtagagatgggatttcgctatgttgcccaggctggtctctaactcctggactcaagtgatcctcccgcctcagcttcccaaattgctaggattacaggtttgagcccctgcacctggtcaacctgagttttaagaggatccctttggcgactggattgaggacagacaagagtggacgggggacacaaggaggccattttcgttatccaggcctggtagtggctagggccaggagggtggggttggtgggaagcagtcagatcccaaagagatttggggattggaagcaaaaggatttgctggtgacttgcacatgggagggagagaggtcagtgcctctgttaatcaaggaatccagattgccaccgaaatttctaggcccgagatatttaggtagtgtctcactctgtcacccaggatggagtgcagtggcgccatctcggctcactgtaacctccgcctcccaggtttaaacgattctcccacctcagcctcctgagtagctgggattacaggcatgtgccaccactcccggctaatttttgtatttttagtagagacggggtttcaccacgttggccaggctggtcttgaactcctgacctcaagtgatccacccacgacagcctcccaaagtgctgggattacaggcgtgagccaccatgctcggccttttaggtggttttgagaggtatttaggtcacttccaatctcgtgcttttccaagtgttgtaaactacaaatattccttcacgtcttcttgtctttttaatgtttagaaaaccttaaaagaaatgttccctattgaggcaggggcgatcaatccagagaacaggatcatcccccacctcccaggtgagcacggggctgagccgcctgtcagggggtcattggcgggggctcacctgccctcccagcacctctcgggcttgacctcatgttctctggtgccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagtgagtgaacttttcaccctgccaggtgggagagggaaggaggggtgggactttctgtgttttgcagatgaggaaaccaaggctcagagagggaaagccaccttcccagagccacacagccagaaagaggaggcaaattccacctccggcccctgtgaccccgccaagcctccaccttaatctttcacacctcagggcactgggggaagcactcggggctggaggttcaaagtcctgggtcctcatcctgacattatggccacctggctatgggacctggagccagtcaccactgctctctgaatgcaggttctccatttctataatgggcagtgaggatcagatgaagcattgggtgtcttgcggagccccccagaaggatgtggggttgatgcctctgctaagtgctgagcatgtctggggtctcctgtacccaggaccctgtgtggaaggcacctgagaggctgagggagctccaggcaggctggggaagtccccttctccactcctctctggtcactgaagctcgaagtggggagcatgaggacaggacgttaccccttgtcaaggcacccaggctgccaagacagagacaagcagcattgctccggccagcacctattgacgcttgaaggtgtcccctggcccaaggaagggcagttatcatcagcccgggaggcgggggaaggatggactctgcagtggggtccgctcctcattgcctgctctctcagggctccagaaggaggaagaggccgggcacagtggctcacacctataatcccagcactttggaaggtcgaggtgggcagatcacctgaagttgggagtttgagaccagcctggccaacatggtgaaaccccatctctaccaaaaatataaaaatttagtcaggcatggtggtgtgcgcttgtaatcccagctacttgggaggccgaggcaggagaatcgcttgaacccgggaggcagaggttgcagtgagctgagactgcgccactgcactccagcctgggtgacagagcgagactctgtctaagaaaaaaaaaagaaaagaagaaagaagatggcctgggagcccgcaagagcattttccaggcttagggcatcctttgggtctgcagaaggctatgcagtgtcctcctcatgtccctcccttgggctgcccgagcagatccgcccgcccccatcacttcctgaagcccttcctcagccagtccagttgctgtcttctctccgcagtgccccttccctttcccgggtccctcttctcttgggaagttcttctgcaggtctacccagtgcctcttcttcctccatgggaagccaagggtctcacccagactgttctctcctcaggacaaaaaagccagagacatacttgatgcccaaagatggcaagagtaccgcgacaggtgagaggacggggggcagccggcggggggggacaccctgaggagacccagagtgttcagggaatggagcaggggctgggagcaggctgggagggctcacagctaccctgctgaagaattgggtctttgggccgggtgcggttgctcatgcctgtaatcccagcagtttgggaggccgaggcaggtggatcacttgaggtcaggagtttgagaccagcctggccaacatggagaaaccctgtctctactaaaaatccaaattagccaggcgtggtgacaggtgcctgtagtcccagccacttgggaggctgaggcaggagaattgcttgaacccggaagacggagtttgcagtgagccgagatcgtgccactgcactccagcctgggcagcagagccagactccatctcaaaaaaaaaaaaaaaaaagaagaattgggtctttggaaggtccctggagactgaaaggagccctttgcaggtggcagtgcagagaccagcgcagacccttgctactggcagccgggggagtgtttgcggctgaatgaatgaacaggttttggagggcagcgtggccttcagaggcgatgcagggctgtggcagtttctaatacttattgcacagtcactgctaataacaataataataataatacctaacattaatggagtgcttactctgtgccagccactattttgtttttgttgttttcagtgacagggtctcgctctgttgcccaggccagagtgaagtggtgtgatcatagctcactacagcctcgacctcctgggctgaagcgatcctcccacctcagcctcccaagtagctgggattacaggtgtgtgccaccatgtccagctaatttttaattttctgatagagatggggtctcactacattgcccaggctggtcttaagctcttggcctcaagcaaccctcctgcctcagcctcccaaagtgctgagattatagacatgagccactgtgcccggctttttcttcttcttataaggacatgaggcctgttgggttagggcccactctactgacctcattttaacttaattacctcttgaaacgtacttaagagtacctttctcttaatatacccacgctgtaaggtactgggtggttaggacttcaacatatgaattttgagaaggcagatgtcagccaataccaaacagcatcagcacctccacggttggatgaagggctggtcagaaatgcacactcaggtcccacagtggacctactgaacaggataggcattttagcaaaatcccaggtattcgggtgcaccttaaagttaggaaaaggtcaggcactgtggctcatgcctgtaatcccagcactttgggaggccgaggcggttgaatcacctgaggtcaggagttcgagaccagcctgaccaatatcgtgaaactccatctctactaaaaatacaaaaattagccaggtgtggtggcaggtgcttgtagtcccagctacttgggaggctgaggcaggtgaattacttgaacctgggaggtggaggttgcaatgagccaagattgcaccactgcactccagtgacagagcgagactccatctcaaaaaaaaaaaaaaaaaaagttgggaaaaggccaggtgcagtggctccacgcctgtaatcccaacactttaagaggctgaggtgggagaatcctttgagcccaggagttcgagaccagcctgggcattgtcccaagaccttgtctttacaaaaaattagccgggtgtggtggcatacgtctgtggtcccagctattcgggaggctgaggcagggagattgcttgagcctaggagtctagggctgtagtgagctgtgatcacgtcactgtactctagcctgggcaacagagcaagactctgtctccaaaaaagaaaataaagttgggaaaggctcactaacttcatcagatgagaacaaagacatgtttgaagtgtgaggccgaagcctggagaacgctatgcgcccaggaaatgcagggcagcagagactcaagatgccagcgcctgttctggaggcccagatgggccctgcaatgcccactcaccctgccctccctcttgccccagacatcaccggccccatcatcctgcagacgtaccgcgccattgccaactacgagaagacctcgggctccgagatggctctgtccacgggggacgtggtggaggtcgtggagaagagcgagagcggtcagacctcccaccttacggggctccttcccctggtgctcaggaacccacagccacaagccccctgccaaggctcaggcagcctggcccctgggaggactccggctctgttaggggccctaaatgtcctccccacactgtgggtcgccttctctcttagtgtgcaccctgtggtggctgtgggcatctgtgcatggcaggccggggcggggcatgtctgcgtgttctgtctggatgggtatgggaccgtctgttcattatgaagtgggctcagagctgtgattctgtgagcatgtgtgcatgcatgcatgtgacctcattgtccagtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcatccttcctcgagcccctggacagtcctgacgagacggaagaccctgagcccaactatgcaggtgccccctgccctccgaggctgtaggggtgtgggagaaaggggcaggcagggctcagggatattgagtgactgctttggagtctgggctggttgctggcttggcagaaaagtcagggctaagatctcatcgtctctggcttgggggccctggcaggttgtgatgcccttggtctggacagggaaccaggaggaggagcagacgactcgggagagtgggaggccagtggtgtctgtggatatgtggccaggttcagtgggaagctgaaggatgagcagaccttaggctcaggaaggagggctgcctggaagtgggggcatcatcactgaccagaaagggaaaactggcagtgccagggctggatggggcctgcattgagcttgaaaaaaactataatagaattggttaccattttattttattatttatttatttattttacttttttgagatagagtctcactcccttgctaaggctggagtgcggtggtgctatctcagctcactgcaacctctgcctcccaggatcaagtgattctccagcctcagcctccccaggtagctgggattacaagcatgcaccaccatgcctggataatttttgtatttttagttgagacggggtttcaccaggttggccagactggtctcgaacttctgacctcaggtgatctgcctgccttggcctcccaaagtgctggaattacagatgtgagccactgtccctggcctggttacccacattttaaaatggagtgatttcacccttttatgtggatttacagctttttttttttttttttgagacaaagtctggctctgtcacccaggctggagtgcagtaatgcaatctcagctcactgcaaccttagcctcctgggttcaagcaattctcctgcctcagccacctgagtagctgggattacaggcatgcaccaccacgccaggctaattttttgtatttttagtagagatggggtttcgccatgttggccaggctggtctcgaactcctgacctcaggtgatccgcccgccttggcctcccaaagtgctaggattacaggtgggaaccacctcgcccagcctgtggctatcgtttaaacactgggaaggcctgcagcccccaggccgacagttagctgcagctgagcagttcccagtgccaggtagacggatgctccacccacctactcatggctgatctcttgtcatagtgaagtgtctggacagaccttcatcgttatgggatctctggtccccagagtgggtggcaatgaatgggagtggacaagctcacctgggtgtagggggcagagggccgaagtccagagtgtacccccagagtgggtgccagcaggagcttgccgagggatctgggatggagcaggagggtggagggaggagacccagaagagggggaactgtgggccctgggtgggtctggagtgcctggaggaagcccaggcgcagagaggagaagatgggatgggtggcgagccccaggctgggccgacctcacactgtgctctgtgcccctgccgtggaccaggtgagccatacgtcgccatcaaggcctacactgctgtggagggggacgaggtgtccctgctcgagggtgaagctgttgaggtaattcacaagctcctggacggctggtgggtcatcaggtaggagggcccctctccatccagagcacccatctgagtcagccccagccaggacggggtgtttagggatctggggtgacttgtccctgggactctgggtaagccactgcccctctctgggcttagtttccatctcagtagcagggagggatgagcccacccttgcctgtcttgtggggatccaatgtccttgtccaagtgggtgcatttctcctttgtgatttagggtctcttcccaaccatctattattattccttctctggcaacatggtgaactgttgtataaataattacattcctagctaggcgcaatggcccaggcctgtaatcccagcactttgggagcccagggcaggacgatcacgtgaggtcaggagttcgagaccaccctggccaacatggcaaaaccctatctctactaaaaacacaaacatgagccgggtgttgtggtgggagcctgtaatcccagctactcgggagtctgagacaagagaatcgcttcaacccgggaggcggaggttacagtgagccaagatcgcgccattgcactccagcctgggcaacgagagcgaaactccgtctcaaaaaaaaaaaaaaaaaaaagattactttctttttatcattcctttatcttttaaagctttcttgcagtcaggtgcagtgtctcatgcctgtaatcccaacactttgggaagctgaggtgggaggatcactcaaggctacaagttcaagaccaacctgggcaatgtagggagacctctgtctctacaaaaaaaattaaaaaatagctggatgtggtagcacacacctgtagccccagctactcaggaggctgaggtgaaaggatcacttgaccccaggagttggaggctgcagtgagctatgactgcaccactgcaccccagcctgggtgatggagcaagaccctgtctcaaaaaaaaaaaaaaaaaaaaaaaagcttccattgcaattcccatctgtttatcctccaaatgaatgcagaaatactaattatcttttttctggttctggggaacacagaattctagcggcttgtggagccatttccctggagccatggggcctcccaggtcctttcctgtgtcttcattttttacgaattttttcattttttgagacaggatcttgctctgactcccaggctggagcacaatcatcgctcactcaagcgatcctcccacctcaggctcccacgtagctgggactacaggtgagcaccaccacatctggctaatgttttttaatttttttgtaggggtggggtctcactatggtgccaagactagtcttaaactcctggcctcaagagttcctcctgccttggccacccaaagcactgggattacaggaatgagcctccatgctgggcctttgctggcgtcttcagagccctaggtcacagggccagcctggcgccctgccgcaagcttatcttaaagctgggaccacaacatgcatacctgcagccgggcccggggccagagggctttgaggcagcatttctcagccttttagacacacactctgttaacccccatcctgtgtctctgataatcttcttgtgatcctcccaccagccaagaattgggttttatgtgaaccttgtattatgcaaagttttcttttgttttttttttcactcccaaatataatattgagaatagaaagaaagtcttttcaacaaatggtgctggaacagatggatttccatactggaaaaaaaaaaaaagagcaaaaaacaaacctagaccccttcctcacactgtacacatatgtttacttcagatggatcacaggtttatcccagagtaaaacctgaaactaaaaaccatttggggctggacagggagctcacgcctgtaatctcagcactttgggaggctgaggcaggtggatcacttgaggtcaggagtttgagaccagccatgaccaacatggtgaaatcctgtctctactaaaaaaatacaaaattaaccaagtgtggtggtgcatgcctgtaatcccagctacttgggaagctgaggcaggagaattgcttgaacttgggaagcagaggttgcaatgagtcgacatcatgccattgcactccagcctaggcaacaagagcaaaactctgtcttggggttgggtgggggaaaagcatttggaagaaagcatagaatttggtggcttggaggtaggcaaaggttcgtaggagacagaaggcagttaacataaaagaaaaattggcaaatataatctgccagtgtcttcttttttctttaattttttcgggaggtagagataggggtcttgctatgttacccaggctgatctccaactcctggcctcaagcgatcctcccacctagatccctcaaagtactgggattacaggcgtgagcgaccgtgccctgcccattcttgccaatgtcttatagcaaatacctgtcccctgcggtgacctggatctgctaacctccacccctgcctagactgtggaaggattgctggaagggtctcagttgcacagaccaggaaactgaggcccacagaggcaggtgtccggttgtttgcaacctctcagcctgtgctaaccccaattgttcagagagagccctgaaaccctctcctctgggcgcccccaggtgactgccccagcctcaagggctgcctctgttgcaggaaagacgacgtcacaggctacttcccgtccatgtacctgcaaaagtcagggcaagacgtgtcccaggcccaacgccagatcaagcggggggcgccgccccgcaggtaagcgggggtccccggggctgggcggggtcgagcggggcgcaccacgggttcgctctgtctaggccatagcttggcagtgccggggcgggggctctcagcctggcaggagaggcaggaccctcacgggggaaaggggctggacgcgcctggccgcggtgtggggctggcacgggggcggaaggaaagcggcgatgcccgggggctttggggatgggcagtccaggggggctccccggagagggggacgacagaccgaaggctggtgaggggcgtggaaaaccgcccaggctctgctgcagggcaagggtccttgtcgtgacgggggcagccgcctcttgtcccgccggggtcgtgcagactaccggccccctactgccccccacttcctcggaccaggggtgcccatctgagtccctgggggcaggggcgccctcgggctttgacgacgccccgtcccgctgggccaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcggtgagtgcagcgggagagggcaggaagggcaagccctaggggcggagtcagcgggagaggcggggccagaggtagggccagagtagcggggcgggaccagagggcggaatcagagggagaggcggggactggaggcgggggcagaggaggagccagcgctagggggcggagcgatccctaagaggcggagtcagagggagaggcacaagcgggaggcgaggccagagcgcggagcaggagttggagaccgcggcggggcgaggccagagagcgctgtgggcggggccagtgtgcggggcggggcgtctgactcggccccgctctctgcccgcagaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgaggctctgcaggaatgcagggagggccgggctccgccccagggttatttctaagttgaggacaggaggttgtgagttctgctggggggaagttgcaagagccgaggtctggttgcatgttgccctggtcttggccaagaacaggtttgcacaaggccaagttcaagaggaactcccggtttcctgctgaccgtttggtcagaaaccacctgcttggactctggcggaagagtcctgaagatgggtgcacacagtgcagcagggcagccctgtctcatggcaggagacaggctgccgtccagggtgtaggagtgacctcatagctgggataaaaaatatattataacttaggttcgggcgcggtggctcacgcctgtaacccagcgctttgggagaccgaggtgggaggatccgttgagctcaggagttcgagaccagcctggccaacatggtgaaaccccatctctaccaaaaatataaaaattagctgggcgtggtggcatgcatccataatcccagctactggggaggctgaggcatgagaatcgcttgaaccggggaggcagatgttgcagtgagccgagacggcgccactggactccagcctggacaacatggtgaaaccccatctgtaccaaaaatataaaaattagctgggcgtggtggcatgcatccacaatcccagctactggggaggctgaggcatgagaatcgcttgaaccggggaggcagatgttgcagtgagccgagacggcgccactgcactccagcctggactacagagcgagactccatctcaaaaaaaaaaaaaaaaaaagtaacttaggtgcagggtgtcctctgttattcactgagaccgtgccccggttatgaggttgtaccagaaagcaagtattcactatgcacactattcaccgctcaccctagcattgaagccagcctgtagcctgaaagcctttgctttgagggcaggtctttccccaaaatgcagacacgaaggtgcaaagtgaagctgccagtcttgcaaaagatgtaacttgtcacgaaggccacgagtggcagggagagctgtcccacatttgcggaagtggctatgtgaggacgggggaggcgggtcccttagagataagagacaatcataaggggagatatcagagaaaatcgtaaggggagcagatggttgtcaagagaataggctgaccatcgaaggactggcagaagctttcagaaaaccactggacggctgggcacagtggcttaggcctgtaatcccagcactttgggaggctgacgcgggtgaatcacttgaggtcaggagttccagaccagcctggccaacatggtgaaaccccatctctacagaaaatataaaaattagccaggcgtggtggcacaagcctagaatcccagctactcgggaggctgaggcaggagaatggcttgaacccaggagtcagaggctgcagtgagtcgagattgttccactgcactccagcctgggtgacagtgcaagactccttctaaaaaaaaaaagaaaaaaaaagaaaaccactgcagctctaaactagttctgcatttttgccgaccctggtttgctggaaaagcccagcaccaaaggctatcatacaaagctgtgggaaattgaatcaccaacctcaccccttctgcttgttcagttgcagttataacccttttattaaatacagtataaaataccacgcctctaatccgagtgctctgggaggccaaggtggaaggattgcttggggcagggagttcaagaccagcctgagccacacggtgagacccgtctagacaaacattttaaaaaattagacaggtgtggtggtgtgcacctgtagtcccaggttgggtgggaggatcgcttgagcccaggagtttgaggctgcagtaagctgtgatcgtgccactgtacttcagcctgggtgacagagcaagaccctgtctcttaaaaaaaaaacaaattaaggccagccacagtgtttcacgcctgtaatcccagcactttgggaggccgaggcaggcggatgacttgaggccaggagttcgagaccagcttggccaacatggtgaaagcttgtctctgctaaaaatacaacaacaacaaaaaaattagccgggtgtggtggtacacgtctgtaatcccaggtactcaggaggctgaggcggaagaatcacttgaacccgggaggcagaggttacagtgagccgagatcacgccaccacactccagcctgggcgacagagcatgactctgtctcaaaaataaataaataaataaataaaaattaaaaaaaatacatacatataaaaaagaagacaaaatacttattttcatgattgtttcatttttttccaagctgaggtcctgaccaaatgtttccccgtggtttttgtatatttctgatccccttaaagtggcccttgcagcgtgctggggaggaggcctctcggtgggtgggtgattgggaagccacgcccacagggaagggagaaaaaaactgaagttgcctgctctaagggctgcacctctgtttagccaacaattttcttgaggccagtcatagtgctgggctcattccatcatctccagttctgagaccaacactgtctggtaggtgttttatggatgaggaaaccaaagctcataaaattaattaagtggtttgcttatgaaataatgcaagaaagcaacagtgctgggaggtggaactgggtttttcttttcttcttctttttttttttgatggagtttcgctcttgtcacctaggtggagtacaatggagcgacctcagctcactgcaacctctgcctcctgggttcaagtgattctcctgcctcagcctcccgagtagctgggattacaggtgcccgccaccctgcccggctaattttttgtatttttagtagagatgaggtttcaccatgttggccaggctggtcttgaactcctgacctcaggtaatccgcctgccttggccttccaaagtggtgggattacaggcatgagccactgcggctggcccaggcttttctttttgattctaaggccttccagatccagtactttatcctgaccctgcagagctcaggatctgtggttcaggcctgtggctcagaggagggaatacggcacacaggtacgtgccaggccaagtgtgagggggtctggcttccagggccctctgcagacccctagtcccagggcctgtgttggaggagagattggctctttcctctgtccatcctgggatgagaagtcggggacttgggatagatgcagtgcaatccctgcccctgaaaattgacaaagacccaccaaatctagcccctactcctaggctgggcccctgcccatctccctggaccacaccactctcaagggctctcgtttgcagacaccccattgccctactaaaaacctctcctggccaggcttggtggctcacgcctgtaatcccagcactttgtgaggctgagttgggtggatcacctgaggtcaggagttccagatcagcctggccaacatggtgaaaccccgtctctactaaaaatacaaaaattagctgggtgtggtggggggcgcctgtaatcccagctgctcgggaggctgaggtaggagaattgcttgaactcgggaggcagaggttacagtgagctgagatcgtgccactgcgctccagcctgggcaaccgagcaagactccgtctcaaaaaaacaaacgaaaaacctttcccagccattcagtcattcccacagtctcaactcagtcctatgagtgacagtgcatgtcagtggccatcatatctcaagccatcctggtcccaacacacattcctggggccttgggaattgattcaaagcagaacagcttcatgaatggtccggccaacaggaggcagcttaggctgagccctactgtcccctccctatcatctgattggtggaccaccagggagccacacacatgacagatgatgagggcagaggctgcatgacagatacctgctgggtctccatgtcaggcacagtggctgcttaggaatgaagcacatgggtcaggtgtcgtggctcacacctgtgatcccagcactttgggaggccaaggcgggtggatcacttgaggtcaggggttcaagatcagcctggccaacatggtgaaaccccgtctctactaaaaaatacaaaaattattcggttgtggtggcgcatgcctgtagtcccagctactcgggaggctgaggcacgagaatcactagaacccgagaggcggaggttgcactgggccaagatcacaccactgcactccagcctgggcgacagagcgacactccatctcaaaaacaaaaagtgaagcacatggactttggagtcacatggaccctggtttgaatcctgacaactcctataatggctgcgtgacctggagcgagccacttagccactctgagcttcagcttcccgtctatgaaagggggctgctctggtcctgctgctcggccacacctctgatatgtggtgtgaacgagtgctcacttccaccaagacctggactcccctccaactcccgttataaaccagcctatctgggattccttctccaaaagagcgctgagcttgccagagccagctgtacctgaagtcaacgacaggaactgcctggagtggggtcatttccctgtgtctaaggataggcacctgggctccaactgggctcctggcctgggggttgctctctccctcctgcaccccctgtcatttttatcaaagtccttttctccattgcttcctgagtgggtcattaggtggagatccacagccttcctccacgctggtcgcgtgaattcccccaatctggaaagtattcacaattttgtgtcactaattccagtgactaatagagattacacacacacacaccttcaaatgacaacctgccaggagaaaaatgctataaagggaaagatatcactttgggaagctgaggcgagtagatcgcttgagcctggaagtttgagaccagcctgggcaacaaagggagaccctgtctctacaaaaaaaaaaaaaaaaaactccacaaaaattagctgggcatggtagcatgcacctgtagtcccagctacttggaaggctgaggtgggaggatcacttaaacccaggaagcagaggttgcagtaagccaaggtcgcaccactgcactccagcctgggtgacagagcgagcccatttccttgtttccaaaaataaaaaagggaaagatattattgggtcaacagggaaaactagagtatgaacagtaaactggataaaataattgcaacaacgttcaatttactgaagttggtaaaggaaacgttattgtgtaagagaatatccctgttctctgaaaatactcactgaagtatttaggggtaaatgatatacgtaactttcccttgaacggtccaggaaaaaaatgcacatccatttatacacatatcatagatactcatagacatttgcttatacacacttaccataggtactgattatagatacacatacacacatatgagtgagagggagaaggagggaagggggtagggagacaaagtgatccaataatgaaacaagggtgaaatgttaacaattgagagtctggctaaagggcatgtgagtattttccatactatttttatttttgcaacttttcttttttttttttttgagacaaagtctcactctgtcacccaggctggagtgcaatggcacaatctcggctcactgcaacctctgtctcctgggttcaagtgattctcctgcctcagcctcctgagtagctgggattacaggcacgtgccaccatacccggcaaatttttgtgtttttagtagagacagggtttcaccatgttacccaggctggtctcgaactcctgacctcaagtgatccacccaccttggcctcccaaagtgctgggattacaggtgtgagccacatgcttggccacaacttttcggtaactattcatagtaaaaaacaaacaaaaaaaaccctctaaaccttaacttactttgtctaacttttatagacaaagtctacgttatttgctctggggctttccattttaaacctgacctttctggctctgggtttttccattttaaacctgacctttctggttccaggtgaaggcagagacagataaaataggattattgtatgtcagtatgttttcaactatttctcctgaaacttggaaacgtattagaccatgtgggataccacgcggacgggaacgggggataaatgtgtgttcatatatactcctccacaaatatacatgtctcaggctgggcgcagtggctcacgcctgtaattccagcactttgggaggccaaggccggcagatcacttgaggtcaggagtttgtgaccagcctggccaacatggtgaaaccctatctttactaaaaatacaaaaatgagccgggcgtggtggtgggcacctgtaaccccggctactcgggaggctgaggcaggggaatcacttgaacccgggaggcagaggctgcagtgagcccagatcgccccattgtactccagcctgggtaacagagtgagactccgtctcaaaaaaagaacccccaaaaccaaaaagcaaatatacacgtctctctccctatttctctgttgattgatttaaacttcaagatgccaactacagtgcctatcagggtggcaggcaggtaatgtgaatgaatgaaacaagccaggcataagaaaagtcaactaccaataatacaataaaactttcttgatttttaatgaatagtgaggcatacaatgtaatataaacaagtatgatactgcagattatatttctgattcaaagtggaaaaaaaactgaaaaaaaaaaagtttaagaactcatttcgtcagctgggcacagtggttcatgcctgtaatcccagcactttgtgaggtcgaggcaggtggatcacctgaggtcaggagttggagaccagcctggccaacatggtgaaacctcatctctactaatacaaaaattagccgggcatggtggcgcacgcctgtagtcccagctgctcgggaggctgaggcaggagaatcgttcgaacccaggagctggaagttgcagtaagccgagatcacgccactgcactccaacctgggcgacagagcaagactccatctcaaaaaagaaaaaaaaattcattttgtcatctcccaatcccttgggactagaagactccagcctttcccaccatagggccctgccaggagttttctctccatcgcgttgcgatgtggagtacagaatcccactgggaatcctttaactgggagcagtattttgttttgctcagtttcataatggagaacagctgttcgcagatgtaggtgctcccgaacatggaaagaatctttgcgcaatggtgcttgtatttcgggtagctaccccagaggtacttgtagaattctggtattcccaccttgtcgtatttcgtcttcaggaccgcgttgcattgcaggtcgataacctccatctggagctcctcgtgcacactgtcgatcttcgtggagaacggggagctgaacagagtcagttcgctttcgtagagtttgaaatcagacagccttttctggaattcggtcttgagttccgcgattttgggaatgtagttcaggccatcgctttcatttctggaaaccaatttcagggtgggaaagtgggccagattattcctcgtcaagtgagtctcccagaggcacagttttgctaggaacacccggatcaggtcatacatctgcgtgacgatttgggagtgtccttggagagagatgttcaaagtgttcagatgcatcgtcatgtcaaccaagaaggccaggtctcggatccaatctatggagctcagttgaggcaggggtttccctctggatgacatgaaggagtcgatttcttccaaggattcgaaaaatctctttagcacgagcccgcgactgagccacttaatctccgtgtagtacaggaggctaccatactggctgtccagctcatagagcaaggttgtgaactcgctgtggttcagtccccgggagcatatccagttcacggacttcactaccacgtccatgacgtggtccatcttcaacttctgagcacagagtgatttcggatgaattatacaacagatggacttcagttccgcacccttgcagaacgtcgccaccctggacttcagttttgtaacaagcccgttattggcatccaccatcgctggggtgccagtggaggccacgcttactaatttcgaccagtcgatacagaactttttcaggctcttctcaacacgcgaaaagatctcgtttccagattttgtacccgtcgtgggcaccgtatccagaagttcttcggacacatcgaaattctcatcgacaccacggatgaatatggccaactgggtggtattatttatatcggtgatctcatcgattgcgatagaatatgccacaaaagacctgattttttcacgtaacttctcccataagttcccagctaggtcctctacaggctgcacgggggatttctgggttggacttgggtttgcaaacacttgtttttgctcgggacactcggtgtctgacgagcctaagagatacttcctgagcccttttttcagctcgtgaagcttctcgtcacgcattctttccgtatactggtcataatgcttgctgtgattggtttgatagtggcgtcttaggttatattctttggacacagacatgctttgtttgcatatgagacatgttggaatattctgtacttccacgaagaaaaatgctctctcccacttttcttgaaacacacggccctcctggtctatcttgcattttcccacttttgacagagacagggagacaaagatatttcacttttctcttatcactactatgaggaaaacaacagcaaatgcttgatgacgcacgagagggaggaagcggggcggggcagggcgtggttaacaggagggtgacccaccctgcagagggacggctgaccatcaactccagcaaaccgctgccaggacgccagctgtggccagatcttcaagttttctaaagaaaacctgaagactgaatttttgttgtcgttgttgttgagacggagttttgctctgtcacccaggctgcagtgcagtggcgcaatctcggctcactgcaacttctgcctcctgggttcaagcgattcttctgcctcagcctcctgagtagctgttatgacaggtgcctgccaccacgcccagctaatttttgtatttttagtagagatgagatttcaccatgttgtccaggctggtctcgaactcctgacctcaggtgatccgcccacctcagcctcccaaagtgctgggattacaggcatgagccactgcacccagccagatcttcaggttttctaaagaaaacctgaagattgacttttatgaaagagtgcctggtttgtggtgataatggctcactgcagcctggaactccctgggctcaggtgatcctcccacttcagctcccagttgctgggactacaggcatgcaccacactgagctatcttttctttctttctttcttttctttttttctttttctttttttttttttctttttttgtagagctggagtcttaccttgttgcctaggctggtctgaaaccccaggctcaagcgatccacccgccttggcctcccaaagtgctgggattataggagccactgtgccaggcctcatccttattttcaaaagtacatgagccaaacaaaagacacctttgatgaggttcagcatgtagctgtgcttgttatgtccagtttaaacaggaattatttgataatatgtttgcattttctttttagagacagggtcttgttctgtcacccaggctggagtgtagtattgcaattatggttctctgctgtctcaaactcctgggtttaagtgatcctcctgctttagcctgccaagtagctggggctacaggtgtgagccactgtgtccagctaatttttaaattttttgtagagatggggtcttgctatgttgcccaggctggtctcaaactcctggcctcaagcaatcctcttgccttggcctccaaaagtcctgggattatacgtgtgagcattttaatatattttctcatttgattcccaagaaaactttgtaataacagagatgggaatgagcacagaaaggcatatgatttttacctactgtgagtctcaaatgacaagggtgacggccacagatccacacaaaactcattcatataagtgtgttcgagtgtacaggggctagtgttttagatttaaagaacctggccacgctgcaggtaatcaaggtatttccagagtacacacacataaaagtgcaccttaagaaaatgtaggccatgtacagcggctcatgcctatagtcccagcactttgggaggctgaggcaggaggatcgcttgaagccagaagctcaaggccagcctgggaaacatagtgagaccctgtctctacaaaaaaaaaaaaaaaattatctgggcatggcagtgctgtcccagctactcgggaggtgaaggtgggagaatcacctgagggcaggagttccaggctgcagtgagctatgatcatgccactgcactccagcctgggtgacagagtgagaccttgtctctaaaaaaccccaataataatacaataaataaataaagatattataaaagatcaaaaaatcatttagcaatcagatgcgtttgggaataaaaatggagcattttaataggatactttggttttcttttcttttctttttttttttttttttgagacagagtcttgctctgtcaccaaactggagtgcagtggcacgatctcggctcactgcaacccccgactccctggttcaagtgattttcctgcctcagcctcccgagtagctgggattataggcacgcgccaccatgcccggctaatttttgtatttctagtagagacggagtttcaccacgttgtacagaagggtctccatctcctgacctcatgatccgcccgcctcggcctcccaaagtgctgggattacaggtgtgagtcaccgcgcccagcctactttggttttcaaatgttacattaggaggttccctggtgactcatgctcgtgagaacacctctccgtattctacttgacaggatactgactcacttgcaagggctccggggaagacattaagaatatttaacagggtgggggcgggtagggggagggagagcatcaggaagaatagctaatgcatgctgggcttaacacctaggtgatgggttgataggtgcagcaaatcaccatggcacacatttacctatgtaacaaacctgcacatcctgaacatggaccctagaacttaaaataaaagttgaaggggaaaaaaaagagaatatttcagaagcagagtgcctgggcattgctcaatcagaacagatgctgagccaggtgcagtggcttacatctgtaatcccagcagtttgggagaccaaggagggtggatcacttgaggtcacgagtttgagaccagcctggccaacatggctaaaccctgtctctactaaaaaatacaaaaagtagctggatgtggcggcacgcacctgtaatcccagctaatcggaaggctgaggcagagaatcgcttgaacccgggaggcggaggttgcagtgagccgagatcttgccactgcactccagcctgggtgagagagcgagactctgtctcaaaaaaaaaaaagaacagatgctagtctcagcactggaagggttctaggggcctctgctgtgccaggtggaactccttttgcttcagcactgtagggaggtcaagccacggtcggagggtactagggtgggactgcatggccaggcaggcactatttaccaacacagaggagatcggtactgtgatcctgagtgcagctgtgcgggtggcctcaggggagcccccaccacaaagcacacttgaatagtgtgccacatcagccatgcgtggtggctcatgcccgtaatcccagcactttgaaaggtggaggcgggcggatcccttgaggtcagaagttcgagaccagcctggccaacatggcaaaaccccatctctactaaaaatacaaaaattagccaggcgtggtggcacacgcctatagtcccagctactcgggaggctgaggcaggagaatcacttgaacctgggaggcggaggttgtgtggtgagccgagattgtgctgcactctagcctgggtgacagagcgagactctgtctccaaaaaaaaaaaaaaagagtgcgccacatcacacgtcacactcatggtgtgatatagatcactctccttcagactggttaatcaaactcaagtaacagagttatctaactttatcacatgcaggaaaaataaagcatgcatcgaaggctgcatacttgggtcccaggctcacggaagcaaaaaccccgtggtgagcgcccaccaagacacttcccatggcccaacattgccggaacgttcttctcacctgtagaatactcaccattactgagctcaagccctggaagcggcctgaagagaaagacacattgataaatgcgacaagctcacgtttcctcttttgcccacttagttttatttttttttaatttttacttatttatttttttacagaagaatatttatttatttgtttgttttgtttttgttttttttgagacaagagtctcgctgcgtcacccaggctggagtgcagtggcgcgatctcggcttagcgcaacctccgcctcctgggttcaagccattctcctgcctcagccgcctgagtagctgggattacaggtgcccgccaccacgcccagctaattttttgtatttttagtttcaccatgttggccaggctactcttgaactcctgacatcaggagatctacctaccttggcctcccaaagtgctgggattacaggcatgagccactgcgttgagccttttgtttttgttttttttgagacggagtctcactccatcacccaggctggagtgcagtggtgtcatctgggctcactgcaacctccgcattccaggttcaagtgattctcctgagtagctgggattacaggcacgtaccactacacccagctaatgtttatttttagtagagatggagtttcaccatgttggccaggctggtctcaaactcctgacctcaaatgatccacctgcctcagcctcctaaaatgctgggattacaggcctgagccaccatgcccagcctatttatttatgttttgagatggaggctcattctgctgcccaggctggagtgcagtggtgccatctcaggtcactgcaacctccacctcccaggtcaagtgattctcacgcctcagcctcctgagtagctggtattagaggcgcacgccaccacacccgactaatgtttgtattttcagtagcaacggggtttcaccatgttggccaggcttgcctcatactcctgacctcaggcgatctggcccgcctcagcctcccaaagtgctgggattacaggcgtgagccaccgtgcctggccccacttagttttattggacaaatttttgcagagtgttaactctacgctaggtgctgggtgagctaaaactgggacgggctgcccatgatcaccgaggaacagggacatggacacatctcaaggaagcagaagatgatgaagtcagtgtgagaggcagcatggcccagcggtcagctgcgggaacaaacccccagcccaagtcatgggacagacattcctgggcagccacatgcccacctcgggcaagtcagagtctccagattccttctcttgactcacttacctgatgactgtgaatttgataaactcagctgcctccaagatcctcctcatggaactgatttccagatagccggggtccttgaataccacccccggggcatgccatcaatcaccacacagccagggttgaatgtgatcttcctgtagggaactttcacagggaaatccacgccaattgcttcacctgtgacgggatgagcagcataaaaccagctgagtttggctgggcacggtggctcacacctgtaatcccagccctctgggagactgaggcgggtgaatcacttgaggccaggagttcgagaccagcctggctaacatggtgaaaccctgtctctactaaaaatacaaaaattagctgggcgtggtggcgcatgcctgtaatcccagccacatgggagggacccaggaggcagaagttgcagtgagccgagatcgccccactgcactccagcctgagagacagagcgagaccctgcctcaaaacaaaacaacacaaaacaaaacaacaaattaaaaaaacaacaacacaaataaaactagctgagtttgttccttacatttcctaaaccaggatttatctttaatgtcaggatttagaagcatcaaatgacaatacttatgatcagtcattttattttccagtgctactatgatgtgtgaatataattttaaaagtttggaattagcatgggtagtaggcaaactcagtttctccatccattacacagggttatcatggcgcctacctgaaaggttttatgtaaggattaaatgatcaaacacatgttgagcacaaaaaataatacacaaggtaagcactcagtaaaacaaagatagctattattattattattgtaattagtcaatgataccatgcaaaagctcttctgtaaaaagacatattgactaatttttatcatagctctttcacaaaaagatcaatttcttttttttttttttttttttgagacagggtcttgctctgtcgcccaggctggagtgcaatagcgcgatctaagctcactgcaacctctgcctcccagttacaaccaattctcgtgcctcagcctcctgagtagctgggattacaggtgtgcgccaccacacccggctaattttttgtatttttagtagagatgggattttgccatgttggccaggctggacttgaactcctggcctcaagtgatccacccaccttggcctcccaaagtgctgggattaaaagtgtgaaccactgcgcccagccaagatcaaattcttataagataaagttttgttttttttccttttgtagacctggggtgtcactttgctgcccaggctggtctcaaacgcctgggctcaagtgattctctagccttagcctcctaaagtgctaggattacaggtatgagccaatgcacctggccaagtattcttttaaaaagaagtattttaggtatatgaattctggatataaaaagatataaaaacttaccaaattttcggctaaagaggtcattaacttgttctcttagctgtttaatcttttcaatgcttgataatctttccttctcattatctaaaaataattaaacaaataaacaaaccaaggttattaatgtattttctcccaagaaagctgttgggagaaatgcctgttagcacccgagaaagtgctttacctggattgttattcagtctacttttagcaataattaagcatcttggaaatttggaaatggaagccattacagacaatagagaattttccaaattataaccctatataaacatactacatactacttttaaggaatattttcaatatcatacaagacaaggatgtttagggccaggcgcggtggctcacgcctgtaatcccagcactttgggaggccgaggcaggtggatcacgaggtcaggagatggagaccatcctggctaacatggtgaaaccccgtttccactaaaaatacaaaaatttagctgggcatggtggcaggcgcctgtagtcccagctactcgggaggctgaggcaggagaatggtgtgaacccaggagacggagcttgcagtgagccgagatcgcaccactgcactccagcctgggtgacagagcaagactccgtctcaaaaaaaaaaaaaaaaaaaagacaaggatgtttactttcaccaccacttttcggccttaaaatagaaatctcagccaatgaaatatgacaagtaaaaggaataagaggtactaggattagaaggtaaggtatatttttattttctttcctttttttcctctctttttttttttgtttgttttgttttgttttgttttgaggctgagttttgctcttgtcacccaggctggagtacaatggtacaatcttggctcactgcaaactcctgggttcaagcaattcactgcacccctcctgggttcaagcaattctcctgcctcagcctcccaagtagctgggattacaggcacccaccaccacacccagctgatttttgtatttttagtaaagatggggtttcaccatgttggccaggctggtctcgaactcctgacctcaggtgatccacctgcctcagcctcccaaagtgctgggattacaggtgtgagccaccgcacccggtctgtttttcttttctttttgttttttagagacagagtctcactgtgctgtgcaggctggtctcaaactcctgggctcaagtgatcctcctgcctcagcttcccaaagtgctgagattacaggcacatgccaccatgcctggtcctttttttttgtttttattttttagatatttttcaacactttaaaactttatttacttttgaataactaaagcaatcacatggctcaacattcaagaggagtaatatacagaaacatctcaaacgtctctctcctatccctatctcagcggtcagtttccttccctggaggaactatgtaattagattctcttgtatctttccagatatattttacatacaaatattcagaaaagaagattattattattattattatttatttttttgagacagagtctcgctctgtcgcccaggctggagtgcagtggagtgatctccgttcactgcaagctccgcctcccaggttcacgccattcttcagcctcagcctcccgagtagctgggactacaggtgctcgccaccacacccggctaattttttttgtatttttagtagagacagggtttcaccgtgttatccaggatggtctcgatctcctgacctcgtgatctgcccgtcttagcctcccaaagtgctgggattacaggcgtaagccaccgtgcccggccagaagattgttaatgatgagcaacaaaacatttcacctctgtggccaattccaattcaaccatagctggtgctccatgctgcctgctctgagatgcattttccaggtaatgcccgggcttgtccaggagaagcaaaatatccgattaataatgtctgatgtgagcaagatgctcgttgtgtagcaacttgcagaatattttatattcccaaaatgtcatttcttagctatcagggtgaactaagtgaaaaatgacaggtccaagagaccaccctatgtcaaaaaataattaagacaaaaggaaaaatgtaacattagtccatacctggaacagtcacttgaacgatgttaagatcttcaacacctgctgcagaatttgtaacactggatgaatttgtgtttccttaaaacagaagttgaagtttagaatttaccaagaataagaccaattctcctttaaatatgtctaagtgctgctttgatcagaagcccagactgaattttttttttctttttttttttttgagacaggttcttactctgtcattcaggctggagtgcagtggtgtgatcctagctcactgcatcctcgacctcccatggtcaagtgatcctcccacctcagccttttgagtagctgggaccacagacatgcaccatcatgcttggctaattttttttttttttttttgagactgagtctatcacccaggctggagtgcagtggtgtgatctcggctcactgcaacctttgcctcccaggttcaagtgattctcgtgcctcagcctcctgagtagctgggattacagacacccaccaccatgcccagttaataattgtattttttttttagtagagacggagtttcaccatgttggtcatgctggttgagaactcctgacctcaagtgattcacctacctgggcctcccaaagtgctgggattacaggcttgagccaccacgcccggctctaatttttgtatttttagtagagacagagtttcgccatgttggccaggctggtcttgaactcctggcctcaagggattcacccacctgggtctcccaaagtgctgggattacaggtgtgagccacccaccacgccagccttaaatcacactttcaacttcacttcctttagatacttgcacttcaactgagttcaccggctgcaggcctgcggagttacctttgatatttatctgtccactccagtagcaaaggggctatgtctgagtgaatcgtccttttctttccattctccccccttatgtaccctcaacccttcattctttcctcacgtgaacacagcacagttgaggcccagttgtgggtcagtgctaacgtgcaagacttaaaaaaaaatttttttttaatttttatttttagagatggagtcttgctctgttgaccatgctggaatgcaggggcataatcacagctcactgcagcctcaaaatcctgggctcaagcgatcctcccacctcagcctcccaagtagctgagactacagatgcatgccaccatccatggctgatatttttgttagtttgtttcgaggcaggatctcactcccatcacccaggctggagtattgtggcacaattatggctcactgcagcctcgacttccctgggctcaggtgattggcccacctcagtctcccaaatagctgggactacaggtgtgtgccaccatgccctgctaactttttgtatttttagtagagacagggtttcactatgcccaatttggtctcaaacacctgggatcaagtgatctgcccacctcagcctcccaaaatgctgggattacaggcgtgaaccactgtgccttgcctaactttttcttaatgtttactttttgcagagatagtctcactatgttgcccagtctgatctagaactccagggttcaaatgatcttcttgccttggcctcacaaagtgctgggaatacaagcatgcaccatcatgcctagttattatttttcttttctttctaatttttttttgcacagctaattatgttgtctacaacacctcaaagcactgggccctaatgggaatggctgctctattatatatacacattatactacatcagagatttcaatctcttccccacaattttttttttttttagatggaatctcgctctgtcacccaggctggagtacagtggtgagatctcagctcactgcaacctccgcctctcaggttcaagcgatcctcctgtctcagcctcccaagtagctggaaatacagacatgcaccaccacgcctggctaattttgtatttttagtagagacagggtttcgccatgtttcccaggctggtctcaaactcctgggctcaagcaatacacctgccttggcctcccaaggtgctgggattacaggcttgagccactgagctctgccatcctccctgcaattaatcctgttagaaagaatgaaaaccatacttggcaatggggctttgggcaactaaccttcgattttcacctcggcttcagggtcctcatttggttcttctgaagggaccagcggagtggaatcttgaaaaaaaaatgtctaaaatgacattcattattaagtattctcctcatattccaacacattaatgctcctataccaaaaaagtagcttatcctggcattttaaatatatttcatatataaataatataaacataattttaattttataagcaataataataggataataaacagtaactgggccgggcacggtggctcgcacctgtaatcccagcacttttgggaggccgaggtgggcgcatcacttgaggtcaggagttgaagaccagcctgggcaacatggtgaaaccccaactctattaaaaatacaaaaattatccaggcgtggtggcgcacacctctaatcccagctactcaggaggctgaggaaggagaattgcttcagcccgggaggtggaggctgcagtgagccaaggtcgcgacacactgcactccagcctgggtgacagggtgagattctgtctcaaaaaaaaaaaaaaaacagaatcattttggtagtccatgtgtcactatctctctaaggcagatattacaactaaaagtaagatcacattgcctgtaaatggcaaagatgtcccacgccactaggtttggaaaggaaatctttattattattattattattatcattattgagacagtctcactctgtcacccaggctggagtggaatggtgcgatttcggctcactgcagcctccgcctcctagtttcaagcaatcctcgtgcctcagcctcccgagtagctgggattacaggtgcctgccaccacgcctggctaatttttgtatttttagtagagacagggtatcaccatgttggccgggctggtcttgaactcctgacctcaggtgatctgcccacctcagcctcccaaagtgctgagattacaggcataagccaccatgcctggcccttttttaaaattattaattttatcttggacatacacaaaccaccgtaggaatttaggctttattcatatgatgctcaagatttatatatgaatggagggaagtattatcaaattttacttctaatgcaaggatttcctaaaatactattcgactctgtccaaaagaattatgtcatgccatccaaaagacaaagcaagaaacagcaccactgcaaagttaacttccatattcgggtgctttaagtagaatcactcacagatcagaagcacaagaagtgatagagcccttcatgttatatcttagggcaagagctcaactattcatagttttctgagaagacaggcatgccagaaagtcaccttccttattttccaacttacatgtataaaagagtatgttctctgtaaaatactataaactttcaggtgggcatggtggcttacgcctgtaatccccgcactatgggaggcagaggcggacggatcacttgaggtcaggagttcgagaccagcctggacaacatggtgaaatcccgtctctactaaaaatacaaaaattagccgggcgtggtggcacgcgcctgtaatcgcagctactcaggaggctgaggcacatgaatcgcttgaacccaggaggcagaggttgtagtgagccgagattgcgccactgcactccagcctgggtgacagagcgagactctgtctcaaaaaagaaaaaaaaagtatgttctttgtaaaatactataaacttctataaacttttcttaaaagagagagaaaaaatgctgcatttttctaaccttccattggtaattccatttctattacttcattgcttgtggaagaagggtggcttcctgaaagaaaaataaataatatataacaaaggagaaatacaaaaatgtaaaaagaaatcactgaatacaatgcaaacaagtcaatacccacacaggaatacacctgaaatacttctaccccttgaaataaaactggctgcgcgtggtagctcacgcctgtaatctcagcactctgggaggtggaggcgggcagatcacctgaggtcaggagttcgagaccagcctggccaacatggtgagaccccttctctacaaaaaaatacaaaaatcaaccgggtgtggtggcacacgcctgtaatctcagctattcttgaggccgagccaggagaatcacttgaacctgggaggtgaaggttgcagtgagccatgatcacgccactgcattccagcctgggcgacagagcgagactctgtctaaaaaaaaacaaacaaaaaaaacataaaccaattaatttctctgagtttctcacattctggattttattgactacatccttgtggtgatgttttcatatgtgcctgtattccatgcatctcctaaaaactgctggttagatctaaatgctggatcagacttaggtctgattgttttgttttgttttgttgttgttttgagagagagtctcactccagcacccaggctggagtgcagtggtatgatcacagctcgctgcagccttgacctcccagactcaagcgatcttcccacctcagcctcccaagtagctggggctacaggtgtgtgccaccatgcccggctactttttgtattttttgtagagacggtgtctcaccatgttgcccaggctggttttgaactcctgggctcaagtcatacacctgccttggcctcccaaagtgctgggattacaggtatgaggcactacacctggccaggtttgattttttttttttttggaagaatccttgacaaaggtggtgtggtgtacttcctactggataccgtcagaccagtgaccagtcagttcaggaactgtcagtcaggtctgcccatgataaagtccccatcagacttttataaaatggttttaatgaccactgacaattattgccaagatgcactgcttcattaggtggtgcaaaatcatgacagtcgtgacaatttatgacttctttttaaaagccttatgggtcaggtgtggcggctcatgcctgtaatcccagcattttgggaggccaaggtgagtggatcacctgaggtcaggagttcgagaccagcctggccaacatggcgaaaccccgtctctactaataatacaaaaaattagccaggcgtggtggcacacgcctgtaatcccagctccttgggaggctgaggcacaagaatcatttgaacccaggaggcagagtttgcagtaagtggaaatagtgccactgaactccagcttgggcaacagagtgagattctgtctcaaaaaaaaaaaagagtatgtggatttagcccaggcatggtggctcacgcctataatctcagcacttctggaggccaaggctggaggactacttaagcccaggagttagagaccagcttgggcaacaaggtgagacctcatctctgtaaaaaaacaaacaaaagagtacatggatttaggctaaatagaatctattttataactgtaggattatttactctaaatggcagcatgcttgatcctaggtaaacacacatgggtgctcgccagtttttcagacaggtagtaattaaaatcttccatcccaaataacttttggggaagaaaattattatcaaacagtattaccttgcatattatattgatagtaattaggatcttctgattctttcttgactgagacagcttctgctttcagtgaaatgccttggaatgtaatggaaatgataaaattgtatgttaggttaagtttgccaacaaagaaatacgactagctaatataagttgattaatacagcaatgttacaatcagcaaaagaacttgtagctcactcactatgaacaaatttgacctcttgatacaaaaatagaaatactataaattaaaataatatacatatagaaaacatacatttgtgtatttatgtatgtttatataaaaataatatcaattgtaaaatcaatagaaaaggaaagaaggaaggaggggaccgggcacggtgactcacgcctccaataccagtactttgggaggctgaggcgggcagatcacttgaggtcaggagtttgagaccaacctggctaacatggtgaaaccctgtctctactaaaactacaaaaattagctgggagtggtggcggacgcctgtagccagccacatgggaggctgaggcaggagaattgcttgaacccaggaggtggaggttgcagtgagctgagatcgagccactgcactccagctggttgacaaagcgagactccatctcaaaaaaaaaaaaaaaaaaaaaagaaggaaggagaagaggatgaaggaaggcatcgtgaagatgggagagcttagttctgatcctagtcctagttttgggagattttccccttcagggtggctgaatatccacgtgcatttacatgaaatgctgtgaagattcttctgtcatgaagcctgaactgacatatataaccatttttttttttttgagacagagtctcactctgttgcccaggctggagtgcagtggcatgatctcggctcactgcaacatccacctcccaggttcaagtgaccctcctgcctcagcctcccaagtggcccacgccaccatgcctggctaatttttgtattttcagtaaagacggggtttcaccatgtaggccgggctggtctcaaactcctgacctccggtgatccacccacccaccttggtctctcatagtgctgggattacaggcataagccaccgtgcccggctaggcacttataatcttaacttactcactataatggaatggatttcaaaacctggagaagctatatcagtacaacctaacgcctttatcagagaagggtgcggttggctgcaaaaattagctcaagacctctcccatcccaggatgtacatccctttgcaatgtgactatcccatgcttcttttctagaagtaaagtctgtttctatgccattttgttattattttttgagacagagtcttgctctgttgcccagtggagtgcagtggcatgatcatggctcactgcaacctctgtctcctgggctcaagtgatcctcctgtctcagcctcctgagtagctgactataggcatgcatcaccacgcctgcctaatttttgtattttttgtagacatgaggtttcaccatgttactcaggctggtctcgaactcctggactcaagcaatttgcctgccttggcctcccaaaatgttgggattacagctgtaaaccacggcgccaggccattctctgccctttaaatctggccctggctgtgtgacttgctttggtcaatgcgacatcagccgatgggatgcaaagagaggcttgagaagagcttgatcatctgtgcctgctgcttctagaacttcatcaccatgggagccagcctagggtgcctccaaagggtatgaggccacaaggagagagaccctgatgtcccagccggggcctcagacacacagccatccggcccttgctgagccagtccagccaacacacagaaatgtaggaaagactaaatattccattccattccattggagcccttccccttctctttccagcccaggttggagtgcaatggcatgatcttggctcactgcagcctccacctcccaggttcaagtgattctcctgcctcagcctcccaagtagctgggactacagatgcgcaccactacggctggctaatttttgtatgtttagtggagacaaggtttcaccacgttggccaggctggtctccaactcctgacctcaggtgatccgcctgccttggcttcccaaagtgctgggattgcaggcgtgagccaccacacccagcctcatttcaggggtacttttaaatacagcaatagatgactgatactaaaatgtacatgtaatttaaccatgaatgtttgtaatagcaaaacaaaaaaactgtggcatagcttggggttcattgtttaacataatttataagttctgaggggtcgtctgaaaacctttaacagctctgttggtataaggacagtgaagctaaacatttaaaaatctgattttcagctggggacagtggctcagacctgtaatcccagcactttgggaggctaaggtaggcagatcatttaaggtcaggagttcgagactagcctgaacaacagggtgaaaccccgtctctattaaaaatacaaaaaccagccaggtgtggtggtgggcacctgtaatcccagctactcggaaggctgaagcaggagaatcacttgaacccggggggcggaagttgcagtgagctgagatcacaccactgtactccagtctgggcaacagtgagactgtctcaagaaaagaaaaaaaaattggcctggtgcggtggctcatgtctgtaatcctagcactttgggaggccgaggagggtggattacctgagttcaggagtttgagaccagcctgggcaacacggtgaaaccctgtctctactaaaatacaaaaaaattagccaggtgtgacggcgtgcacctatgattccagctactcaggaggctgagacaggagaatcacttgaacctgggaggcagaggttgcagtgagctgaggtcgtgccactgcactccagcctggcaagacaagaaagaaagaaaggaaggaaggaaggagagaaagaaagaaagaaggaaagaaagaaagaaggaaagaaagaaagaaagaaagaaagaaagaaagaaagaaagaaagaaagaaagaaagagaaaataaattaaaaccagggagatggtttgtttttgtagcaaatgctacacacatatcacaagaaataaggaccaattgaggaccagctctcaggagcctgctggcagctggtagcaatccatatcgctttataaagtctacagtaggaagttttgtgaataaggaagcatatttttgttcaaatgaaaccacatctccaacaaaggcacgtgagaaccacagatctagcccaacagctggtgaggaaggaaactcagcccctggggacactgatcacttctcactctcacccccttcatcttcccaggttctttcttttttctttttttcttttctttttgagacagtcttgctctgtcacccaggctggagtgcagtggtgccatcttggctcactgcaacctccgcctcctgggttcaagcaactgtcctgcctcagcctcctgagtagctgggattacaggcatgcaccaccacgcccagctcatttttgtattttcagtagacatggggtttcaccatgttggccaggctggtctcgaactcctgacttcaggtgatccgcccaccttggcctcccaaattgctgggattatgggcgtgagccaccgtgcctggcctcatcttcccagtttgtatgtggagcctgtggcttggggtattcttttaattctctgtgaccaggtaagacacaggcagaagatatctgagctctgaaaacatccaaggctaatattgagtgggcaagagtttgaggcctgtcacgtcagaaacgagaccaagattccacagctgacctgtgctcacagctgaattgtgctgagctgaaatactgcgcccgtttctttccattcaacttgtcttggtttgacctagaaccacactgcacaggagaagcaccattttttgttcagactctcatctgaagctggagcttctgctaagcacttgtttgcatgggagtggaaggggacatgcgcacccacagttgtggcgaaaagatccttgggtgtgacaaaggaggaggcgggccaaggagacccatccactgtgtccctggaccctcccaaggaatcccaggaactgcgaagcataaaccacatcttcactgtcttagagacgctgctgtccttccttcattttactcatgctaaaggctctatttttcttttctctagaactttctttctttccttttttctgagacggagtttcactctgtcacccaggctggagtgcaatggcgcagtctcggctcacagcaaactctgcctcctgggttcaagcgattctcctgtctcagcctcccaagtagctgggattacaggcgtgcgtggtggcgcctaatttttgtatttttagtaaagacagggtttcaccatgttggctagactggtctcaaactcctgacctcaggtgatctgcctgcctccgcttcccaaagtgctgggattacaggcgtgagccactagacccagccaggtctttgtttcttaacacagaatattgtttttcttttggattatgattattattctttgaagccagggtctcgctctgtcacccaggccggagtgcagtggtgcaatcatggctcactccagcctttatctcctgggcccaagtgatcctccaacctcagcctcccaagtagctgggattataagtgcgtgctacgatgtctggctaattttttatttataaatattttttgtagagacagggtctcgctttgttgcccaggctggtctcaaattcctggactcaggcgatcctcctgcttcagcctcccaaagtgctgagattacaggcgtgaacctttcaacttgtaatgctttcagtattttcccatcccttgattgaacatttgggttttaaattatttttgttgttgttgtttctttttgagacagagtcttgctctgtcacccaggctagaatgcaggggtgtgatctcggctcactgcaacctctgcctcctgtgttcaagcgattcttgtgcctcagcctcctgagtagctgggattacaggcgcctgccatgatgcccaactaattttttgtatttttagtagagacagtgtttcaccatgttggccaggctggtctcaaactcctgacctcaagtgatccgcccaccttggcctcccaaattgctgggattacaggtgtgagccactacacccggcctaagcttttttttttttaatcttaacctgttaacatttttcctctaattaatgctggttttcttttattgaggagtgaggagaagcaagaatggggtcaaccccattgaagagggattttttttccagtatacactgtcatagtaatgtacctatattgtaaaacatttagaaatgacagaaaagtccaaaaaagcagtagtatatgtccaaaaatgaaaacactgctctatttgtgagtcaagtaataattccaaatttatattcaaaatgttttactcatttcaaattcaggttctcattcaactataaataaaataatattctgtccaaaagtatgtgtatttaataacatcttagtccccatttatgtactgaattagaaggctccctctctctctctctctctcttttttttttttttttttttgagacaacgtctctctctgtcacccaggccggagtgcagtggtaccattacagctcactgcagcctcaacctcctgggcttaagcgatcctcccacctcagcctcctgagtagctaggatcacaggcatgcaccaccattttttatatgttttgcagagatgaagtctcgccatgttgccaggctggtcttgaactccggggttcaagcaatttgcctgcctcggcctcccaaggtgttggagttacagtcatgagcccccacaccctgccaaggcttgttttctagatatttgagtaaaataatggttcttctgcaaatgaggctccactgaggttaattcacaccctggtctttatttatttatttatttgataaaacaaaagaaaggtgtcaaatgataacctgctagatacttggttcttttttttgtttgttttttttttttgtttttgtttgacacagaatctcactctgtagcccaaggtggagtgctgtggtgcgatcttggctcactgcaacctccacctcccgggctcaagcaattctcatgcctcagcctcccaagtagctgggactacaggcgcacacgaccatgcccagctaattttttgtattttagtagagacagggttttactatgttggccaggatggtcttgaactcctgagctcaggcgatctgtccgcctcagcctcccaaagtgctgggattacaggcgtgatccaccgtgcgcagccttgtttgtttttttgagacagggtcttgctctgtcacccaggctggagtgcagtggcgccatctcagctcactgcagcctcagcctcccaggtccaagcaattctcctgcctcagcctccctggtagctgggattacaggcacgcacagccacgcctggctaatttttgtatttttaggagagacggggtttcaccatgttggccaggctggtcttgaactcctgacctcaagtgatccgcctgcctcggcctcccaaattgctgggattacaggcgtgagctaccacgcttggccgatacttgattctaaaagcatcttggtacccaccagaatcttccatgggttcagttttcacattgatggggccgcagctgcaaggagaagggaaccctggtcagatgggcagggtgaggaccaggcacagccgcctggacacgatgagctcaaatgccctggatctccgcagcaccaaatccccctcctcccctcaatcaaatgcaacaatgcctccattttaacattaatgtcttaataagttgttcccaaattaaacgtgtctaccgaaaatagtcttctaattccaaaggtccttttggacaaagaataggatagaaaataaggaagggaagaagcacattaaccctttacactccacttaaatgctgtaaggaggcctttctgtcatccaaaaacgaacactgtgcatagttgtggattttggttgctgtgatttatcttttacctttcacttggtgatactatggatctctccgcatctgttaccatcccagggccacctgtagaggaatgaaaaaacacacaccagccccttttagcacctcggaaaatgactaacatccaaaggcatagaaattgacagcaaatacacagaaaacggaactcccagatcgaagccaacgtggaaaagtcatcgagagagaaactgactcaaagcagccgctgtgttccggggccatttgtgtgggcaggatgggggttaccgaggagtgttttggggccagagcacggtcgtgcggctgagcctcagctcaccagctgggctgcctccagcaactcactaaacctccctctgcctccgcttcctcgtgaacacggtggttgtgggaggattcatgaatatacgcaaaatgactagaacagtgcctgcatgttgtaagcactaagttagagctgctatgacacgagctcccccttgatctgtggtttcgcggtcctcggtttgctccccaaggtcaaccaaagtctgcaaagagtaaacggaaaattccagaaataattcagaagtttgaaatcacacgttgttctgagcagcgtgatgaagtgtcgtgccgtcccgcctgggacgtgactcatccctttgtcctgcaatccacgctgtctacactactctcccactagtcactgagtagctggctctgttatcagactgacagtcctgggaaggccagggtgcttgtgctcaagtcacctttatttgacttcataatagccccaaagtgcaagagtagtaatgaaggcatattgttataatcattttattttatctttagttattgctgttaatctcctactttgcttgatttattgatttatttactgagatggatcttgctctgttgcctgggctggagtgcagtggcacgatctcggctcactgcaacgtctgcctcccgggtttaagcaattctcccgcctcagcctcccgagtagctgggactacaggcacgcaccaccacgcccggctaatttttgtattttcagtagagacagggtttcaccatgttggccaggctggtctcaaactcctaacctcagatgatccacccgcctcggcctcccaaagtgttgggattacaggcgtgagccaccacacctggcctgtgcttgatttataaattaaactttctcttaggtatgtatggctagggaaaaacatagtatatgaagggttctgtactacccatgggtccaggcatccactgggggtcttggagcatattccccgaggataaggggggaccactgtattattgtttttctatgatgatgatacaagtcagttgggacaacaatccatggccacctgccaccctgcccctctcatttgtcctttaatgtgagttagaggatgacaggaactcaccaaccctcccgaaacagactttccactgtgtttagtccccggctaagaagaactgaagcatgtcatacacccagcaggtgccttgtgaactgtgccaccccccacccctgccgtctccttactccacttaggcagtctcagcaagacatcttcttttattcttctttatttatttatttttgaggcacagtctcattttgtcacccaggctggagtgcagtggcacaatcttggctcactgcaaactctacatctcgggttcaagtgattctcctgcctcagcctcccgagtaactgggattacaggcacccgccaccatgcctggctaactttggtatttttagtagggatggggtttcaccatgttgactagactggtctcgaactcctgacctcaagtgatctgcccacctctgcctcccaaagtgctgggattacaggtgtgagccactgcgtccggccaatttttttttaatagctacaaatgtatttttctttttttaaaaaatattctttatttcttctaaaaaaaaaaaagggggggatacatctgcagaatgtgcaggtttgtttcctaggcacatgtgtgccacgatggcttgctgcacctattggcctgtcctctaagttccctcccctcacccaaattcaagttttgttttttttttgagacggagtcttgctcagtcgcccaggctggagtgcagtggcgcgatctccgctcactgcaagctccacctcccgggttcacgccattctcctgcctcagactcccgagtagctgggactataggcacccgccaccatgcccggctaatttttttttgtatttttagtacagactgggcttcactgtgttagccaggatggtcgcgatctcctgaccttgtgatccacctgcctcagcctcccaaagtgctgggattacaggtgtgagccatcacgcccggcccccaattcaagttttaatgaagaagaagtggttcagcagctcagaagagccaccaaacctgagaagctgtcacttacccagctgactctctggtcctaggaagggtctgcaagaaaagcaacaccattacccagcacggaccaatgaaaaaagcatgacacatctgaacagtcagctctgaaacgcagcaggcgggatgcacgagtgaattaaaattaggctattggtttcatctttaaatgaactgaaggggcgggggtgcagagtgtgtcacctatttatgatgaatgaaatccctgctttgttctccaaaatccatttcagggttgcaaggtcgtaattctcagggtgttgaaaggcaacgccttccggaagcccctgcactaccacagccgactggtctcgcagcatcttctcatagggaacagacaccatcactgttgtccctaaggctttacctacaagaagatgcaaacgtctttggatggtgtgaacctaacgttctaccagtttttttttgtttgttttttgttttttgttttgtagaaacagagtctcgctctgccacccaggctggagtgcaatggcaagatctcggctcgctgcaacctccacctcctgggttcaaacaattctcctgcctcagcctcccgagtagctgggactacaggcacacaccaccatgcccagctaatttcttttgtattttagtagagatgaggtttcaccatgttgcccagactggtctcgaacggctgagctcaggcgatctacccaccttagcctgccaaagtgctaggataacaggcgagccactgagcccagcctagttttttttgtttttgtttttgtttttaattaagagacagggtctcgactgggctcactgcaacctctgcctcctgggttcaagcaattctcctgcctctgcctcctgagtagctggcattacagccgtctgccaccatgcccgactaatttttgtatttttagtagagacggagtttcactatgttggccaggctggtctcgaactcttgatctcaggtgatccacccacctcagcctcccaagtagctggtgtgagtcaccgtgcccagcctgttatctagctttttaaaacactgcaaaggatttttgaaaattatttttattttattttgtagagacagggtcttactatgttgctcagtctggtctcaaactcctgggctcaaatgatcctcccaccttagcctcccaagtagctgggattacaggctcaagccaccatgcccagcgtatttttttttttttaattcccatcttcatgcctatggaaagacatgggtaggtggagtgacaactgaggggtgagggaggtgactgagccaacattgactgtctttagcaatacactggccttgatgcggggctctctaaaatgggatcaaggaagaaagagtgatcaatacagaagtttccacagagcagaagatccaagatccacatcatcttctataagaacacttaatctggtaattaagaactggtgggccgggcgcggtggctcacgcctgtaatcccagcactttgggaggccaaggtgggtggatcacgaggtcaggagatcgagaccattctggctaacacaatgaaaccccgtctctaccaaaaaatacaaaaaaagttagccgggcgcggtggtgggtgcctgtagtcccagctactcaggagactgaggcaggaaaatggcaggaacccgagaggcggagcttgcagtgagccgagattgagccactgcactccagcccgggcaacagagcgagactctgcctcaaaaaaaaaaaagaactggtggccaggcatggtggctcacacctgtaatctcagcattttgggaggccgaggcaggaggatcacctgaggtcaggatttcgagaccaacctggccaacatggcaaaaccccatctctactaaacatacaaaaattagctgggcaaggtggtgggcacctgtaatcccagctacttaggaggctggggtgggagaatcgcttgaacccaggaggcagagtttacagtgagctgagattgtgccaatgcacttcagcctgggtgtcagagcaagactcctctcagaaaaaaaaaaaaaaaagaactagctcctcgcttgataagcatatgggttttgaaatgttcaaacattctaagtagtcatggcaataagaccgtctgtgacactgtcctactcctgggtgaaccacttagagaattcatgcttggctgggcgtggtggttcacgcctataatcccagcattttgggaggccaaggcaggcggatcacaaggtgaggagtttgagaccagcctggccaacatggtgaaaccccatctctactaaaaatacaaaaattagctgggtgtggtggtgggcgcctgtaatcccagctacttgggaggctaaggcaggagaattgcttgaacccaggaggcggaggttgcagtgagccgagatcgcaccactgcactccagcctgggtggcagagcaagactccatctcaaaaaaaaaaaaaaaaaaaaaatagaattaatgcttaaagtgaacgttaccatgacaaaagcagaaatagtcctccactgccttcctgagtatttccgtttcgcccgagtggacctgcatcccgttcacagggcagggaggtttcacctcacacagtccctctgcaacgcctgcaaatggatgattggcattaggtcagtttctaagcatttgtgctgtacacttccgtactttgtttctggtattgaaagaaaaaaggggaaaaaagtggataaatataaaacaagatcttttaaagaaaaacaagaaaaaattgtatttatgataaacaggttaatgaactataaaaaaatcaacatataaagaaatagtagtagtttaaggaaattattatttttagagacggtttcactctgctgcccaggctggagtgcagtgggatgatcgaagttcccggcagcctcaaatttctgggcttaagcggtcctcccacctcagcctccaggagtgccccatcacacctggctaacttttaaattttttttagagatgggatctcactatgttgcccaggctggcctctaactcctggcctcaagtgatcctcccatcttagcctcccaaagtgttgggattacagatgtgaggcactgcacccatccagaaattatctttataacagaaatttgatttgctatacagttgaaacgtggcaataattgtataggaagactatacccctgaacccattcaagaccagccccagaatcaattgctcctccaaaagttttaaaactgattgttttcatcagtctagtcagaagagagaaaccacatagtaatttgaacacagaaaggttttttttttttgtatcaatgtaaggggcacaagtatagttttatttctttcttcttttttttttgagacagagtctcgctgtgtcacccaggctggagtgcagtggcatgttctccactcactgcgagttctgcctcccgggttcacgccattctcctgcctcagcctcctgagtagctgggactacaggtgcctgccaccacgcccggctaatttttttgtattttttagtagagatggggtttcaccacgttagccaggatggtctcgatctcctgacctcgtgatccgcccgcctcggcctcccaaagtgctgggattacaggcgtgagccaccacaccccgccaagtatagttttcttgcatggatatacggtgttgttggtgaagtctggggttttagtgtactcatcacccaaataatgtacattgtacccatgaagtaatttatcatcccttacccacctcctgcctcccacccctgagtctccagtgtctgttatttcacactctatgaccatgtttttgtttgtttgttttgagacagagtctcactctgtcgtctaggctggagtgcagtggcgcaatctcagctcacagtaatctctgcctcctgggttcaggagattttcgtgcctcagcctccctagtaactgggattacaggcacccgccactacaccaggctcatttttgtatttttagtagagacagggtttcaccatgttgaccaggctggtctcgaactcctggcctcaagtgatctgcccacctcggccttccaaagtgctgggattataggagtgagccactgcacctagcctcacattctatgtccatgtgtacctattatttagcccctcttgtaagttaggacatgccgcatttgcctttttacgtcaaatgataaagacaatagcccccaatcccatccatgttgctgcaaaagacatcatttcattctttttttttttttttttttttttttgagagagtcttactctgtcgcctaagctggagtgcaatggcatgatctcggctcactgcaacctctgcctcccgggttcaagcaattcttgtgcctcagccacctgagtagctgggattacaggcatgcaccaccacccccggctaacttttatatttttagtagagacgaggtttcgccatgttggccaggctggtctagaactactgatctcaagtgatccatcgcctcagcctcccaaagtgcttggattataggcgtgcactaccatgcccggccatttcattcttttttatggctgaatagtatcccatagtgtacgtaccacattttctttgtcccgtcatctggtgatggatgcttagcttgatttgcacatctttgctattgtgaatagtgctgtgataaacgttcaaggcaggtgtctttttgatagaatgatttattttcctttgggtagatgccaagtagtgggcttgctggattgaatggaggtttatgtttagttctttgagaaatctccatactgttttccatagagcttgtactaatttacaccaacaggtgaagtttcctagaagagtcgtcaactggtaacatgggattagctgctagagggactgaggactctaaagagaacataagcagcaaattgcaagagcatctgtgactgctgggctaaggcaggggacccaggagggagcaaatccaggaatggggtggctccccagggccgagatccagacctcattaaacaggatttggtcacggcccactggatagtggggaagcctgtgggggtgtccatgtggtggctggcaagcaggggcctgctttctgggggtgctggtggaaatcactagacagttaccctgtgggtgcctgcaacactttctgggcgttataaggaagatggcctctagtgtgctagtggaactctctggaagctacctggagggtgatgccaagagaatttgctgggaagccatgctctggggaactggtggaactccctaggaaactgcctgtgggtatggtgccactgaaattcactgcgaaacctccttctggaattttctttcttcctttttcctttcccttttttttttttttttgtcttgctctgtcacccaggctggagtgcaatggcacgatcttggctcactgcaacctccacctcctgggttcaagtgattctcctgcctcagcctcccgagtagctgggattacaggtgcatgccaccacgcccagctaatttttgtatttttagtacagatggggtttcgccatgttggccaggctggtttcaacctcctggcctcaggtgatccgccagcctcagcctaccagagtgctggaattacaggtgtgagccaccacacccagctgatatatatatttttaaaataataataaaaaagaaaaaaggccaatgtaaaaatgtatatatatatatgtattttgtagagacagggtcttgccatgttgcccaggcaggtctcaaacgcctgggctccagcgatcctcccacctcagccacccaaagtgctgggattacatatgtgagccactgcacctggccccttctggaattctctgggacttcgataagacttgctgggaagccagctggagtattagtggaagtgactgggaagctgtgtgtggtgagggtgtcactaaaactcactggaatgagtgccacactgggtatcccaaatgctgttggtcatcacaggcaggtgagagctcactgcaacctccgcctcccgggttcgagcgattctcctgcctctccctcccgagtagctgggattacaggctcctgctaccacacacctggctaatttttgtatttttagtagagacggggttttcccatgttgaccaggctggtctcgaactcccaacctcaagtgatctgcccgccttggcctcccaaaatgctgggattacaggcgtgcctggccccaagtggaatttattcctcaaatacaaggatggttcaacatatttacatcaatcaatgtaacataccacattgacagaataaaggacaaaagccacatgatcatctcaattgccacagaaaaacatttgacaagattgaacatcctttcatgataaaagcactctaccaactagaagtggtaggaaatgaccaatgtaataaaggccatttataaaaagtccatggctaatatcactcaacaatgaaagactgatagctaagatcagaaatagcaaagatgggccaggtgcggtggctcacccctgtaatcccagcactttgggaggcggaggcaggcagatcacttgaggtcaggagtttgagaccatgctggccaatgtggtgaaaccccacctctactaaaaaaatacaaaaattagccaggtgtggtggcacgcacctgtaatcccagttactcaggaggctgaggcacgagaatcacttgaacctgggatccggaggttgcagtgagcagagatcaagccagtgcactccagcctgggcaacagagcaagactccatctcaaagaaaaaaaaaaaaaagaaatggcaaagatgccctctctccccacttctgttcaacacagttttggaagtcctagccagagcaattaaattaggtaagaaaaaaaaaggcctccaaatttgaaagaaagaagtaaaattatctctgttcatagatgatacatgattttgtatgtagaaaatcctaaaaattccacacaaaaatctattcgaactccaacatattcagcaaagttgcaggatactacatcaacacagcaaatcaactgcatttctatacagtaacaatgaacaatctgcaaaggaaataaaacaattccatttacaatagcatcaaaaagaataaaatccttagggatagacctaatcaaggaagggaaaaatctgtatactaaaacaataaaacactgctgaaaaaaattaaagaagacaggctgggcgtggtggctcacgcctataatcctataatcccagcactttgggaggccaaggcaggcagatcacttgaggttaggtgttcaagatcagcctgggcaacatggcgaagccctgtctctactaaaaatacaaaaattagctgggtgtggtggtgcatgcctgtagtcccagctacttgggaagctgaggcagtagaatcgcttgaacctgggaggcagaggttgcagtgatctgagatcaagccactgcactccagcctgggcaacagagcaagactccgtctctcaaaaaaaaaaaaaaaaaaaagaaagaaaagaaattaaagaagacacaaacaaatggaaagacatctcatgttcatggattggcaggcttaatattgctaagatacctgtactaccaaaagccatctacagaattattgcaatccccatcaaaatctcaagtgcatttctcgtacaaattaagaaatccactctaaaattcacatggggctgggcgcggtggctcaccctgtaatcccagcacttttgggaggctgaggagggtggatcacgaggtcaggaattcaagaccatcctggccaacatggtgaaaccctatctcaaaatacaaaaaaaaaaaaaattagctgggcatggtggcatgtgcctgtaatcccagctactcgggatgctgaggcaggagaatggcttgaaccgaggaggcagaggttgtggtcagccgagatctctccactgccctccagcctgggcgatagagagagattctgtctcaaaaaaaaaaaaaaaaaaattcatatggaacaccaagggactctgaataacagaaataatcttgaaaaagagcaaatttggaggtctcatacttcctgatttcaaaacatattataaagtaatcaaaacagcatgatactggcataaagacaaatagatctacggaatagagtagggagtccagaaataaacccttgaccaaatatttagcatgcatgccaggtgcagatctcagctacttgggaggccaagacaggaggatcacttgagcccaggaatttatgaccagactgggtaatatagcaaaaccctgtctcaaaaaaaaaaaaaaaaaaaaagctgggcacgatgactcacgcctgtaatcccagcactttgggagccagaggcaggcggatcacctgaggtcaggagtctaagaccaggctggacagcatggggaaaccctgtctctactaaaaaatacaaaaattagccggctgtggtagcagatgcctgtaatctcagctatttgggaggctgaggcaggagaatggcttgaactcagaaggtggaggtttcagtgagccaagatcatgccattgcactccagcctgtccgaaagggcaaaactctgtctcaaaaaacaaaaacaaaaacgaaaaacctgcagccatagaaaagaaagaaatcatatcctttgcagcaatgtggaggcagctggaggccattatcctatgtaaattaatgcagggacagaaaaccaaataccacatgttctcacttgtaagtgggagccaaaccttgggtacacatggacataaagatggggatgggaacaatagacactggtggctcctagaggaaagagggaagtgggggcaagggttgcaaaatgaactacggggtactatgctcactactgtaccccaaaccacagcatcacacgatatacccatgtaacaaatctacacgtgtgccccccgaatctaaactaaaagttgacattattaaaagaaaagaaaatataaaaagattatcacaccaatttcagaacagtttcattacaagatgaatactagagaaaatatttgcgacaacaaaattaacatgcaactatgaatcttaaaaaaatctacaagtaaatttcagtgattagaaattcaactggcatctgacattaatgaattgagaatacccttcttgtgtatcaattacatactgtattatttaaagatggcttcattttttaatctgtcttcttgatagtggagaccttaatttgggatctcggaagtaaatttgaatcaatctatcactcaattctcccctctctcatctctctctctctctctctatccattcatctaatctatctatatacatatatatatatatataattcctgtctcccttatctatctatccatccatctaagctatctacatacatatatatatataattcctctctcttatctatcatctatccatttatctaatctgtctatatacatatgtatataattcctctcttatttatctatctacctatctatctaatctacttatacacacacagacacacacacacacacacacactttatataccttctgccaatccatagagacccctctctctgtacatacatacacacacacacacacacacacacacccttataccctctgacgaacctttctgatttttatcctttcatggttacaaggaatattaaattgctatatcaatacttggtaaataacctacagtgttagagattaccaccataaaaggtgtagttttttgtctggttttgttttgtcttgagaccgggtctcgctctatggtccagactggagtgcagtggtgtgatcacggctcactgcagccttgacctcccgggctcaagagatcctctcacctgagcctcctgagtagctaagacaacaggcgagtgccaccacgcccatctaatttttttttgtattttttagtagagatggagtcttgccatgttgcccagcttggcctcaaactcctgagctcaagtgatccatctgccttggcctcccaaaattttgggattacaggagtgagccaccgagcccggcagaaggtgtagtttttaacactgtagagtagttccttgacatatggccacatatactcactcacactggatgcttgcagcacaccgtggcatattgaaggctctgaaattgccatactaagaaaaggaaaaaacggccaggtgcagtggctcacacctgtaattccagtactttgggaggcagaggtgggcagatcacttgtggtcaggagtttgagaccagcctggccaacagggtgaaaccctttctctaccaaaaatataaaaattagctgggcatggtggaaggtgcctgtaatcccagctactcgggaggctgaggcaggagaatcgcttaaacctgggaggcggaggttgcggtgagccaagatcgcaccactgcactccagcctgggtgacacagtgagactctgtctcaaaaaaataaagaaaaaaagaaaaaaggagtaattgtataatggctattaataggcagtaatacacaacaagctctgaaaaagtttttcccccttcctttggaaaggactaaagagtattttgtaaaatggtgtttattttaggaattaaagataatttgttctatgtccttgaaatttattctaataaaccagagtaccgctgaggacctagtataaaataaaatgaccatttgtcttggactctgcagtgttaagcagtgtttatttggtaagctgaatccaagaagatgtgttaggatcgtttctaggagaatgcttatgatagcttagaagaaaatactgtggaagtcttgcctgcgatccttttgagattgggaatacaaaggataaaattaaaacgcctacagtattttgcaaaatctttctgaaaatccgtcctggcattaacaaaagcgcatcctctctcggttccgacgacaaacacgtctgtttcgtacactgcgatgcaggccacttctgccttggacttggccagttctttacactgaaacagaaacaaaaagcgatgtattatctacaagggcagatccaagtttctggggcctgggaggcctgatttaagaatacaaaattaggtagcaaaaggaatatttatttatttatttatttttgagacggagtctcgctctgtcacccaggctggagtgcagtggcgcaatctcggctcactgcaagctccgcctcccgggttcatgtcattctccggcctcagcctcctgagtagctgggactacaggcgcctgcaaccacgcctggctaatttgtgtgtgtgtgtgtgtgtgtgtgtgtgtgtgtgtgtgtgtgtgtatttttagtagagacggggtttcaccatgttagccaggatggtctcgatctcctgacctcatgatccgcccacctcagcctcccaaagtgctgggattacaggcgtgagccaccgcgcccggcctctggatatgtccttccagctgatggacctcaggattgggagaaagatcggggacaagagacgggcacaacagtcacctggtttctttttcttcctttattttttgagactgagtctcgctttatcacctaggctagagtgcacgatcttggctcactgcaacctccacttcccaggttcaaatgattctcctgcctcagccttccgagtatctgggattacaggcgtgcactgccatacccgactaatttttggattttagtagagatggggttttgccatgttggccaggctggtcttgaactcctgacctcaagtgatctgcccaccttggcctcccaacatgttgggattacaggtgtgagccaccgtgcccagccacatggtgtcttccatgacagctccctctctgctgaaatagcatttcccacccccacccatggcatcactcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaattttttttttttttttttttaagacggagtctcattctgtcacccaggctgaagtgtagtggtgcgatcttggctcactgcaatcccgggttcaagcaattctcctgcctcagcctcctgagtagctgggattacaggcgtgagccactgtgcccggcctttatttaagatttgcctccttaaccattacacctgtaatcccagccctttgggaggctgaggtgggcagatcacctgagttcaggtgttcaagaccagccaggccaagatggtgaaaccacatctctactaaaaattccaaaattagccaggcgtggtggcaggcacctgtagtcccagctaatcagaaggctgaggcaggggaattgcttgaacctgggaggtggaggttgcagtgagccaagattgcaccactacactccagcctgggcagcggagtgagactgtctcacacaaaaaaaaaaagaagtgtcaggtgctggcagagacactgcttttccctaattgacctgtttggtcctcacattaaccatattttacagctactctcatttacagataaggaaactgggccaatgaggaggtgagaaatcactcaaggctgccaggtacagtggctcatccctgtaatcccagcactttgggaggccaagggaggaggattaattgaggccaggagtttgagaccagcctaggcaacataatgagactctgtctctacaaaaaatttaaaaattagtggggtgtggtgatgcatgtgtagtcccagctactccggaggctgaggtgggaggatcgcttgatcccaggtgtctgagacagtagtgagctacgattgcaccactgcactacaacctcggtgatgcaatgagacgctgtctcaaaaaaaaaaaaccacacacacacaaaacaacaaaaaaacaaattgttcaaggcgagcctggtgtgccaagcccttgttctgggcacttggcttatattatctcccttaatccttcccaccaccccacgtgctagatactgggattaatttagttgagctgtaatacatcaatactgtgtgaaatgctatgcaacatctaaaaggaagacaggtggagcttttatttattttttattttatttattttttgagacgcagtctcgctgcattacccaacctggagtgcagtggcacaatcacagctcactgtagcctcaacctcctgggttcaaacaatcctcccacctcagcctctcaagtagctgggactacaggcttacaccaccaagcttggctaatttttttttttttttttttttagagatggtgttttgctaagttgcccacactgatctcaaaatccttttgtttttgctttggaatggtctggaactcctgagctcaagtgatcctcccaccttggcctcccaaaggcctgggattacaggtatgagccaccgcaccaagcccaggttgagcttttaaggtattaaagatccactaggtgaaaaaaaagagtgaaagatacatatgccatttaagggaagcacaggaaaactcctattttgtttatatgtgaatagaggcacatagatgcctagaaaagtgtctgggagggaatgaaaccagattggccacaaaaatcacctctggaaaaaggaaaagaatggggactttcactttttgcttcatatgtttcatgtacctttttttttttttgagatggagtttcactcttattgcccaggctggggtgcagtggtgcgatctcagctcactgcaacctctgcctcctaggttcaagcgattctcctgcctcagcctcccgagtagctgggattacaggcatgcgccaccacgcccggctaattttttgtgtttttagtagagacgaggtttctccatgttggtcaggctggtctcgaactcctgacatcaggtgatccgcccaccttggcctcccaaagtgctgggattacaggcgtgagccaccgcgcccagctgctttttctttttttttttcctatttttatttttatttatttatttttttaatttatttttttctattgataattcttgggtgtttctcagagggggatttggcagggtcatgggacaatagtggagggaaggtcagcagataaacaagtgaacaaaggtctctggttttcctaggcagaggaccctgcgggcttccgcagtgtttgtgtccctgattgcttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaacctttcctagtgcagaacaaaatgaaaagtctcccatgtctacttctttctacacagacacggcaaccatccgatttctcaatcttttccccacctttcccgcctttctattccacaaagcctccattgtcatcctggcccgttctcaatgagctgttgggcacacctcccagacggggtggtggccgggcagaggggctcctcacttcccagtaggggcggccgggcagaggcgcccctcacctcccggacggggcggatggccgggcaggggggctgaccccccccacctccctcccggacgtggcggctggccgggcggggggctgacccccccacctccctcccggacggggcggctggccgggcagaggggctcctcacttcccagtaggggcggccgggcagaggcgcccctcacctcccagatggggcgtctggccgggcggagggctgacccccccacctccctcccggacggggcgcctgcccaggcggggggctgacccccccacctccctcccggacgggtggctggccgggctgaggggctcctcacttcccagtaggggcggccgggcagaggcgcccctcacctcccggacgggcggctggccggcggggggctgacccccccacttccctcccggacggcacggctggccaggcggggggctgacccccccacctccctcccggatggcacggctggccgggcgggggggctgaccccccacctccctcccggatggggcggctggccgggcggggggctgaccccccccacctccctcccggacggggtggctgccgggcggagatgctcctcacttcccagatggggtggctgccgggcggagaggctcctcacttctcagacggggcagctgccgggcggaggggctcctcacttctcagacggggtggttgccaggcagagggtctcctcacttctcagatggggcggccgggcagagacgctcctcacctcccagacggggtctcggccgggcagaggcgctcctcacatcccagatggggcggcggagcagaggcgctccccacatctcagacgatgggcggccgggcagagacgctcctcacttcctagatgtgatggcggctgggaagaggcgctcctcacttcctagatgggatggcggccgggcggagatgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcgggatcactcgcggttaggggctggagaccggcccggccaacacagcgaaaccccgtctccaccaaaaccagtcaggcatggcggcgcgtgcctgcaatcgcaggcactcggcaggctgaggcaggagaatcaggcagggaggttgcagtgagccgagatggcagcagtacagtccagcttcggctccgcatgagagggagaccgtggggagacagagcgagagggagagggagagggagagggagagggagagggaaaagtcacacttcttaaagttgcagtctcaccaatgcaccacccagatatttttataaatgaaaataaaaggagaatcatatggttccagatgacattgctaataatttggtatatcattttacagattcattcttcatgcttatttttcataaattaatacacatgcattttattttacaaagtaagaataatactatacattggggtccccaacccctgaaccatggaccagtaccatctgtggcccattaggaaccaggctgcacagcaggaggtgagcagcctgctttttctttttaaaaagtaaaatataacagagaaaactgcacaaaacagaagtgttcaaattaaattttttttttttttgagacagggtcttgccctgttgcccaggctggagtgcagtggctcattcatagctcactgcagcctcaaactcctgggttcaagcgatcctcccaccccagcctcctgagtggctggaaggccaagggaggatcgcttgagcccaggagtttgaggctgtgccaccacacgcagctggttttttttgttttttttttttttaattttttgtagagacagggtctcgctatgtcacccaggctggtctcaaactcacgggctcaagcaatcctcccatctttggcctcccaaagtactgagactacaaacatgagccatcttgcccagcccctagaacgtgttatcaaataaacaccgatgcaaccctcactcagccgagaagtaaaacattgccagccaatccctaaatgcttctgcttgccgcttcccaatcctaaccaatgccttctcctgacaattatgatggtcatgtctttgcatttctctaatgtttcccatcacgatcaaactagttttgttttgcctgtgtccaaactttgcataaatgagcagcatgtgtctggtggacctggcttcttccactcaacattatgataagaagattgaccatttggtgcccatagctattgctcttgcattttcattgctctatagattcttactcaacataccttaaaaatttttttattctgaaataagagcgggatgctattaaaaaaagcagtatcagtgtcattgttaacactgtcattattaagacggctgaagtcagtttaagaattgtgattcatttgtctttatatccctgtgtgaatgctagggacatgtaatcaatatatcgtgttttaaagtaatgttaattgtcctttgggtacaccaactttatatacagtgaggttcgtttgttcagtatgtttgaaagttacagggatttctgtgttttcctttttgaaatagttctgttttaaattatgtaaaatctttgaaacaataagttgtttcaaaaaaaatacactaaaacaagatacactcaaaaattcagtttccatccctttccactctacatttttccttcctctccatttttattttttgattatcctttattgttttttaaacgatatgcatatcagtgtatctgaaaaccgccaccttctaacatttaaggtagtagacagtatatacagatttgaaccttgctttttcacataatagatagttgaggtcattccatagcagtacacagaaactcatctttggtcttaaaactgcataggtactttagtcctctgttgacaaatgttgggttgtttcagtcttctgctatcacaaataatgctgcaaagaatacatttgttcatatgtcatttcacccttggcaattttgcctctggaaagttcctagaagtcagattcccaggtcaaaggttaaatgagcatgtaattttgctggatattgttaaatccccctacagagcatgcaccactcagcattcccctcagcgttgtatgagagggaccatttctctatggcctcaccagcagatttggttattgtagctctgggcttttaccaatttcacaggttaaaaatagtatctaagacaggcgtggcagctcatgcctgtaatcccagcactttgagaggccgaggaaggcagatcactggaggtcaggagttcgagatcatcctagccaacatggtgaaatcctgtctctactaaaaacataaaaattagctgggcatggtggcacatgcctgtaatcccagctactcaggaggctgaggaaggagaatatcaggaacctgggaggcaggggttgcagtgagcagagatagcgccactccactccagcctgggtgacagagtgagactctgtctcaaaaaaaaaaaaaagccagccgagcttggtggcttacacctgtaatcccagcactttgggaggctgaggcaggtggatcacctgaaatcaggagtttgagaccagcctggccaacgtggcaaaaacccgttgctactaaaaatacaaaaaatttagccaggcgtggtcgtctgtgcctgtaatcccagttacttgggaggctgaggcaggagaactgcttgaccctgaaaggcagaggtcaagtgagccgagctcacgccactgccctccagcctggacgacagagtgagattctgtctcaaagaaaaaaaggtatctaatttttgtctcttatgagtagtttgatcatctgttcatatgttgaatgattattttcagttctgtttccgtgagtcttagttcatatcctttacccatttttctgaagggctaccagccaaatctcatgttcaagagtttttcctatagtagagaaacctattccaaatgaagcaaagttttgaacgtaaaatagaaaccatagaagtgcagtgttagaagaaacaggctcctcacgagttgcaggtgggagtgtcagttggtacagctctctagagggctttgtgacaggaattgtccacataagagatacatgcaccctttgatcaagcagctttacctttaggaagttatcctacacacatactgggaaatggatacaaggatttaatgtaacatttttttaataatagcagcttggaaacaatgtacatgttatcttttcagggagctgattgaataacttacagtattggtgtaagttggaatatactatgtaactatgaaaaagaataaggcaactgaagaagtactcatgagaatgatctcaaaaagcaattacataaaaacaaggctcagaactgtatagtatcctctattattcgggcttttaaaaatcttttaatatgcataaaataattcttacaggatatattaaaaactggcaatcgttactgagataaaaaggaaatttactttttactgtacagtctttttttttttctttcttttgagacagagtctcgcactgtcgcccaggctggagtgcaatgctgtgatcttggctcactgcaacctccacctcctgggttcaagcaattccccagtctcagcctcccaagtagctgggattacaggcacccaccaccatgcccggctaatttttgtatttttagtagagatgggttttcaccatgttggctaggatggtctcgaactcgtgacctcaggtgatccgtccgccttggcctcccgaagtgctgggattacaggcatgagccaccacacctggccccaagttgttgtctttttcttagagatttgaatacgctctttatatattctagatacaagctgtctgtcatgtatgtgttgcaacaaaaaagtgtcctgctcttgccattctacttccttgtggttagcatactttgtgtagtattcaggaaatctttgcctacctaacctaaggtcatgataattttcttctgtgctaccttctagaagctttattattttattattacttttatatgtaaatccataaaccacctgaaattaatttttgtatatggtgtgaggttgggatcaaaattagttttttttgtgtttggtggtgttggtggtttttgttgttgttgttgtttttttttactgtagaaatacccatttctcttagcaacatttattgaaaggaccatccttatttctctgcagcaccgtctgtgtctaatttaagtgtctgtatatatgtgggtccatttctagactctgttttgttccattggtctatttttctacctagaccttgtgccagtctttgttttacccctagccttatactttaagtcttgatagagtcagtcatcccactttctcatttctcttcaggactgtcttgtatcttggccttttgcattttcatataatttttagatcaacttgtcaatttccacacacaaaaaaaaaagttctgagatactgattgggattgcctttcatctactgattactttggatggaattaacattgttacaatattgaccttgtttacttctaatctatgaacatggaatgtcgttatttatttatttaacttttgagacaaggggtcttgctctgtggcccaggctggagtgcagtgacatgatcatagctcactactgccttgaactcccaggctcaagcgattctcctgcctcagcctcttgagtagctgggaccacaggcatgcatcaccacacctagctaattttaaaaaacttataatagagacacagtctcactatgttgcctaggctggtctcaaactcctgagctcaagcaatcttcccaccttggcctccctgggtgctgggattgtaggtgtgagccaccatgtcctgcctccttcatttatttacatcatctctatttcttctctgtagaggttttacttctcttttattagatttacaatctcggctcactgcagcctccacctgctgggttcaagtgattctccagcctcagacttccgagtagctgagattacaggcacgtgccaccacacctggcgaatttttgtagttttagtagagacagggtttcaccttgttggccaggctgatctcaaactcctgacctcaggtgatccacctgcctctgcctcccaaagtgctgagattacaggcgtgagccacggcgcctggccctaggtatatgctattctaaatagtgccttcatatatgctattctaaatagtgccttcaaaatgtgattgactgtgctggtgtgtagaaatacaactgattttgttttcagaaagtttgctaaatctgtatgttctttaggattttagtacatacactcaggtctatgataatgagtttttcctttcctctgcaatcttattctgtttatgtcttgctgcacttggctaggactttaagttgaatagacatgataataaacatccttgtcttgttagatctgaaatgagtgtgtatgtacagtcaatgaagtagaggagtaatacttttttcccctaattgttaaaccagttgttcagttgtcttccagtcctagctaatcattacagtctcctttggcatttcttttttttctttattttttcttggtagagatgagacttcactatgttacctaggctggtctcaaaactcttgggctcaagtgatcctcccaccttggcctcccaaagtgttgggattacaggcatgcaccaccacacctggctaatttttgtattccttttttttttttttttttttttttttttgagacagagtcttgctctgtctcccagccattctcctgcctcagactcccaagtagctgggactacaggcacctgccaccacacccggctaattttttgtatttttagtagagacggggtttcaccatgttagccaggatggtctcaatctcctgacctcatgatccacccaccttggcctcccaaagtggtgggattacaggcatcagccaccgtgcccagcttgtttttgtatttctagaagagatgaggtttcaccatgttggccatgctggtctggaattcctgacctcaggtgatcctcctgcctcagcctcctgaagtgctaggattacaggcgtgagccacctcgtccggcccctttggcatttctgacccttgcttgctcagtgatgtgtatccctcagtgtctggagcacattgtgaagaaaaatgcaaggtttatggtttttattgttttaattttattactttaactacaggtaaggtcttgctatgttgcccaggctggtccgaaactcctgggctcaagcagttctcctgcctcagtctccgaaagtgctaggattacaggtgtgagccaccgcactcggccatctatgtgcttttaaagttccacaggtggctaggtgtggtggctcacgcctgtaatcccagcacttttggaggccaaggcaggcagatcacgaggtcaagagatcaagaccatcctggccaacatggtgaaaccctgtctctactaaagatacaaaaattagccgggtgtggtggcatgttcctgtagtcccagctactcgggaggctgaggcaggagaatcgcttgaaccagggaggcggaggttgcagtgagctgagatcgcgccactgcactccagcctggtaacagagcaaggctccgtctcaaaaaaaaaaaaagttccacaggtgactgatgagccgtcgtgtgagaaccagcgaggtagtgtcagggatctgaagtgattgaaaatgccgcttatatattcaatccttggatccctttgatgaatttttgtattctgctcttttatatgcctgtaatcccatgttttttaaaccattgtgctctggcctttcttgctgtttgagcgtaacttcaactgttattgccgtgagcagtcttctcaagctcctcctgggcccggcttcctgatggtggcctcactgaactgttctgctgcttaccacttgtctgaagcttcctcttttccctttttgaactcttattaagcattgttggcttcctgtttgtacttatatgatgtagctggtactgggtaagaaatcactagcagcttttcaagtaggaaagacggtctgaggtgacagtttaggctttgtaattaggctcagcacttacgagactatttgcagtgtccgctctgtgccatctactttgctgctggtctgtggaggaagcagagatgaaaacaccatctttgctgtcaagaactcacctggtggaagaggcagatgtatggataatcatcacatgatgataaatgccatcgttgttgcaaaagtcataaatattatgacagtgctttttttgtttttgtttttgttttttgtttctttttgagacagagtctcactctgtcacccaggctggagtgcagtggcacgatcttggctcacttcaagctccgccccccaggtttacgccattctcctgcctcagcctcccgagtagctgggactacaagcacccgccaccacgcccagctaattttttgtatttttttgtatttttagtagagatgggatttcactgtgttagccaagatggtctccatctcctgacctcgtgatccaccccccttggcctcccaaagtgctgggattacaggcgtgagccaccacgcctggccatgacagcgtatttttaaaatgaagttactaaatgaaaaatcgaaaatttaatggaagcaagactaaattagtttactgggttgtcttctttaatttacttgtatcctttccgtagacagtctggcacaggtttgaatgtgtcctggctcttcattactgaggctaatatatgcaaaagtgtgtccatcccttctacctttattcacattccattacttttatagacttttctttttttgctttcataattaatactggcagttgactttcttttcaggggtctttcttcacaaacaaattttttccattttcattttctttttttttttttttttttgagacagggtctcactctgtcacccaggctggagtgcagtggggcaatctcagctcactgcagcctcctgagtagttgggaccacagatgcaaaccaccacacccaactgatttttcaattttttgtagagacgggggtctcgctatgttacccaggctggtctcaaactcctgggctcaagcaatcctcccaccttggcctcccagcatgctgggattacaggcatgactaaccatttaaccataaaaaatatttttttagtcacttaaaaagagactttgtcatgttgagggtcagatgctaagttatcagcaggctcagtcatgtccctcttgatttttagctgtggaagagaaatggccccagttcatcacccttctctagcccagcctcatcccgctcccagacaccggagaggccagcaaagaaaataaggtattcggcattctcctgcagttttcatttgctacgtggacagaagggggtgaggaaaggtgggaaacgaacctggctcttaggctttgtgctgctgtgacttggagaatcaaagaaactaagtccctgagagggacaatgcagcacccacctgaacaactatcatccctacagtcttggatactgactccagtggcctctggctgtcgcctcccactccagcatgagggatcgggtgcaagcacagaggccatgcagagtggagagcagagagagtcaagtcagcgggcagtcaccttcaggttcttgactcgagctgatcccctaggtgcttgcagttggctggaatgccactccctcagggatcacatctgtgtctagaactcccagggacttggtaggttgtaagtaaggtttgaagattattgttttgtgcttgttttaagacaaaaactgtcttcatggcctctgtgaacagtctcccttcattctgttggaatttcctgttgactttttttatcctggcatactgagatcttaaatgatggttgttttagatgttggccacttggtagttaggagggtgtgagaaattatttaatacttcagccaagaagtctttctagactaaattgttccttttttcccaacagagaagaagagatgtgtcatcattccagttcttcaactccattggcagcagacaaggagtcccagggagaaaagggtaggttgctgagccaggaggaggggctgctgttggtggtggaggtatttgtggaggatgtagagattaatacctattgaaaaaaggtcttgagcattgctatgtctaaggcatgttagatacaaagagagagatttcctctccttcagaagtttatagtctgatgagggagaaaggctacagacgggggctaacgattggatagaggtaagctcagtttgagtcacctgtgggtgatcccagtaattactgcacagtaagcggtttgtgtgcgcgccttaatcttacaaacaccatccaagcaaccaaaccatagaagattgaatcttttcagagataccatcattgaaaactcagtgtgaaatgcgaagtgggtagacacaaccatccatttctggaagagggaaggaagcaaacgagtcttgatttctttctttagctgcagatacaaccccaaggaagaaacaaaactcgaattctcagtctacacctggcagctctgggcagcgtaagcggaaagttcagctgctgccttctcggcgaggggaacagctgaccttggtatggtcttgtccatctactcctgccctccccggcttagctctcctaagtcttaggaacgctaaggacaagtttcttctgattttttttctaatttatttttgtttttgttttttgagacaacatccctctgtcacccaggctggagtgcagtggctcgattttggctaaccgtaacctctgcctcctgagttcaagcaattctcctgcctcagcctcccaagtagctgggattacaggtgcttgctaccacgcctggctgattttttgtgtttttagtagagatggggtttcaccatgttggccaggccggcctcaaactcctgacctcaagtgatccagctggcttggcctcccaaagtgctgagattaccggtgtgagccaccatgcctagccttcccgttttttctgattggcctgacttcttctttttcactttggtagcctccacctccccagcttggctattcgatcactgccgaggacctagacttagagaagaaggcttcattacagtggttcaaccaggccttggaggacaagagcggtaaggagcacagattgttgcacactggagaggtttcaggtgtctgttttctttggttttattttggtgtttgaaaaaatgggtttctctgggaaaatcccaagtagggttccatgttttcttgtggtctttctcacctgagatatccgtgttggtcttcacgggaactggacagcagggaccactgcaatttagggcaggcattcctccatgagctgtgctgagagcctgctctccgacaggcatgtggaaagaagtcccagacaagccaggactgcttcacctttctttctttcttagatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccaggtgagctggagtggggccgtggatccagccttctgagcagcatccccggcttgggttggaataagggcgtcgtgcctgtcagtcgctggagattgctctgcaggccgaacgcaccctggctcagcacaccggagcgggcccacgtttaacagcgccagagcccgcatcaggaagtgttagagaaggggtgctgcgacgctcaggatctgaagcctggctcgtagctgccctgagcctcgccttcctcatctgtcagatgagaatgatcttcccggtgcagcacctctgaagtgtgaatgtggtggcgtggtcaggatatccttgcctgtcagaaccactggtccagaacagcactgcttcctttccctccagcacttcgagggctgctggtgttcccggcccaggccttcacggcactgcgcgcgcacacctctttatcagacggtaacctggggttcgtacgcactctccctgctcaagggcagagacttccccattcatagttgtgtgctcttagcgcctggcaggtgagcttagtaggcaaataaagtatatctagattcatacgtgaacttcagagttcagacaattggactgtcttagtctctacacattaggcccccatttaggccccattttatccccttctgtctgatgatctgtgaggtggaaataatgaacacttccttgatttactgtacaggcctgtagtgtagacttagctgagtttattgactgactcttggatcccaggctctgtggtaggcgtggggaggacactgaaatactgaataccatcatctttgaagtgtttattccaatttcacattttctattcttcttccagaatctgctggagcagcaaccactgaggccctctcacctccaaagacacccaacctcctacccccgctgggtttatcacagtcagggccgccagggctgctccccagcccctcctttgactccaaccccccgaccactttgctggggctgatccctgctccatccatggtaccagccactgacaccaaggcacctccaacccttcaggcagagacgactaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtctcagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggctgctgcacccacacctgcacctccgtccatgatcaagatcgtgcctgcgcacgtgcctacgcccatccagcctacctttggcggtgccacgcactcggcgtttgggttgaaagccacggcttcggccttcggcgctcccgccagctcacagcccgcctttggcggctccactgctgtcttctccttcggtgcagccaccagctctggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcgcagggggcttaggtcagaacgccctgggcaccaccggccagagcacaccgtttgccttcaacgtgggcagcacaactgagagcaaacctgtgtttggaggtaaggaggggcgtggacttgggctaccgggccggacactgaaaagctgtgcctgcgaagcctgtggtctcggggagcttatgctgtggcagtgaagagacaggcactgaatatagaactcagtgagatgccagggaacgatacatgttttgctaacgtagtaatgactggaggagccattgtggatttaactggtcaaaggccttctgagtagttaacaattgtaagctgaaggttgggcgcagtggctcacgcttgtaatcccaatattttgggaggccaaggagggtggatcacttgaggacaggagttcaagactagcctggacaacttggcgaaaccctgtctctactaaaaataccaaaaaattagccgggcgtggtggtacccacctgtaatcccagctactcaggaggctgaggcacaagaatggtttgaacccaggagttggaggttgcagtgagccaagatcatgccactgtactccggcctgggtgacagagcaagactctgtctcaaaaaacaaaccgtaagctgaatatgggggtggggtgggggtgggcacagcacaagtggacatgcctttcaggcccaggatggcgcatgcaaaggcccagaggcagaaacatgtttggtatgttgaagagcagaacaaagacaagcatggcaggagggcaggagctaaagcagtggtgtggaaggaggccaagaggcaaggattgtttgtggccagggttgggtgtttgggtcttaagtgttcaggaaaaccattgcagaatcaggcagaaggatgcagtgatggttcctcccatgtggaagatgaatgtagatcccatggcttctgtttgcttcgtgaagtagagaaaatctgggagagagagggtcaggataaagtgtataaaaaaaggggtcttttgaaatagtcattttggacagtgggggaaaggaacatcatattaaaaagtgtgatcagtttccaggcagtttgtgggctggaaaattgtgattgtgaagttaaagtgaggccagttagcatggcatgtgtttcccagcgacactgtgggtgtagacctaaggtcagcggacagctggtgccacccggccatggagaccccagcaagcacagcaggaggggcagcgtgtcagtgccccgatgcagctcagggggtgcaggagtggagagcgggtgaagtcagctgcaggaggggtggtgcctacaggagattcgggagccggagcagttgtggtgacagtgtggctgcaggagtggtggcaggggtcggggagaggaggtcatgggggtggcagggtcgaggggctgagaggaccatcagtcagcctcacagggcgaagtcaccgtgagtggtgatggggaggaagccagtgagccaagggtcctctgtgaatcagggagtgacctggcagttgacaggtgacatgaggacatggcagattaaagtgatctgaacttgagttacggtatttagggaaggaagagaaacagtgtggaagcagcgtgggagcacagggagcttcctcttgtccgggccggaggccaagccctgagagcagccatccctgcagaggggctgccagagagggcctcgggcaggcagccagagccagtcagggcaaggccggggaagggagggtaccacggggcatcacaaaagacgcgggacggacaaaccaggcttcagaggggaggggacggtggctaggggaaaaaggcctgaacagaggaggtagccaacccaggtacgctaggaggcgggggccccagagtactcccctctgcagcgatggtcaggaggcccacgaggtggctgcggggcaggggggctttttctctgccctggcgtggccattagcgggtgggagaagcaggctgagctggggcaccaggcatgaagactcggttgtctggctcagctgctgatggaggagtgccccagaagcagaagtggggctgagggtcccgtgggaagtgccctgtggagcacaggctcctgcccggctcctcgcttgcctccgccctctgctcactggctagctctctgttctcttcattccaggcaccgccacccccacctttggtctgaacacccctgcgcctggagtgggcacatcaggcagcagcctctcctttggggcatcctcagcacccgcccaaggctttgttggtgttgcacctttcggtaagcagcaagccaccctgtggccctgctcgtctgtctgaggagaggttgggcggggtggcaggctcctggccctctgaggccccgtgaagatcaggttcagcacaggaaagacatttcgggttaggagtacagcacagcccagggatgggagttggatggcagagatcagagaggagctgtccggggtggaagtttgcctcccatgggaagccaggtaaaaatggattcttgggcctcgctctgagactctctgggagtttgcatttcgggaggcttctcccgtacagtgtttctgatgcagcggggaaagccctattgaggcaccctgtgttttattactggcctggccttccagagatttgggcacccagagccagagtctcaggtagcagctgccctgatgaggtcttgttgaatctttccaggatcggcggccccttcattttccattggtgcgggatccaagaccctaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggaaacacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccattttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgccctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccagcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggtggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagcacctgagctagtttacctcagttccgcaggcaggacagccggtccgggaaccctgagtgagtgtgagtgtggatgtgtacagtacacgcactggacggcagcgggaggctgggactttccattacaaatagagacttcattcctgttgagtctagttggaacttttagtatgaatgtgagatttttctcctgcttgtgacattaagaataaaaaactgtgatctatcgtagagtacgttctgcattttatttttgcaggcaacactttgctcaccagcaagaacacagcccaaggaagggacccaataacctttcaaaacccaaactgcttcctgcggtgagggcccagggtcctccacggagaggacaggcatcttcctttcccaccaggaaggagtcagcccggagcctctgctatgtgcaaggcggtgtgcaagcaccggctgcggctctttgctgtctcttctttctctttggggctgggctgggtgtgcgttctggtgctgatgctttggcctgtgaggctgagctagagaagtgtagatgttagatgtgccggtgccatcctgcgcctcccaagcacgcccccactcactcaccttggcacctcgacccgttcaattacagcaacgaagaagccactgctgagtgtggtctcaggggaggcccggaggcagtgctcggcacccgggaacgtgctcaggcctcggtggggccaggcaggcagggcgggagctagcctgcaagagaaacggccccaatgctgggtaagagagcagctcaccccgtcccccactccccacgaccctggcgcccgccctgtacctgaaggcgcccgggttctgctgcagcgcatctcgcaccacgtcttcattctcctcctggcagagggagcacgtggagtagacgagccgctgcagggaagggaaagtgagcgcgtggcacagggctcgctgctggaaccctgccagggcatgcagacgcaccgggctaggtgtgcctgccccgggctcctccagctgtctgctcggcatacctaaggaaaagagtgtctctgttacatagcttcacaggctacctcagtcctgaaatcctcgcttcacagaggagaacttttgtcccagggtcccaagcccattagtgtcagaagtaagaccaaaacaaatgactccaggtctaagctgctgtggatctgcgagtccctcggccacgctttctcgccatctcacccgagccactgcaggaaggatccagcaggatgtagtggacctcatggtagcgtggatccgagggggagaccgccaggaagtcctcctcagccagttcacagcaagagacgccagcccgggccagcagcgtggccatggatgccagccgcttggcatccaggtcaaaggcaaagatcttcctagggcaaagcaggggtgagctgagcacgcatggagcagctaagggcctgtcacagccaaccagaacatgcaggttaagccaggacacacaatattgaaacggcctacgtttaaagggctcacagtcagaggtaactggcctggggtctctgccccaagggctaagggatccacatctcacacctgcagtggggaaagcttagcttggggcaaataccgtgaactgctttggtgcagcaagaaagacttaagcgaaagtcatcctttcagccttcattacccactgaaaggcacagaatcaaaccccatgtcctcctcctcctcctgtggcactcacccttggttcttcagaagagcagccaagtgactggtcttattgcctggggcggcacaggcatcgatgacatgggagcctggcggggggtccagcagcatggctgggagacagctggcctggcaggcagagcacaggagccaggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatttcctgaatttctccctgccaggccccatttcaacggtccattcatgcaacaaatgttaccacagctatggagaaatcaacagggtgataagctagagatgggcggaatccgcagttgagggaatgggttgtcaagccagactgatgggtcaggagccccctctactgtttaccagcagtgggagcctgggcaaatgattcaatctcaagccccactggcatctctgtaaaatagtaggtgtggggattcaatgagccaatatattcaagatacttatttggcacaaattaataaatgttagctattcctgttgaagcataaccttggaaaaagtttacttttttttttttttttttttgagacggagtctcgctctgtcgcccaggctggagtgcagtggcgcgatctcggctcactgcaagctccacctcccgggttcacgccattctcctgcctcagcctcccgagtagcagaaaaagtttactttacaggggggtgaggggatgcagggaggtgagagctgagctcattcttgatggatgaggagttagtcatgtgaggcgcttaggttaaaactacattcactataactcagtaaaggagtcccgccgactctccgacccatgcagaaataggcctagagagtcacatctctcagttcagaaatctgtcaaagtggcagagctggaattcaaacgcaagcagccgttctctgctattccaccctggtgtccaagcaacatggtagaggcagaaggaagaggatcttacaaagagtaggagaaagggagaggggcagaggctgcttctcagagccaacgaaggacaaaacgagacaggtgtgagcccagtggaggaggcacggggcagggaccagccactgttgctggcacactggtgcacgcagcaccgtggcagatggacctgagagaaagcaggagggacagcacagtggagccaagaaagggcttagcatggccgggcacggtgactcacacctgtaatcccagcactttgggaggccgaggcgggcagatcacctgaagtcaggagcctcgagaccagcctgaccaacatggagaaaccccgtctctactaaaaatacaaaattagccgggcgtggtgctgcatccctgtaatcccagctactcaggaggctgaggcaggagaattgcttgaacccaggaggcagaggttgcagtgagccgagattgcgccattgcactccagcctgggcaacaagagcaaaacccttgtctcaaaaaaaaaaaaaaaaaaaaaaaaaaaagcttagcagaggagtaacagcatcagatctggctttagagcttcctacagtcaacctcaaggaaaatgcagtgagacagtctggaagcagagaaaccagtctgggaagttcttgtggtcatcccaataagaaatgagtgcttaacctaggcagtgtccgaggggctgaagagaaaggagtggaggccagatgtggtggctcacgcctgtaatccgagcactttgggagaccaaggcgggcagatcacctgagttcaggagtttcagaccagcatggccaacatggtgaaacctcatctctactgcaaatacaaaaattagctggacattggtggtgggagcctctaattccagctactcaggaggctgaggcaggagcatcgcttgaacccgggaggcagtgagccaagatcatgccactgcactccagcttggatgacagagtgagactcagtctaaaaaaaaaagagagaaaggagtggagctgagaaagatgctcaaggtaggggagtaaatgattggagggaggagaaggaagcacctaggatgactcagtttctggcttgaccaaatgggtggaagatggtgacatctgttagatttaactggggatgtactaggtgtaaagtctgagaggaaagatgacaaatgcagcgactgttagcatctgtggtgcgttcatatgaacctgaggaggtaagaatgcaagaggggaagtctacactgggtggtgagaatcaccaggtgggaggcaggagttaaagctagagaaaaaacggagagatcaagaagaatgtaggatgaggctcctaggagttcgatgtttaagggatggcaggaagacaaaccttggagatggataaactgctggaaaggtaggaagaaagcccagagagcaaagtcacaactatccagccacttctcttcccaataccccagacacctccctagatgaggacagccagggctctaagctctcacctggaagcccgaccctgataggagaaaccttgtctcttgaaataatcaactacatcatcggagcaggtcttgagagtgttcacacgcacaaatcgaggcagctgggaggctacgtaggacgcaatgagcagtgagtaggcaggagcaaagttccccgcctcccccaccccccaactccttccagcttacctggaccaggcctggatcccacttccaacaggtcctcattccggctcacaccccgatgaaccttgagccgagccaactcagccttgagcctcgcctggtgccggcccaacagagccttccatcggcccccaccccctcgaaagccctttcccaacaacaactcatacactagcacctgggaatgagggaacaaagacaaaaacaaaaatgccctaagcatgaagcatgaatgccttagaactaactctaatggagccccggcaatggaatggctaaacagatcacctgacaagatacaggtgggataccttatccaagatcacaccagaaattaactacagaacaggatcggaacctggcgtctcgcttcccagccttagaccctttctccaccgatgttcaccagtagacacctctgcacccaacttcttgccaacattaccctttcgtgggtttgggttttctttttagaatggggtctagctctgtcgcccaggctgaagtgcagtggccagatcatagctcactgcagcttcgacctcctgggctcaagtgatcctcctccctcagcctcccgagtagctgggaccacaggtgcgcgccgccacgcccgacttccttacagtctccgccactaccactttgtacttcggttatttaatccttcaaaacactcaaagttaaagcattttcatcccatcttaattcgtaacccagggaaggtcggctcatactcatttcagatgagcgacttgctccagtcccgccgtgcacggcagcagagctgagaccagatgacaaagcgctgaccgtcggggttcacttccccgtccctcccctcccctcaccttggccaggtgcggccgcagcttcttctccgcacggaggaggccggcgctggcgatcacagcatccagcacggcggagtagcgctgcgtttcgcacaccagcgcgtacagctgcttcacgttctgtgtggccgaggaagacaagctgggtgggggctcccccggccctcctcgccgggccccacctcccgaccccacccgggcccgtccgaccccaccccgggttcctcactccccacccctactactcgcgcccaggtccgctacctggaagttgctggagtacaccaaccccttgatagagccctggcggctctccacgccggccaacacgcctgcagctgcagcatacagccccatgttcccgcgcgcctttacggctctgtggcaaaacgcacccggctcggcgcccgcccggacttccggggtcaaaaagcacgaccttccgggaccggaagtgccggtcgaagtcgccctgcaaggcgtgtgtgtgatcgcgcacctgccggggtagggagtgcgacgctgcagcccgtttcgccacttcttctctggttcttaagtttttgccaatctgatgggcaaataatgggattttactgctgtttaactgaagttactgaggttaaatatcttcacatgtgtattagtcattatatatatatatatatatataatttttttttgacacagagtctcactctgtcgcgcagtgtcgcaatcgcggcacactgcaacctccgcctcccgggttcaagcaattctcctgcctcagcctcccgagtagctgggactacaggcccacgccaccacacctggctaatttttgtatttttagtagagatggggtttcactatgtttgccaggttggccttgaactcctgaccttaggtgatctgcccaccctggcctcccaaagttctgggattacaggcatgagcccccgcgctggccataattttgtgtctccgtttattgtcttatcttcctctgccatgtgtcatccaatggctgtgttctcagggaggcttctgtgtaatggcaaaaaaggtcctagcaactctaggtccacaatgtggtttacaatacctgccattcaccctgcaccagtaaccacattagtcccagagccaagcaagaaagcacgtggggtatttgggtacctgaaatgggccggtttggccaaattaagtgatgtaggtatgatccaggcctcaaagccacaataacggttttgtttttgtttttgatgaggtcccactccgtcacccaggctggagtgcagtggcaccgtcatagctcactgcagcctcaaactccagggctcaagcgatcctcccacttcactctccaagtagctgggactacaggcatgcaccaccactcctagctaattttatcttttgtagagatgtggtctcaccatgttgcccatggatggtctcgaactcctggcctaaagtgatcttcccacctcggcttcccaaagcagtgattacaggcatgaaccactgtgcccagcgaggattttattcttttatcttgaaagaaatggtagtcctcttaaggtttttaagtcatggagtgctgtgctaacatatacttctttaaaagatcagtctggccaggtgtggtggctcacacctgtaatcctagcactttgggaggccaatgcaggcagatcacttgaggtcaggagttcaagaccagcctggccaacatgacaaaaccccgtctctactaaaaatacaaagattagccaggcatggtggtagacacctgtaatctcagctacttgggaggctgaagcaggagaaccatttgaacctgggaggctggggttgcagtaagctgagattgtgccactgcactccagccagggggatagagcaagattctttccccaaaaaataaataatcagtctggttacagtgtggggatataggatggagggggcagagttgaggcagggagagaccaatgggggtcatgggagtcacctaaacaagaactggtggcctggactgagttggtggcagtggagttaggttgaaattggcagtgtgaccgctaagttaaatccacagaacttgctcaggaaaaaggacaggtcgagaataactcgtaggttttcagtttgggcagttcacacaatgctgctgtgtcttttggtaggatggggaaacgtggggtgatggagtgaacaacggccacccagagagagcaggtcctaattcctagagcctggaaatgtcaccttctatggaagagatctgtaggaatgatcaggggaaggatttggagagaaggttatcctcgattatctgggcaggtcctgcatggcatcaccagtatccctataagagagaggcagaggaaggacaagcgcagtgactcacacctgtaatcccagcactttgggaggccgaggctggcagatcccttgagcccaggagttcgcaaccagcctggccaacatggtgaaaccccatctctactaaaaatacaaaaatttgccaggtgtggtggtgcatgcctgtaatccctgctactcaggaggctgaggcaaaagaattgcttgaacctgggaggcggaggttgcagtgagctgggatcataccactgcactccagcctgggcaacagagcaagactctgtctcaaaaaaaaaaaaaaaaaaaaaaaaaaaaaaaaaaaaaataagaagcagaggaagattagaccggcacatacagaaaaggccacgtgaagacggaggcagagattggaatgatgcggccacagggccaggaaacaccagggcatggcagccaccacctgaagctgaagaggaaaggggcaggttttccccgacagtctccagagggagcgcggccttgccgtcatcgtgatcttggacatctggccttcagaaccatgagagattaaatttgtttgaagccaccaagtttgtggtcatttgttacagtagccacaggacaccacagccacaggataaatctcagggatgggggagtaggaagatcatgagcgcggttttggacatgcccttgacgtccaggcggagctgctgaatggctggagcgctactggatgtggcatgtaagggacgggtctcccggagagggaacttctgagtcatccctgtggaagtgatgactggagctatgggtgtggaggggtagacagccagaagaggagcctggaggtcctcaggccatgagtggccaggaggagaggctgaatccttgaaggagactgaggagaggagggaggaaagtcaggattgtggggaggctgagggttgctgtttgccccagctagtctccctcaggccctcttattggtctgtgcacccagtttgacttccagtggccagagccagcatcttggttagagggctaccccagagcttccaggacccacttagcctgtgggtatggtgagtcaaaggggtatgacagcctaggcacagtggctcacacctgtaatcccagcgctttggcaggccaaggtgggaggattgcttgaggcccagaccagcctgggtaacatagcaagatcccgtctctactaaaaatttaaatattagctgggtatggtggcagacacttgttgtctcagctactcaggaggctgaggcaggaggatcacttgagcctgagaggtcaaggctgcagtaagctacaattgtgccactgctctccagcctgggtgacagagcaagatcctgtctctgaaactagactcgaggctgggcacggtggctcacgcctgtaatcccagcactttgggaggctgagacaagtaaataatttgaggtcaggagttcaagaccagcctggccaacacagcgaaaccccatctctactaaaaatacaaaaattagctgggtatggggcacatgcctataatcccagctactcgggaggctgaggcaggagaatcacttgaatccgggaggtgtaggtttcagtgagcctacatcgtgccactgcactccagcctaggtgacagagagagactccatctcaggaaaaaaaaaaaaaaaaaaaagactcgagcataaagcagtatgtatagcaactaatatgtgcaaatcatttaaagagaaagaaataatgtcaaatttattatccttgatagtagttgaaagttcacagtaatatggaaaaggtatacatgggactatttctgccctcggaagcgtctgcgcagatagcatggttagcaagtggcaggaaccatggggatttcagtgtgtccctggctgccaaggcctgggggccgaagtttacaaatacacccttggctgaggggaaagggactggggtcctgttccctatcattacatgttccagggacacacaggcctgaagaccttcctaaacagtgacgatatcacctcaggcgggacccagcagaagcccgcgagtccccggtgccccgccgggatgggcctgtgggccggcaggactccgggcggccctacagcttggtgggctgctcggggctgagggggccaggcccgctgggcgggggcagcaccatgggcagcgagttgctgcccctctcgtgccagcaggtgtccaggatggggtagagcttgccctggaagtcggcctggaaggtgtagagcggccgcaggtcatcggggcggtcggcatcgaagaaggtgagttcgccctgctcatagtgcaggtagagcccgatgcggtgggggtggccggccacgggcaggggtacccgggggcaggcaaaggcttcgtacacccggccctccttcaggccgatcagccacacgccgtgctcgggggacctgttcagcttgcccttacggctggctgtgcccttgatgacccccaggcgccagtcgctcttgctgcccaccaccacctcccagtagtggcggccgcaggagaagccgcggctggccaggacgcaggtgctgtagtcgaagcgctcaggctggctggctcgccgctgggccagaagcccgcactgcaccaccgtgttgcccttggagagctccaggagtgggtgggcagtggcagggtccaacttgagaggctccggggctgggagggagatcacagagggtctgtgaggccacgtggagggcagcagacccggcccacagaagctgatggaggccctgaactccccaaggagaggggctgtgtcttcctcatctctctagccccagggtctagaaggggccagtacagggctgctccctgaatgaatgaatgaatgaatgaatgaatgaatgaatgaatgaagttttacataaggaagatcaatcacagactgattgcatccacccaaggcaaaaacagtgtttatataaaagggagcagcttggtgggctgtggggggctgaggtggctggagaaagaaatggacactgggctcggggttctggcctgcctgcctgacacagaggtgttgtgggaaggacccggaagacacctgtcctgtgagcctatagctcagccctcagggatttctggagaacccataacaactgcagctgttggatttgctagcctagtcagcctattcaaggacgaactagcccacctgagctttttgctagttaccagctgatccgtttaccccagaaatgtgagatgtgctcccccctgcccgcctcccaccccttcccgccacccaagttgccgcaaggaaagaaggccaaagggaagaaggtggctccggcccctgctggcgtgaagaagcaggaggccaagaaagtggtttatcccgtttgagaaaaggcctaagacttttggcactggacaggacttccaggccaaaacggacctcgcccactttgtgcaatggtcctgctcggtcagggtgcagtggcggacagccatcctctataagtagcagaaactgtctcctgctattaaccagttcacccaggccctggaccgccaaacagctattcagctgcttaagctggcccagaagtacagaccaggggcaaagcaagagaagaagcagagactgttggccctgactgagaagaaagctgccagcaaaggggacgtccccactaagaggccacctgtccttggagcaggaattaacaccgtcaccaccttgatggagaacaagaacgctcagctgggccaggcacagtggctcatgcctgtcatctcagcactttgggaggctgagacaggcagatcacttgaggccaggagtttgcaagcagcctggccaacataatgaaaaaccccgtctctactaaaatacaaaaattagccgggcgtggtggcacacgcctatagtcccaactactcaggaggctgaggcagaagaatcacttgtacccaggagccagaggttgcagtgagctgagatcacaccactgcactccagcctgggtgacagagactctgtctcaaaaaaaaaaaaaaaaaaaggaaggctcagctggtggtgactccacgcaacatgggtcccatcaagctggctgtcttcctgcctgtgcctgtgtgtaaagtggggtccctgactgcatcatcaaggggaaggcaagactgggatgtctagtccccaggaagacctgcaccactgtcgccttcacacaggttaacttggaagacaaaggagcttgggctaagctggtggaagctaccaggaccaattacaacaacaaatgtgatgagatccgccatcactggggaggcagtgtcctgggtcccaagtctgtggctcacattgccaagctcaaaaaggcaaagactaaagaaactaccactaaactgggtaaaacgtacactgttgagttttctgtacatgaaaataatacaaattttccttcaaaaaaaaaaaaagaaatgtgagatgtacaaacaggattcacagttcacaaactgcaatttttttccttcttatctttcctttttttttttttcattcttttcttttttactgatgaggtctcctctgtcacccaggctggagtgcagtggtgcaatcatagctcactgcagcctcccaactcctgggctcaagcaatcctcctgcctcagcctcctcagtagctgggcccacaggcacataacaccacaccccactaattattttttgtagagatggcgtctcactatgttacccaggctggttttgaactcctggcctcaagcagtcctcccaccttggcctcccaaggtgctgggattgcaggcgtgagccgccgtgcccagccccttcttttatataaaccctatttttgcttttggtggatgaaatcgctctgttagcagtctcccttatgtacaagacagcatgctagtaataaaggaatgaaatgtgtttgagttgtttttgacagagaacaagaataggttggttcaaaagtaattgcggtttttgccattactttgaagaccacttgtcctttgagtaggaaggacatttttaaaaggatattacttttttttttttttttgagacggagttttgctcttgttgcccaggctggagtgcaatggcacgatatcaactcactgcaacctccacctccctggttcaagtgattctcctgcttcaggctcctgagtagctgggattacaggcgcacactaccacgcccggctaattcttgtattattagtagagacggggtttcaccatgttggccaagctggacttgaactcctgacctcagaagatccgccctcctcagcctcccaaaatgctgggattacaggcatgagccactgtgcccagccaaaaagtacattacttttaaaagtaatggcaaaaactgcaattacttttgcaccaacctaataccatttatgaagcactaagctgcaacacacgtatgtctatatacaagctctgcagcctggccgggtgggtgcaaatagccccactttacagatgaggaacctgggctcagaaatgacacaacttgcccagccagcagctaggaaaggaaagagtaagcaggaacccaagctgttcggaaactcagtcccatgctctcactaggaccctccacaaacctccatctgagttctctgtagcttattatctctctgatacaatcgatgaactgccacctgccctgggcggcagccctcaggaaggaggacgggtcagggcctcacctggcaaaactttccggaagagccttttccacacggtcagcttgatgtcagcctggtggaggcctggcttgaaggagatggggctgaatgcgccttctaagggccgggcctgcggcatctctgctctgcaggtgacagttcacagtacaagagagtgaggtatcacgtggcccaccccacccctccatcctatctatgtttgcccagccagatccacagtgcaggactgcagtcacaatgcccatcaatgcccatcatcccctcccctgcacagccccttcagggaggacccatctccttcctagaaggggaaacgctctatagtggtgcttctagagtgcaggtttggggaccagcagtgttggttggaaaatggtccaacccattcccagtagaaagtcaatggtccacctgggaaatggtcagaaatgcaggttcttagaccccacaccagacctgccaatcagaaaccaattatgggggccaagtaatgtgtcttttttttttgagtcagagtttcactctgtcacccaggctggagtgcagtggcatgatttcgactcagtgcagcctcaaccccctgggctcaagtgatcctcccacctcagcctacctagcagctgggactataagcatgtgccaccatgcccagctaatttttttctatttttggtagagacagtttcaccatgttgcccaggctggtcttgagctcctgagctcaagcaatccacccaccttggcctcccaaagtgctgggattacagctatgagccaccatgccaagacttttttttttttttttttttttgagatggagtcttgctctgtcgcccaggctggagtgcagtggggtgatcttagctcggtgaaacctctacctcccaggttcaagtgattctcatgcctcagcctccccagcagctgtgattacaggtgcctgccaccacacccagctaatttttgtatttttcatagagacggggtttcaccatgttggctgggctggtctcgaactcctgacctgaaggcatccttctgcctcagccttccaaaatgctgggattacaggtgtaagccgccatgcccagcctctgtcccttcatttaaacccatgtcttctgaccaaattgtctctaagactaaaagaaatgtgagaaacacggagtctcccataaacagggagtgaggaaggcttgggaactgcacgtgttcgtttgttgggtctagaacatggatccactctcttcccacaatctgcagagcaagtttcaggcagggctgatactgcctgctgcgcaagggtgaggagggtaagcaagggatgcccggtgctcctggatgttgcttctggccatttcccacctctcccagctccgactcctggtgatatcctgccttacacccagccaccctgaactcataaccagagtccacatgccactcccccttttacaggaccgtttcctcggcttgcctggcaaactcaggtcctgggtccttctcagccatcaggcctgtgcccctctgccaggtcccccagacacctgctcctcctctagcattctgttttgttttctgagacagggtctcgctccgtcacccaggctggatcatgcagtagcatggtcacgactcactgcagcatcaaacttctgggctcaagcaatcctcccgcctcagcctcatgagtagcggggactataggcacatgacaccatgcccaactaatttttttatttttgtattttttgtagagatggggtcttactacattggccaggctggtctcgaactcctggcctcaagcaatcctcctgccttggcttcccaaagtactgggattgcaggcatgagctaccctcctctagtatttctgtagcttgagtgaacttctgctgttctaggtacccacagttcaccatctgcctccccacccatctacgagacccttgaaggcagggacatgactttcctctgtttttcccaggctcagttatagagccagctgtgggcagctgcttgggaggcgctggttaaaccgaatggaggaaccagtggagctgagatgcccgtgcccgcagccaccagaccctggctgagctctctccaaggttattacctggaggccatggagtggaacttctggaaggcaagagagagggaggttaaggctagaaggtgggaagctagggcactgttgggaaggggaaggccctggcgggtatggggatgggacgcctccctgtccactcacccggatgaacttgtggtggtcctcattgccgaactgttccagcacacactcggcttgggccagccgctcccgggttccctgggcctgctccagctgcatgtccagggaggccaccaggccacgggtgtgaccccctatcccctccaggcagcgggccttctcctcatccaccaggtggtgcagctcctggaactcgcggcggatcacccagctgaagacatccgactcattctgggacagggagggctggtcactgcagagtcacagccgagctgccaggctctgtctggctggcctcggtgtccccagggccttcctgaccgggttggtcctgggacctgagtctcaggggaggctgcatggcctggcgccgggcagggagttcaccccatgcatggggagccctggcggtggccgtggggagggtgaccccagctcccgtttcaaatggagaggctctgttttggcctgttttaatttttttttttaagagacagggtctcactctgttgcccaggctggagcacagtggcatgatcatagctcactgtagccttgacctcccagcctcaagcaatcctcccgcctcagcctcccgagttgctgggattacagatgcacgccaccacaccccactttgcctatttcagctattaaatgtgcatatcccagagttccacaactgaaggaaagcaggaaggccctaggcgagcaggctttgctgtgagggagccagaactccctgcagaaccctgagctccgcctccaccaggcagggctggtaccgcctgccgcgcaagggtgaggagggtaaatgagggaggctgagtgctcctggatcttgcccggctcctgtttctgtttcacagccacctccagggccggggcactatggctcccagccccatgtgcctctcacttcgggagatcagccagggcccagggctgccagcctctccacgcctgagcacccaggtactgggagggcaccatgacaggctggcaaggtcaagcagacacaggtggcacaggggcggaggagtcatgcccatgctttgagctgtttaccccctgagactcaagtcctgggttatctcagtctcaaggacacagagggcaaaagccaacttggagccagtcctaacgacaactgggttgaattcccctgagaggatttgcgctttccccaccccgccctgggaatgctttgagttctggctttatatggaaggcatggttttctgtaaaggaccaatgagaactgagttctacaggaaagtgaaggtggccggtcccaggcaggggcagagggaaggggcactcacgacgattcgggtccggttgttcaccagtttggcgatgagctcatccacctttttctgctcctgcttcagctcagagatgagggctgcgagctcctcctggaggcaacaggccatggccccatgagcagctgatccctccccttctcagctccttggatcaccttcttgggagtatcccaatggccacaagcactcccagggaaaccagggcgggaaccagagccacccaggtacccttgagtccaaaacaggttaaattgttcgagaatagtctgggcgcagaagctcacgcctgtaattccagcactttgggagactgaggtgggacttcacttgaggtcaggagttcgagactagcctggccaacatagtgaaaccccatttctattaaaaatacaaaaattagccaggcgtggtggcatacacctgtagtcccagctacttgggaggctaaggcacgagaatcgcttgaatctgggaggtggaggttgcagtgagccaagatcatgccactgcactccagcctgggtgacacagtgagactctgtctcaaaaaaataaaaataaaaaataagataaattaattcaagaatattctaggctgggcgcagtggctcacgcctgtactcccagcattttgggaggccgaggcgagtggatcacctgaggtcaggaattcgagaccagcctcaacatggagaaaccctgtctctactaaaaatacaaaattagccaggcgtggtggtgcatgcctgtaatcccagctactcgggaggctgaggcaggagaattgcttgaacctgggaggcagaggttgtagtgagccaagatcgcgccattgcactccagcctgggcaacaagagtgaaactccgtctcaaaaaaaaaaaaaaggaatattctaggctgggcacaatggctcgtgcctgtaatcccagcattttaggaggccaaggtgggagaatcacttgaggataggagtttgagaccagcctgggcaacacagtgagatcccatctctaatttttttttaaagaatattctgcattgacagcaggaacttcccaggcataagagggtctcaatgtcacccctctgcatgacatggagagagtcactaaacgttacagctaccagaagtcaccatgtgatgctggcacttcctggattgaatgctgcctgtaggggacccatcaggtgaactctgtggtcaccagcagatccagaattagtgggtatttaatcaggagccatcacaaaaaggccggcgccaggtgaggctaattctagggccagtggtgctcacacgggcctgggttaaacctggtgaatccccacacccataaacacctgaatccattcctggtgggcttggacacagcacggatttgcgacctccccaagctgacataaatgcacttctcctggactgcccgggccccaaacctgacctagccttgggggtgccaaccgggacccctggaccaccatctactgcacgatttgaccagagcccccgtcggtttgtacccatgcaatatacagaatttttggcttggatcgtgcccaagcaccagagagctgcaaggggctttcaggaagggagttgcgtaaagaatcaagcacttgctggcataaacggacagagtccttgctctggagaacgaggcatcagaatatttcacagcggcccaagaacgacattccaatgtcactctccccaggcagacagacgggactcattccttccccgtgagaggaactaagttatgcaaatcaatgcacccatcaatcgagcatctcaaaatctcaataaacaggaggcaacgggaacacctaaaagagggcaataaaggagtgcaatttagttgtattctgtgttgcaacagagaagagcctcgggatcatcaaaccccaaatctggccgggtacagtggctcacacctggaatcccaactctttgggaggctgacgcgggtggatcacgaggtcaggagatcgagaccatcctggctaacacggtgaaaccccgcctctactaaaaatacaaaaaattagccgggcatggtggtgggcgcctgtagtcccagctacttgggaggctgaggcaggagaatggcgtgaacccgggaggcggagcttgcagtgagccgagatcgcaccactgcgctccagcctgggcgacagagcgagactctgtctcaacaacaacaacaacaaaattaagcccaaatctaaaacagggacccaagctgggctgctggatcctaaccacaaaggacagataagctcccagcctgtttccctccctccttcccattaactaataaaacataaactcggcttcctcacctgcagtcagcttccaccttccatactcccctaaacctgctcttgccaagataatcagttcttactgctacatctaacacttttcagtcctcagagacatttcacacacgtgatctccttcagtctctgtctctctgatttccgggaggccacactcagctggtgttcccgctctgaggattctttctatcccttttttcagggctctctctcaatccagattttaagcctggtaccccttggggtcatcatcagtgtcttcccttatcactatgtagactctcctgggttggtcttctccaccaaaggggacttcagtgaccaccaggaggaaggaccctccacacctctcgccctgagccccaccgctgtcctggtctgcacacccctcgacccgactgcacatatccaggcacctccggctccacctgcccacgccggatcctcccctgcgatcatttcctctgtgcaagggggaatcacagagctggagtcaaccttcccgtccctcaccctccttgccacacacagttgtcagggtttttttctgtttgaaatttgtctttggtctgccccaggcctttgtcccagttcccatcgacttaggtcctggcaccttcatctctcactgtccttttgcctcaccctcaaagctcccctctgccagagagatctgagcatttcatcactggcttaaaaccctccagcctccgccttgctccctcatcctgtgaataaactccaaatcccttcccgggtcacactggcctctccatgccccagccgcagcttacctcgctggccctatctcacccccaccgatgttccctccagccttatgctgggattacaggagtggccactgtgcctggccaacaaggctaattttgaaacttttgtagaggcagggtctcactatgttgcccaggctggtctcaaactcctggactcaagtgatccacccacctcggcctcccaaagtgctgttattataggcataagccacccagtcacgtgttttataacaggtgttttatatatataacagccagccaggtattattattactcgtcttaaagaatgatctgctaggtttggtgatggcctataaaggcaggaattcactgattcagcattttggacatttacaatgtgccaggcatggctccaggcactgaaatacaccaggggacaaaatgaagtccccaccctcatgcaccatagagtgcaaacaggggagtgtccagacacaaacaaggggcctagggcagtggtgcatgcctataattccagcactttgggaggcccaggcaggaggatcattggaggccaaggagttcaacaccagcctgggcaacataacaagaccccatttctacaaaatatgaaaaatgagctgggcatggtggtgtgcacctgtagccccagctgctcgggaggctgaggtgggaggattgcttcagcctaggagttggaggctgcagtgagccatgatcacaccactgcactccagcctgggcaacagagtgagacgctgtctccaaaaagaaagaaaaaaaagaaaggagagagggagagggagaggaagagggaagagggaagagggaaggagaaggaagaaaagaaaaaggaacaaaccagaactgcaaataaaaaaacaggaaggggtgagcacgtgacaccagggagctcccatcctgttcgtgtggcttcaatccccggcacctgggttgagctgcagctcaaacgctaaggaatgaatgcgccagggcacagctgcagggaaatcgaggatagctggatccttttggtgccaggtgatggcaccagagagcacaggatctggtccccgcggcctctccagccgcccctgcaccctcactccccaccttcatgcggctgtagacggtggagacgggcgtgaccgggtggtgttggtgggagcccagcagaccgcagaggccacagatgagctcctggtccttctcgcagaaaaggctgagcgggttccggtggtgcacgcagaccttgggctccgggtccccagggagcctcagggcttcgatcaccctggccagggagacgttgggcagggagctgctgccgtccaccgcctgccggcacacggggcagcgcagctcggcatccaggtggcaggacagggaaaccaggcagcccttgcagtaagagtggccacactgcagcatcaggggctccttgaagacctccaggcagatgggacactgaagccagtcctccagctccagcaggctcacctgccaagccatccacactcactgcccgggctgaaacacaggcatccgacctcagtcctgtcccctcccctccccctgtccagcactcatccaccaccctcaaccctaaggagcaccagaattttagaggaaacactttgagtcctggatcccagtcctaacccacatgaccttgggccccagtttccgcagctgtaaaacaaaagactgcagtgaaaaaaactggtcccttgaagatatgtgtgtgtgtgtgtgtgtgtgtgtgtgtgtgtgtgtgtgtgtgtctacattttttactcaaatttggagacaagcatgaaaggggccatctgcagggtcatttgcagtgacactaataatgcaaggtccagccccagcatgcatccggacctagaactgaacagcaaaacctaggcaagctccccaccttctagatcagttcccaaactttcgggaaactgttgaaagcataggtgtaatagagattctagaggcccaccttcaaaggatcttcttcagggggtctccagtgagacccagaactctacacttataggtgacactcccaggtaattctagagagcctggaacctacaaggcctctaccctgatctcccacctgctcccctatgaaagcttgtcaatgagacagaagcagcaccagcagcccccgggggagcctgacattggaatacctggcttctcacaatccgctgggcctcccactacagcctcaagccagcatcactggctttccttcttcccagcagggaacagcaggcacagagtcagaagtgggaaatgcagctggacgcctgcaccactgcctggtctctgccccttctctcctcccctttcccagcaacacccctgtgtccccaaggtcaccagaatcaggtggaaactgggttacatcacgggactggggaggcagcctttgttgggcctgctctgataacattcaggtgctggccttggccactgtggaggaggggcagaaacagagggactgggtacaccgtccacacctcatgaccccaacaggagcagataggtgctgggaaacagttctttctgaatctcaaactcttgctcttactctcctttttttgggcgggggggctggggggtggggaaagacagcttgttgctctgttgcccaggctggagtgcagtggcgtggtcatagctcactgtagcctccaactcctaggctcaagccatcctcctacctcagctgcctgagtagctgggactacaggtgcatgccaccacgccaagctaatatttaaaaaatttttttagataccgggtcttgctttgttgcccaggctggtcttcaacttctgggctcaagcaatcctcccaccttggcctcccaaagtgctgggattacaggcgtgagccttactgcacccagccttccctctctctctctttttttctaatacaaactggcagatgatgattcaatctctctattttttttcattttattgttttatttattttagtagagacaggggtctcgctttgttgcctgggctggttttgaactcccggcctcaagcaatcctcctacctcagcctcccaaagtgctgggattataggtgtgagccaccaagcctggcctctttttttttttttttaagatattcaaaggtatccttatttacttagattttttaaatcaaggtataacatatacaagtgtgcaaatcttaaccacacagcttgataaacacttgatgtatatacacccactctcaagaacaagatgtagagtgtttccagaaagctccctcctgcctcctcccagtcataactcctaacaaggacagccactgtccttattaccatgttgtcatgtggactgtttttgaatttcacataaacagcatcatatagaatgtactcttttgtgtctggttactttcactcaataatattgaattgtgagttttttttttaatgtgaagtctttcaacgtttagaaattcaatgacactctgttatacaggttttgtttgttttctgagacagagttttgctcttgttacccaggctggagtgcagtggcgcaatctggctcattgcaacctccgcctcccgggttcaagtgattctcctgcctcagcctcccaagtagctggggttacaggcgcctgccaccatgcccggctaattctttgtaattttagtagagatggggtttcatcatgtggggcaggctggtctcaaactcctgacctggagcgatccaccggctttggcctcccaaagtgctgggattacaggtgtgagccaccgcgcctgtcctgttatacagttaatgaatattatggtcataatatactgctgtggtttgaatgtatcctcctaatttcatgtgttggaaacttaacccccaatggggcagtattgaaagttggctgtagcttacgcctataatcccagcactttgggaggccaagactggaggatcacttgaagccaggagttcaagaccagcctagcaacaaagctacaaaccatctttccagcaaattaaaaactaaaaaataaattagctgggcctggtggtgcagttctgtaatcccagctactcgggaggctgaggcaagaggatctcttgagcccagggagtggcggctgcagtgagctgagatccatcactgaactccagcctgggctcagaacgagcctctgtcaatcaatcaatcaatcaatcaatcagtgtcttgtctgggcctaaattctctagaacacaatggaagagagaaagtgaaagaaggtggaagtaacccacagctgggagccctgaaccctgctggtggcaggtggctctcgtgtcctcaccaggttgccctgcaatcacatgctgcatcctttttcctgaacctgccccacgtgccccaccacgcagccactccgagggctccttcaagggcggcagccctgtcactcacgtgttccaaaagtgcttcccctgtgccctgatggcctcgccatgtgtctcatcatgccccacgcgctcccactgtgcgccccacctcgcacccgtgccccatcatgctctgcgtgctcgttaggtgccccatcatttcccgctcgctctcgttacgtacccagcctccggcccctgtaagtgccccatcgtgctctctgtcgctccagttagatgccccatcctgccccgcgagctccaattacgtgccccacctaaccccccacgtccgtgcctcatcatgacccgcacgctatggttacatgccccgcctcgcgctaccgcgcgtgccccatcatgctctgcgcgctcccattacgtgccgccacctcgcgcccctgcacgtacccaacgtgccctgcgtggtcccgttacgtgtcccatcatgtttcgtgcgcttccattacggatcatacctcgcacctcaccgcgtggcctctgtagttccagagctcgcgagggccagggccgttggcggcggttggaacgaaacgatgagtgcctcctcgtggccccagaatggaatgccgccgtcggtaggggtctgccgggcataaaggggccttcggaaccccaccagagtcacagccagggagggcagcggggcgcaccaggccgaaggctcacgccacagggagggcagctaggacatggggggaagcgcgttaaaccagggagtcctggaaggggacgacgcccccggccaggtgagggcccagacgtttcgggggcgtagacgctgaggggtggccgggtgggtctgcggctctgaggcctggctttcattctccatcagtccctgtacgagcggttaagtcagaggatgctggacatctcgggggaccggggcgtgctgaaggacgtcatccgagaaggagctggagacctagtggcgcctgatgcttcggtgctaggtacgccctggggcggtttgtcctcaggatccatgtcatcgcactctgttgggaagagagaggcctcattttcaaaaagcacttaatggggttggaaatgctttgtttgaagtggatttttgttttttgtttttgaaacggggtcttgctcagttgcccaggctggagtgcagtggtgcgatcatagctcactgcagcctccacctcctgggctcgtgattctcctgcctcagcctcccaaataagggatttacaggcgcgatccaccatgcccggctaatttttaatatttttgtagatatgggggactctatgttgcccaggctggtctcagactcctggacccaagtgagcctcccacctcagcctccccagtagctgggattacaagcatgagccgctgcttccggcctgaattagtttttttaagacgaaagctagggactcctatgtcccctttgtgtgatgcttccgcaaagctcttgaacctctgagccaaagggccggcacccaaaatgcagagagaagatttattcctgtacctcggggtgtcgggcagcttaagctcatctgttcacattgtttctgtgtgatcatgagagactcgatattatggtggcgtgggtgtttttggtccattttccttacattctttcttctatcctagtgaaatactcgggatacctggaacacatggacagacccttcgattctaattactttaggaaaactcctcggctaatgaaacttggagagggtaggttcagagtgggagctggagaagaaggaattgtttaggggctagatgaggcacgatgcctcaggctgggaagactgctcagagcgcaggttctttgagttggctttgctgaggctgggttttggtaacacagccatgttctctccccttgagacctaggcatttgggagatggcttaacgggcaaggtataatctttgcactctgacttaactaaccactgggaatgtttctttgttcatttattaagtaaaactcaatcgaatacttacttcccacaatacatggtgaaaagagaggatgtactcagaagattagaacatctccacccttaaggacctcacaatgtagtggaggagactgacctgcactcagctcacttggtagaatcggatgagtgcctgggaggtgaaagcagtgttgtgggtgtgcttaatgaaggcatgattaattctagctgggaggttcagggaaggcttcctggaagtgggggcatttgaactgagcctggaagtttgaataaaatttctatcagtagaagctgggcacaggctcaggaggaagacattgcaggaagagggaactgtgtgagggagacatggaggccagagtactgctgacttagagggggaagaaactgatagcactgagcaggatactgagcaagcttcacccaccttctttgtccattcttacagatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgtaagttccagagcacagatgtcagcactttatagagagacgaatgggttggtgttattggtaattcttctagatggcctgccctgaggctgatcgtcctctccagggtacccccgcggctcctgtgcggtggcggcggagttcctctgcttcctagtctgtgtttgtcttagtaatggctctcatgtgtagataaatgtgctgggcaaggtaaggctgtgagtttaaggattagtggtttgaactgatttttcagtcatcctttgcctagttctccctgtgagacagtgaacacttgcttttcatcgtttggtttccagcaaggcaggcattggtagctcataactagggtgactgaataattgattgtccagcccagcacaggtgagagtaaaaggggctgttcactggaggggttacccatgacatcgggtttaaactgagacagtcccaggcaaactgggatgtatggccactgtcctcaccacttaagtcttgcctcctctttgtagcctttcacttaaccctgtcccgtagatgcagggcttctgaccccgtcagcagtcacaggcactgtctttatcatgctgtctcacactgactccatctgtggccttagaggtccatgccagggtttatatcttcacatggagtctccccagctaaactgtcagcactccaagtgagggagctcaccctttttcatcattctgagattcgagtttcttgcaaatgcctcgtcccacctgtggtgaactcatttaggatctggggggtggggccgggaccagagaggctctatgggtgactctgaagatggccagggcagagcatcatgaccataaagactgccagggccctgagcaaaccaagacctgttcagtgcttggtggccaaatagtggttttgagcactgacttctgtgcttggcaagttccgtcagtttttgattccatgggacactgcttcctcagagaacatcaggggaagactgaagacgtagacttccttctggctctagggtgtaaaatgggacaggttataacactggtgtggcttctgtcagattcagaggtgactccaacacagaaggctgtaaacagaagtgcatgatctgaaaaagaagagctcacagctgtagtaacacttcctttctttcaattactatttttttaaatggagacatgttctcactatgttgcccaggctggtctcgaactcctgggctcacgtgtactaacacttccattgtggcattactgcttttggtttccttgctgaatattcctgtctctggtcctcaggagcagcaagaccaatttccacttcagaaggtcctgaaagtggcagctacggaacgggagtttggcaactaccttttccgccagaatcgtttctatgatgccaaagtgagatataaaagggtgagaatgctttgaaagttaagtgtaagtttagatcctgaaaacttccttgtttaaaaaacacagattttgttttgttgtgatttttgttttgttttgtttttgagacaagagtgtcgctctgtcgcccaggctggagtgcagtggcgcaatctcagctcactgcaagctccgcctcctgggttcacgccattctcctgcctcagccttccaagtagctgggactacaggcacccgccacttcacctggctaatttttttgtatttttagtagagacagagtttcaccgtgttagccaggatggtctcaatgtcctgacctcgtgatctgcccacctcggcctcccaaagtgctgggattacaggtgtgagctaccgcgcccggcaaaaaacacagatttttgtctttctccctactttctatgagcagccattaagaaaaatctcatttaaaaaaatcctcatgccaggccaaggcaggtggatcacctgaggtcaggagtttgagaccagcctggccaacatggtgaaaccccgtctctactaaaaatacaaaattagccgggcgtggtggtgggtgcctgtaatcccagctacttgggaggctgaggcaagagaatcacttgaacccaggaggtggaggttgaggttgcagtgagccgagattgtgccgttgcattccagcctgggcaagaaaggcaaaaaaactcccatctcaaaaaaaaaaaaaatcctcatgccaaagggataagtactggagaggggactaacggggggataagggctgaagaggggactctcgaggggataagggctggagagaggactcacgggattgggaggcacctgggaatgttctgtgttttgacgtggttcttgggtacatgggtgtgttcaggttgtgaaaaacatttgcctctgtatatgtacttgaactagaagtgtttagaatttccatctcactgctctaaaacaattcagtttattaacttttaaaaattctcatcccagtgcttattaggtcctccaccaaccgatttctccacccctttgccatcatcatttcatgtctctgacagtggaggctcatttggcgattctagcctgaggcaattgcagcctcatcaagcctcctgttgtgattttgcttcttgtgtaggttatgctgagctgttttctgtttcctttttaattttattcattcaacaaacatggctggacgcagtggctcatgcctgtaatcccagcactttgggaggctgaggcgagtggatagcttgaggtcaggagtttgagaccagcctgggcaacgtggcgaaaccccgtctctactaaaaatacaaaaatgtgctggcatggtggtgggtgcctgtaatcccagctacttgggaggctgaagcaggagaatcacttgaacccaggaggcggaggttgcaatgagccaagatcgcaccactgcactccagcctgggcaacagggcaagattctgtctccaaaaaaaaaacaaaacaaaacaccacacatgcgtgtgctgtctctggaacatactcatataggccaaatgttgccgaccctgtcacccaatatctattcccccttctcctaacagaacctcccatttcactcaaagcatcagtgtactaattaaaaaactacatcttcccagcttcccatgagcttagggtgtccctgtaacaagggtctagccaaggagacataaagggaaacctctggagggtcttccagaaagctcttaacataacacaagcaccagactcttctcccctccctccttcccacccaggtgaccccgcaatgcgtggccaggggagaatctccctggggcccgccacacagctcttgtcctggggctgccctataatgctagtttgtggatttcctgtttttttctcaacttactcctttgttttaacagagtatgttgatgtatgtctaaaatattcttggtttttaaatacatatttgtctagagttgttattaaaaagtcttttggctgggcacggtggctcgtgcctgtaatcccagcactttgggaggccgaggcgggtggatcacctgaggtcaggagttcaagaccagcctggcgaacatggtgaaaccccgtctctactaaaaatacaaaaattagctgggcgtgttggtgggtgcccatagtcccagctacttgggaggctgaggcaggataattgcttgaacccgggaggtggaggttgcagtgagccaagatggcataattgcactgcagccaggggaataagagtgaaactccatctcaaaaaaaaaggtcttgctagttctgagctcaaagctaacaacaacaacaaaaaaatcttactactacttaggttctttattcctttctacgtgacctgttttttcttctgtagagacgaagatcgtttttccccggcattcctaaattttacggtgatgtgcctctgcgtgtgtgtatcttttcattcaggaaacttttcctccactctgggaaactttcttgagttatttctttgataatttactcttgttccctctgccctctttgtctggaactcctattatcagacctcctgcactgagcttctggctgctgtccctcccccctccccacctagtttccatcttttctcctgtttgtgtcatgtatggaagctttccttgactttttgccacctcttctgatgaatttttcatttaaaattggggggccaggcacagtgactcacacctataatcccagcacttcaggagtccaaggtgggaggattgcttgaagccaggagttaaagatcagtctgggcaccatagcaagatcccatctctacaaaaaataaattttagaaaattgaagggctatttgttcttcccctccctagcattctgttcttgtttcatgtgtatattattttatatatttagactgtcgattataatttaatctcattctttttctgtttggtttttctacatattggggactgtgtccttttgcactaagtttgtcaatgacctaaagatggtttatttctcactcatgtaaaaggctagagtagaggcatgcaagctagggccagttggtgactctgctccagatattttcagatacccagttctcatttctggggtgagactctggccttgtagtccaagatgagggtctctgagttctagcagcagaagggaagaaaggctgaaggcatgtacagctctgttaaggaaggtccttgtcatatgatgcttctactgaattatgttttccagaacctgttctccaggctttgcctagctgcaaagaagcctagcaaatatctaaattctggttgtacgtgttcctggccaaaaaaaaaaaaaaaaagtcctattactgtgaaggaagggagggcagctgctgggaggcaggaggccacctctttcacagagggtttcctcaaatggctggtgatctttgaccactaagatttaaaagagacatcacaaagctgattgggagctccaggtgcttggtggggcaggttgcagtgtggtcaaagacagcctgcacacattagagtatgtaggtgtttcctcagggtccattgagtcctcctctttctgccccgtgtgtgtgccaagggaccggcattctgggagccaagctgggcagcaggacagaggttctcactgtctggtattgagattccttttcatagccgcgttaccagtataccaccttcctgctgtctgctccagcctgcccccaagtcaagggcctctttggttccattttcccagaaaggagacctcgtgattgctgaggccatctggacacataggggcagtggacggggtggggaacatttgacctgacctcctttattcagccccaccagatagctctaattcctggttccatcagttcctaggtctctccaggctctgaggggcagaccggtcccttttacattggcaccactctgccaaatcagtcatcacactgccacccaccctgaacctttgggtttattggtccttttcctgtcctttgcttgtgttggagtactacctgtcttagtcccttagggttggagaaagtagggatgtgtgtggagcctgccttgctgagccagaggttttgcacgtcttttcctagtggaaagtttctcagtctttggagcagcggactgacattgtcagcaccactgtgtctccaccttttgctcagcattgtctgggtcacacaagtatggggtttcctgctttcaagggatttgaatctagttagggagttaaatgcagctccaacagctaaccaatacctatggtctgaatgtttgtgtctccccaaaatgtgtatgttgaaacctaatcatccatgtgatactaagaggtgaggcctctgggagatgatgaggtcatgaagatgaaaccctcttacatggagttagtggccttataaaagaggtccctgagagctgtcttgtcctttccaccataaattctcggcaggaaaaaagatgaacaaagtgatcagaacctattcaggccacagttggtagattcctagtcggaaacataggttacatctaaggaatcataggtgataggaggcggccagattcaggaagacattcaaatatgtgtggatggatttggacttgatgaagtggatggcagggaaccactgaggaagagtgtgttgataaaagtcatattcggggaagaggcagtagttgtgctggagctcgtgaaaactcaaaatttcaattgtaaaattttcaggagttttgtgccctcgttaatgtcactttggtagtttgaaatcagctctgggaggaatatttacagcatgggaataggcaaatgctacaaacaggggtccacctcccccgagagctggctattaaacatgtaccagcacaccactgtgtgcaggacatgtcaaatgacaaacttcattttaatgaggctctgtttcatgttaggcaccgtgctgggtgtgctgcggctgaacctgttaacagggtccaggaatgtgttaaagcagctgtgagttgtgcaaatagaagaaaaagctctggaagtacttccacaaaatggatggttagacttgatgacgttgtatatgatgaagttgtatatataagagatcaaggaaacagaagaagggaatgacttgaaacttcctggtctgagaaaaaaatttaaaccaaggaataactgggaaagaaatgtgttactttcaattttgattactcatgggaatgagcaggtaagcagggcctgtagaaaactgtttccagctgacaacttgcttcacaatttcatttgggtatgagagcagggttcaggcgtgaggttccagctggtgatgtgaatgggagctgaatccattcagaaggtatggagacagttgatgggaacttgcctggtgaatgcccagagtttagagatggaagggaggaccaaggaaggctcatgactttctgcctgtgctgccatctcctgacacattttctccagttcttccatgttctttttttttttttttttttttttgagacagagtctcactctatcacccaggctggagtgtactggcgccatctcggcctcactacaacctccgcctcccaggttcaagggattctcctgcctcagcctcccaagtagctgagattacaagcgcctgctaccacatccagctcattttttgtatttttagtagaggtggggtttccatgttggccaggctgatcttgaactcctgacctcaggtgatccgcccgcctcggtctcccaaagtgctgggattccaggtgtgagccatcgtgtccggccttccagttcttccattctacttgcaccttccaaatggagttccagggagtgcaggctctgccttcatccatttttttttgttttactattttttttcttgttgttgagatatgattcacataccataaaatgtgtgcttttaaagtgtccaattcagtggtttttagtatattcacaaagttgtgcagccattgccactatctaattccagaacattttcctcaccccgaaatgaaactcacaattctttggcctcagatagcctctgttctcctttgtttctatggatttgcctattcaggacatattttgtaactagaattgtcaaatatgtgtcattttgtggctggcttatttcacttagcatgtttttgaggtttatccatgttgtagcttgtacaaacctcattctttttttgttttttgttttttatgagacagagtctctgttgcccaggctggagtgcagtggcacgatctcggctcactgcaacctctgcctcccaggttcaagcgattctcctgcctcagcctcccaagtagctgggattacaggcacctgccaccacacctggctaatttttgtatttttagtagagacagggtgtcaccatgttggccaggctggtcttgaacttctgacctcagatgatccgcccacctcagcctcccaaagtgctgggattacaggcatgagccaccgcacccggaccctcgttcttttgtaaggctacttttccgttggatggctctgctgctttttgtccattcatcagttggacatgtgggttgtttccacttcgtgattattatgactgatgcagtgagcgtttatgtacaagttctcgtgtgaacacgttttcagttttcttgggtatgtgcctaggagtgcaattgctggattgtgtgggaactgtcaaaatttttgaggaactgccaaactgcttcctacagcagctgtaccatcttacattcccacgagtaatgtgcgaagcttccaatttctccacatcttcaccaacacttattttatatttttaaagttaggcatcttagcggatgtgaagtggtatctcactgtggttttgatttgcatttccctgatgactgatgacattggacatattttcatgcatttaatgactatttgtctatcttctttggaaaaatgtctattcggagtctatgcatatctgaaagttgggtcatctgtctttgtactgaggagtaaatgttgctgctgtgctctggatactacaccctcaacaaacacaggatgcgcaaatgctctatgctgttctgtgggctgtctgcactttctttgcagtgtccattgaaacacaaaagttttacattttgatgaagtctaattctttgcttatttgtgcttttggtgttatatctaagaaaccattttctaatccagggtcacaaaaatttacacctatttgtacttctaaagtctgatagttttttaaaaaaatatatgaaatgctttatgaatttgcatgtcatctttgcacaggggccatgcgatcttctccctgtctttccaatttttagtatatgtgctgccgaagccagcgcagagtcttagagttttaactcctacttttagggctatgccccactttagttaatttttgcatctagtgcaaggtaaacattcttttgcatgttgatagtctctcgtcccagcattatttgttgaaaagacagttctctcccattgaatggtctggacacccttattgaaaatcagttgactgtagatatataaatctatttctggactctgtgttcaatttcattgatctacatgtctgtccttatgccggtgctacactggcgtaattactgtagctttaggaagtttcgtgttttttgtttattttttgtcttttagtaagttttgaaatgggaaatatgagttctccagctttgtcctttctcaagagtattttggctattcagggtcctttgaatttccatgtgactctttttttttttttttttttgaggtggagtcttgcactgtcacctaggctggagtgcagtggtgtggtctcggttcaccacaacctccgcctcccatgttcaagtgattctcctgcctcagcctccaatgtagctggaattacaggcacctgccaccacacccagctgacttcgtatttttagtagagatggggtttcaccatgttggccagacgggtctcgaactcccgacctcaggtgatctgcccgcctcagcctcccaaagtgctgggattacaggcatgagccactgtgcctggccaccatatgaattatctaatcaacttgtctgtgtctacaaaaaaggctgttgaaattttggtagggttgcatgaatatgttgaccagttaggaaaatattaccatcttaatattgtcttccagttaatgaacatgagatatttttccattttatttgaatcatctttaatttctttcaacaacattttgtagttttcagtgtgcaagtctttcagttgttttaagtttattgctacttactgtattctttttgatgctattgtaaatggagttgttttcttaatttcatttttgggtagttcgttgctagagcatagaaataaacctgacttttggccgggcatggtggctcacgcctgtaatcccaacactttgggaggctgaggcaggtggatcacgaggtcaggagatcgagaccatcctggccaaaatggtcatactaaaatatgaaaaaattagccgggcatggtggtgcacacctgtagtcccagctactcagaaggcggaggttgcagtgagctgagatcactccagcctggcgacagaacaagactccgtctgaaaaaagaagaaaaaagaaatatacctgacttcttatgttgatcttgtgtcttgcaacctgtaacagccgatttttagctctgatagtttttgcgtgtggattctttagggttttgtacataagactgttactcctcttgaccatctgccttccctctccacaggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggtgagttggaagccagtgacttgggaataaacacccaggaaaaggtagtagcagtgctcaactcagctactgcaaaaatgctgtctttttttttttttttttttttagacagagttttgctcttgttgcccaggatggagtgcagtggcgcaaattcggctcgctgcaacctccgcttcctggcttcaagcaattttcctgcctcagcctctcaagtagctgggattacaggcatgcgccatcacacccagctaatttttgtagttttagtagagatagggttttgccgtgttggccaggctggtctggaatccctgacctcagttgatccgcccgccttggcctcccaaagtgctgggattacaggcatgagccaccgtgcccagccaaatgatatcttttctaactgtgcttttaaagttctctccttgggacaggcttgtcttctcctgactgagtatcaaaaggcccgggattttctagttcgagcccagaaggagcaacccttcaatcatgacatcaataatgagctgaagaaactggctaggtgagctgtgtttgcaggagcatgaagagagatgggtggggttgtgactctggtctgtccccccaccccccccaacaaaggacagtctggcggtgttgcccagagtgttaggaggccgccccctctacagctgggtttttgaagtgctcggccgtgcgctgcaccagcagttcccagcaagcaggtgagacagactgccagactatacatctccatcatcgcccacctttctgtttcccctaccgcaaataaacaacccctagagaggtgggagggtgtcacttttttttttttttttttgagatggagtccctctctgtcacctaggctatagggcaatggcatgatctcggctcactgcaacctccgcgtcccgagttcagacgattctcctgtctcagcctccaagttagctgggattacaggcgtgtaccaccacatctggctaattgtttttgtattttagttgagacagggtttcaccgtgttgaccaggctggtctcaaactcctgacctcaggtgatccccccacctcgtccttccaaagtgctgggattacaggcacaagccaccacaactggccccggtgtcacttaaaaagagtcttctggtgcgctcttccctgcgtgctccaccaagaaccactgctcctaaccaagtgcagaaaggcccctcgtaggtcctcatgtgaccagaaacaggcgtttcgggtctgactcatacccatggattgacctccttgttacccacgtgactaagcacaccagtcttttagtgatgtaattttttctcattatagaagttttgtgtccattgtagaaaaccttgaaaatgtctacctataaataggagtcccccataactccatcacttggtaataggtccatggtttttaaggtatatcttcttctgtaatggtgaaattctctacttgtcttaatattaaacattcagtccagattgctagttaaagcttgcttggcattagtgtctgagatgtgagtatctcttaggttacatttcaagccttttaggacttgccagcaatttcctttctggtatttaaaagtatcctgtcagatctggtcattctttagtgagaaaatcaggagaggttagaggctgctgagggtgaggggtcgtttggcgagactcagcccggagcctggtggccagaggcacctgcccttcaaggcagctgtcctttccagttagggggttttgtccaggggcttggctccttggccagctgtgggagccttccctgcctccccacctctccagcttacttccatccctcccaactcagtttgagtcctgataaattttcagtgtttctggatgtgagtggagaattccagccaccagatgtcacctcctccaaacacagacctcctctaacgagtgtgtatttccctctccagctgttacagggactatgtggataaagagaaagaaatgtggcaccgcatgttcgcgccctgtggcgatggttctacagcaggagaaagttgaaggtaatcaaagggccagggtggcacacaggcttccggatggagaagcgtgctgctctcctccacccccaagtgaatggtggctgtctgcagctgagggtggacgaggggtagacaagttccttgctgtaaagaacaacacaacggtagtgcaggatgcacgtgctgcacgcctacctttcccgtgagaagaaagttcgcccagacctgtgggttaaatgtataggttcagggggccttgagctatttatttatttatttgtttgtttgtttgtttgaggcagagtctcactctgttgcccaggctggagtgcagtggtgcgatctcagctcactgcaagctccgcctcccaggttcaagcgattcttctgcctcagcctcctgagtagccgagattacagctgtgagccgtggcgctcagcctaaatttattttttaaaaaacctttttttttcatgttttatgtgaaactctccttgcagttgcttggaacatgagactgagtagagtcatgaatgtgatggttgatagagctgggctttgacgtgtcaagcttctgttcatcttctttctcctgagaactcgaaagcctccaacttgactgtgtctctaacacattactaaagcagacaagatcgcagggtggggatgggctgtggctcttaaattctactttctattagacttagagatttgaagatgctgaaagcaacagggagcggaatatagcattcctcccaagatcacacctagtaattttgcaggcacagggcaggagttcccaagcacatgagataaccctccagtctgaaccctccagtctggtctactatttaataaaattaatggaaacaaaatcacctgcctgaaacacctgcttagctgcacagataactctgctctctcggagaagttaaacaaggaacaacaagaaaacagctgctgaacgggctcatggtgataaatctctcctttgttgcttcctccatctccctacaaaaggggcttgagaggaggaggcagtgaaaaggcctattcatccccgacattttcatagcggtccataaactgctgctatctgcactttcagatgcgcccaccagcatcacaggtaaatgttgcctttgtcactgatgctggccatgtgaaccctggccttcaggtctttcagtggcctttggagtacatatttgcaggtcttcagaactgagatgtgagccagaggacttcccttgtttggtcacttctagtatccagtaaaaatgaagggcagtgactgtttgccaaacattttggactgtgaccccacaagtcctgtcatgaatgaagacccaggtctgccagggtccatcccagacaagggcttgggcagcccagctgggcagcagttttcctcgccatcatgtttgcttcccagccttttcagtctgtaggactggaggctgctgatcttcagatgctttcccccagatttccaactccagcatttatcttaccatcagcaatgactgtatttgtgttctaaagtagccaccactgtcatattgccactgctgtcacagttgtgataagttttagcttttgtgtctttgctctccctgctcccctttttttctgtagtatttgaggcctagtcatttaaaagaagctaaaaatccagtcatcttgacaacctagttgtcactaaccaggacaattttttttttttaagggtctccctctgtcacccaggctggagtgcaatggcacaatcttggctcactgcagcctctgcctcccagattcaagtgatcctcctgcctcagcctcccgagtagctgggactgcaggtgtgagccaccacgcctggctaatttttgtatttttagtagagacagggtttcaccatattggtcaggctggtctcaaactcctgacctcaggtggtcctcccgccttggcctcccaaagtgctgggattacaggcctgagccactgcacctggcttaggacaattttaacttttgttcttttcatcttagatgttagataccactgacttgtaagattacttctggaggaatgagtgttctcttaagtattagttatgtgctctaagcctctgactatagtagacagtatgccttttccatctttgcattttctagcttctggagccatgccaggtgcacgattggtgctcaggaaatgttggttggactaagtgtgaaatagccaaagcaacagaccagcctctaataaaacatcctccaggctggctctgggattggctgttggacccttggtattgccagggacagaaacctatctttagcatcagccagaaaaaaaaaaaaaaaaaaaaagatttgcagaaggggtcctgggagtggctcacagagttgaggaggagtttggcagtccttgggcagacagtgaccaggcagctctgagggccttagggactcagtctcccctcggctttgttttctccccctgtagggagtgcccatacatccctttctgcaacctcctccctaatggagtgagagttctgtaccctaaaagtccctcctcttcctgccccaaacataactcttcagtttgaaagatcctgggcaggactccggcctggttgggggtatgtagaaccccatgaatgggagtttgtgttttgtccttcctatcctgacatgctggtatctgaggcccttgtgatcattttactgtgtctggaaaggagctgtgaagggagctctatagctattttcaggcatttaaatggttaacatacaacaggtgaaatttgttctgtggtttccaaaggtcagcaccagtaagctgacacaataggaagacagaatctgacctgataggagatttaccagtcaaatgtcctgccatgagttctcccaccatggagtacacagtggaaggggccacttttgactgcttttggggaaacatctgttcccgggccactccactttgttccacggggctgtggggcatctcgggagctggtgcagtccctgttagggtctatccgagcagagctggagggcctgagaggtgggtaaagggagaaattagatcaccttcctggtcgtttttaccatcaggtaattgcagaccttcaaggcagaggtagcagctcccatccccaaggcacacagcagagatgaaatatgacatcctatacttagcatcaaaaaacaccacccgaggaaaggaagtagcaggaggggcctcgttcaagagcagacagattttgttgcctgctgttcccaaacataccaaatgcaaggaatggctgccagaggaaagtgttccgaacgggggaaagccatgcctgccctgccccgcgtggcccgccttcacactgtctcctgccatccctgtggggagccgactgttggtgggcactctagatgctatgtggcatatagagagagttccagtaccacttctgcagccctgacctgcagggattgggggtctaaacagggacaacaagataagtccattaaatcacagtgttcaagagtgggctgtgagggagcacccctgatcagaaagaggctttgctgagctaggcctggggcatgggcccaaggggccccaggagggagttgtgagaggtcctgatattgtcctttcatttggggcctccttggaatgtgggtggcattctatagggcattatagaggaggagaagacctggccagagctgagctgctctgaggggctaaaggggcagcgtggggacacatttaaagtggcaggaccatcaggtggcaggtgtctgagtaagaggtgatggcagcctggacgtgaacctactggcaagagcggaagggtggcaggagtatgcggcctcccatctggaactgacaggagggtattctctgtgaagagttctcctgacaaaccagaccttacctgagggagcatgaccatagtgcctgaggggctgaagatgccctaaccgaagttactgattgtggaggagggcagctttagtgacatgtcagccatctgctaacagaggtgggtgggcagaggccagaaccaggagtccagggctggtccccatgtaccaggagtgactgggaaaactccatgaggggcggccagaacttgagggagtcttgggttacctggcaggaccaggggtgcagggcgaggtgaccacccacacggtcagcttacctacgcgtggctttcattcttttgctcttggtttatcataacatttttcttctaggttgttttgctagtattgcctagcatttatacttttttcttagtgtatttttattaattttggtcaaaatttttattcatattttaaatgccaggtattcttctacatgtttcacatgtgttaatatttttaatgtaagatctgcataatgtagatatgatccccattttacagttgatgaattagatgtgaagaagctatgtaattgccaaggttgcagagctcctaagtgatagagccagagtcaaacgctgcatatacacagggaacccgaattgaatttcagtttcttctggagagtcttccacagggctcaatactatgtttctattaccacttcttgatttatgttttggatatttatctgttgacttcctgctataatataactctttcttctcttacattactacttgtagatcctctgttagattattataacaaaaataattcaatactgatgttcttggcttcatacagctaaagacagtatttcttgtgctccactttgtttttagagacagagtctcgctctgtcacccaggctggggtgcagtggcatgatcatagctcactgcagcctcaacttcccaggctctagcaattctccctccccagcctcctgagcagctgggaccacaggcatgtgccaccacgtccagctaatttttttattttttgttgcgacagggtctcaccatgttgcccaggctggtctggaactcctgggctcaagtgatcctccctccttggccttccagagtgctgaaattatgagcgtgagcacagcacccagccatatctgtttattcttgattcatctaaaattacacagtagcatgtccaggtactccctgttgctcaagtcctttagataggtcccttacttctagaggcttaagcttttaagagccgagaaattcctctatactatttcttaaatcacgtcttcctcgttattccctgtcatcttgttatgggacacctattgactggaagttggacctccttcagggatcttctattctgtctccttaaaatcttttttttctcccttgtgaaatgttcttaattttccaactcttccatcttcatttcatcaatcaaatatttgaatctaagagctcttctcagatttgtctttttcataatgccacacctttcccccccttctttgaaaaatctcaaagttacataacgaataatactaagattccccgatgtgctcaacgtctggctttaacaattaccaaggtaaagccaaggtttccttctaggcttccgcccacatcctccctgtatagcagggaagcctatttccttctatactctccttcgcaacactcaggacttccagaacatttcacttctgacaccagacatgtagggattttccccacaccaaccaattctgaaagcagctcagtgtcctacattacagctctgacacttgacctggacttagtgcatactccacaggttaagggctcatttccacaagactgaccccatttcagactccagtgacaattccaggttgtccctgtgcttcttactaactggttatacatcagagattcccatacctgttcctttgggttgagtcatctggaatggtgctcagaactcagaaacacctacttatagtcactagtttattacagaggtttttaaaaggatacaaatgggccagacatggtggctgaggcctgtaatcccagcatttcgggaggccaaggtgggcagatcgcttgaggtcaggagttaaagaccagcctgggcaacatggtgaaactccttctctaccaaaaatgccaaaattacctggatgtggtggtgtgtgcccgtggtcccagctacttgggaggctaaggcaggaggattgctggagcctgaaaagtcaaggctgcagtgaacccagatcacgccactgtactccagtctgggtgacagagtgagaccctgtcccaaaaaaaaaaatttaaaaagggtggccaggtagggtggctcacgcctgtaatcccagcactttgggaggctgaggcaggtagatcacctgaggtcaggagttcgagaccagcctgaccaatgtggagaaaccccgtctctactaaaaatgcaaaattagccaggcgtggtggcacatgcctgtaatcccagctacttgggaggctgaggtaggagaatcgcttgaacccaggaggtggaggttgcggtaagctgcacaccactgcgctccagcctgggcaacaagaacgaaactccatctcaaaaaataaataaaaaggccaggtgcagtggctcacgcctgtaatcccagcactttgggaggccgaggcaggcggatcacgaggtcagaagatcgagaccatcctggccaacatggtgaaaccccgtctctactaaaatacaaaaaaaaaaaaaaaaaaaaatacaggcgtggtggcgcacatctgtagtcccagctacttgggaggctgaggcaggagaatctcttgaacccaggaggcagaagttgcagtgaggtcagattgcaccactgcactccagcctggcaacagagcaagactccgtctcaaaaaaaaaaaaaaaaaaaaaaaaagatgaagagccacatggggtggcgcacagggcatggtgtgagggaagggatgcgccagcacccacacgtgttcagcagcctggaagctctccaaaccctgttctttctggcacaattggttgaatggttggccattggtgattgccagttgaaggttgcttcggcccttcccttgtcccatggttggttccctggcaaccagcccccattctgaggctgtccgagaatccccagccaccagtcatgtcattagcatacaaagaaacacccatcatttcagagattctgggggttttaggaactgtgtgtcaggaaatggatagagaccaaatatatatttctgactatgtcacagtccaccccctgctgtccggccacagaccccttaatagcaaaacgatgtgcagcttaagaggtactggcatattactagaatcccatgtagccatgaataaagagtccagtccatcgtcatgtgggcccagagtggaagtgtcatcccctgtctttagtgctttatcatgtctgtaaacccacttaactttcctgacattcttgtgaggaagaatgattgtttctgcctcagattggggaaggagtaaagcttagagaaccaggaccctttccctgaggaggcctctgtgtgtataaacaactgagtgttttcattggatttgaaatgttaagccccagatgatgcctgaagcctcaaacatattcagctgctgtattcaggtggtgcgtgaccccgaagcggccatgcacttttatccttctctcagatgttgaggaaactcccccctcctttgctttttccgttgaagagaagctgaagcctttgggctgtagagtattgagccctgctacttggccagccttggggaaagaggatcttaacagactaaaaacaatgttttctggaaagtcaggaggcccaagtggaagtaaaggcaaggttgtggagagtactctctggttggtcgagattctgggatttggtcctggctcagagctggcctgaggtgagccccggagcagcgggccctcagcccagtgccaacgccgaggccacaggaggcctctggggccaggggttccctggttccaaaatagctttcctgtgacccggctgtcctgctcagttgccaggaaaccccgggagcagatcatcatctctctcggtatgtgactggatctaggcagggaatctgtttgatccccttcttcccaaagagattaagaaatatctagtggtgagtctctcaaagttacttcgtgcatccagtgagacactgctgagtcctgaataaagacttgtttaaatatatttttgtaattatttttttttccttaatttttttagatggagtcttgctctgtcacccaggctggagtacagtggcgcgatctcagctcactgcaaccttcgccacagacatgcgctaccactcccagctaaattttgtagttttggtagagacggggtttcaccatgttggccaggctggtctcgaactcctaacctcaagtgattcatccgcctcagcctcccaacgtgctgggattacaggcgtgagccaccgcacctggcaatttttgtaattaatttttctgactttccttccctatgcctctacttttttttttcccctcctctaaatggcgttgcatcttctgccgggcatctgggccaggaaggcattctcttattctcagatgaaggccatgccctgttccaggcaaactgtgtgacctgggctcttaatcttccacgtacctgtgaagtgccttttctcccagctctggaggtgtccctgaagtcatccctttgttgtgtggctataaatacctcaacttcggtggctgccttttcatcataccccttcctgggaaggcatttcctctggaagggttgctttggcccttcattccctctccacatcctctcttggcagccgtaataggcctcaaccctgcttcctgctaagatttactgttgtggattctgtgttctttgcggatgaggtacgaatgacagctactaagttcaatcctggagataactgggttccttttgctgatcgtccacaatcatggaagtgccctttatgattcatgatggggttgaaagacagaacatttggatcctcagtttcatctcttgctatgacattagccaagtcatttcacctctctgggccttggttgcattgtctgcagggtgaagctgaatcacttttttattttaaaagagaaacaaggtctcctatgttactcaggctagagtgcagtggtgcagttatagctcactgcagcctcctgggctcaggcagtcctcctgcctcagcttcttgagtagctgggactacaagtgtgtgccagcatgccctgctgattttttttattttgtaagatggggtctcattatatttcctaggctgatctcgatctcctggcctcaagcgatcctcctgcctcggcctcccagagtgctgggattataggcatgagccaccgcgcccagccatggagcagtcacatctttaagatcactgtggagttgtttatgcttcatgaagaccgtcagatatcggcttagtctgtttttaatttcttgcgttcattaggtgcataagccctgcctccaagcatacataatcccaaacaccaacctggataattaagtgtacaggtagtgagtgaaagaagtgagcctaagcaataaggaattgacatcaagccagtgccttgtaccttctagggagagcatgagtccccgccagctttgctggctgacccccattctgcaggtgctgatcctgttctcaagacctttggttgtagctgttattgactgtcatacttttgatgctcccctacgctcccaagcagccaccgacccagggtgaagctgagatgaactggggtgagcctcagaggttcaagaatccagagaagggttttcaaatctaatagataagtgaagagctatgagcaaaagttctctctagctcagaggtcactcagacattcacaaggtgagaaggatgtggtctgccgtcactgtgagtgcacccacagcagtcattgtcagcatcagtccaaacagaaaaggcagcaagaggcagacagaggggcatctccaggatgtttggcatcctgaggtcatacagcttcatttttttggtgagctgaatatcatggccatgaatgcgagcaaatctgcactaacttccttttgcttctccaagaaatggcctagagaggctgcctgcatttcttggctagtggccccttcctcttcttcaaagacagcggcatgatatcttccaatatttctccctctctccctttctgtctctccctctctctcaccctctctgtgaatctctcattcagcccctctctcccctctgcttctgtcattttgtctcctcctttttctgaccctcctgcctcccttttacgaggatctgattacattgggctgaccaagataatcgcccagctcaagatccttcatttaaccacagaatcccttctgccatgtatggtaatgtattcgtgggttccgggaattggaacaaggatatcttggggggcattttcccatctctcatactctgttacagatcagcatctgtgagggactacacatcttgccaatgcagagataactcagcactctgcatcctcagcattcttggcttaatcctttccgtcccagatgagatcatcctgacagccgtctttcagaacatttcctttctcgtgctcccttctggtggctggggcctgatggacacagctcacctcatctttctgctgtttgtttactgcacttgagggttgctgtactgtttacattgttaacaaatgctaggtttgctacaaccccacatcaagcaagtccgttggtgccatttttccaacagcatgtgctgaatttatttctctgatttacattttggtaattatcacagtatttctttttttcttcttttttttttttttgaggcaaagtctcgctctattgcccagcctggagcacagtggcacgacctcagctcactgcaacctctgcttcccaggttcaagcaattcttctgcctcagcctccccagtagctgggattacaggcgtgcgccaccacgcccggcttatttttgttatttttagtagagacgaggttttaccatgtaggccaggctggtctcagactcctggcctaaagtgatcctcctgccttggcctccctaaaccttgtttttaaacaagcgtggcagtttggatggcactttgacccttctttgaccatgtatcacagcacagtggcagctggtggtggtgagctgcagttgttggaggaagtgcagcagagccatgctgtgaggcctggcccacccccaaaaccgggaggtacctgcaggcgctctcattccatgtcagcctggaaagggtgggctccagaccactcagctccatgcgcattctcatgggactaggtggccagttgtgacagtggggaagtaatcgcactccctgcagagggacgtggccaagggaggagcagagagctgggctggtggagcacgagggtggctgcaggaagtgcagcagtcagcatggagtggccgccagagagccagggccacaggttgggtggggagaagcaggtcagggagtccctgcaatgagggttggctctgagaagccgcctggcaggagtggaaggggcaggtggaggacccagcaggccggaggactgccgccttgcgggctggccagagtgtcacagcagagtcccaaggggtgaggactcctcaaaaaattttccccctcagttgatatttttggagatatccagattaggttcttaagattggctgagtaatgcattttgggaaggggaaccagttgaatggtttcaggaaggtctttcattctccacgtttactatgtacagccttggttcatctgctgggattttgaagaggcagccataactttgatcagtgtttttgaagggctgagtgacccatgcagggttccagggtcttctcaccagatgatgttcatggctgagtttactctagttccccgttgcagggtacagggaagtgcttgaggctggggctgcgaggcagggctggcacacgacacccaccgccaccgtgggaacggcacctgctgagccttgatcctcagctctttgtcctccgatttccgacagaaacatcctgggctctacagcctccagcccgtggctccgcgattacatcactcctctgtcttctctgttacatttcacacccttctttgattactgcttattatgttgtgcgattatggtggacaccactggcattgctgcttgggtttctagttcacagtccctgtgccttttccgaggcctggggcccacccgccgtggaagcagcctggttcgtaggaatggattcagctggagtcggctgtggacctttgtctgtgttcgctgcctcagcctgactgccattgtctttgtcgatctccggacttatttctccttgagccacggatacagcttttttctgactttgcacctctgtgcgatacatgtattgggttttcaaaatgaaatgtgagctgagctttcctatgttggcgcattctcgtttatgctaaagtgttactttttattggctccgatttgaaaattcaactacctgaacctcgtgggatcccttcgtctgtagggagcttgaagttgatctccccccatctgcattcatgcctggagaatattgattttagggcttattcctaaagtcatttcatgggacacaccctagatcaaaactttcttttttcacttgattattattaaacttgtcattatggacattttcaaacgtctccaaaggtaaaaaaaaaaaaaatgataacatgatcactacccatgtatcattacccaggcttgacagtgaacatctttctgctgttcctgtacccactctccaattttttggtagtacttaattttgaattataaaaatgccacatgccagccgggtgcgatggctcacacctgtaatcccagtactttgggaggccgaagcaggcagatcacgaggtcaggagatcgagaccatcctggctaacacagtgaaactccgtctctactaaaaatacaaaaaattagctgagtgtggtagcgggcgcctgtggtcccagcttctcgggaggctgaggcaaggaagtggcttgaacccgggaggcggagcttgcagacagcagagatcgtgccactgcactccagcctgggcgacagagcaagactctgtctcaaaaaaaaaaaaaaaaaaaaaaaaaagtgagtgtatatgtaacttgtccacaaaaagaattatacattttgtactagaatatatttttattgcattttgagtgttttctaagttaacacaaagagaactacgtcgtttttaagaagtggctggatagcattccatcctgtcaggatatggaaatggttttcacagtgattagtaggcaggtaggtaggtagagattagatagacacacagaaacatggtcatggagctatcctcacgcctgactttcctgtgacagtcaaagtcctatcactggttgtgatgggtgtgtctttgcctgaactaggtcatgctaaactgacctctccagtggctgtaccagtttgttcttggtagtgtctgagagattccattccgtcgctttgccatcatttggattgctagactttttaatatttgccaggttggtgtatctcaaataggatctcattactagcattagcagttccctgaccaggtctctgttcacatgtttccagactgaggtggcctttctgtaaattgcctaattgtttctctataaccaaacacctttctgatgtttttaagttatttttgataactctgtcattaattctgtgagttctatcagcagtttcactgcatgcatcaggtatgtgataccatatgccggtaatggtcattttgtcttctcctcttgtatcttttttgtttcccctcacaagacagagtttcactcttgtcacccaggctggagtacagtggcgtgatctcggctcactgcaacctctgcctcctgggttcaagcgattctcctgcctcagcctcccgagtagctgggattacaggtgcctgccaccacgcccagctaatttttgtatttttagtagaaacgaggtttcaccatgttggccaggctgattttgaactcctgacctcaggtgatcccccccagcttggcctcccaaagtgctgggattacaggcatgagccactgtgcctggccctcctctcatgtcttattcagagcctgatggtgcggtgcatgcttccagaacagtagcgatgggtgtgcctcatgaccgtaatggagctgctgctcgctccaccgttaaacaccatgctgactttggctgagctgtatttttttcttatcatgttatggaaatgtttgtttgtttttgtttggtttggttttttttttttttttttttttgagacggagtctcactctgtcactcaggcgatcttggctcactgcaacctctgcctcccgggtataagcaattctccttgccttagtctcccaagtagctgggattacaggcaccagccaccacgcctggctaatttttgtatttttagtagagatggggtttaatcatgttggctaggctggtctcgaactactgatgtcaagtgatccgcccgcctcagcctcccaaactgctttgattacaggtgtgagccaatgcgcctggccaccacctcagtctttacttacttctgtcccgttgcctgtggttctggaagtctgactggaaaggggtctgttcctgacaccccacctcctcttccctctctcaggtgctggctcctttggttgtattggggtagggaggaaagagaagggaaagggtagctcacgcctgtaatcccagcactttgagaggccgaggcaggcagatcacttgaggtcaggaattcgagaccagcctggccaacatgacgaaatcctgtctctactaaaaatgcaaaaaaaagtatccaggcgtggtggtgcgtgcctgtaatcccagctactcaggaggctgaagcaggagaatcacttgaacccgggaggcagaggttgcagtgagcagagcctgtgctactgcactccagctgggtgacagagtaaggctctgtctcaaaaaaaaaaaaaaaggtttcccagagcccatctagtagggccacacggtgatggcatctgtctcttggctcctgtgtggtcaccggccatgcccttccctgacctcagctgctagccctcagcacatgtgactgtgacgtcgtgtggcagctgctgagtcctgagatgtttttaatggctgtttgattcccaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgc

SEQ ID NO: 38155 - DNA, 9638 bp, Homo sapiens
gggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgtgagtaaccttttgcagaaacagtgttatactgtatctgaaaaagtatcactcttaagcttggctgctgctactttctacaaaggcttttaggtagctatttgttggatacagggaaggggaaatggagaacttcagtttttattcaagttcggatgtatcacattaggtatccagaatgcaagtttcctcgggtctccttgtctcgatgatatcagacagtaaaaatatatgtaaaagtaatttttatttcgaggtatgtcaaacgtgccaaggataaaagtacagatcttccaactcacaagtctaggaatcacacgtggattttgaaagcgattctaaatcaaagcacaatatatgccgtgccgcctccacagcccgtccgtgttcgtgtctttgatttggttttctactttgtgtagttttgaagccaggcaggtatggcagtactggaaagggaacattcccaaggtgctacttgaagtgttgatgctttgctcttttctcccaagtcagttccaacccaagtctccccacacatagggtccccatccagtgcaacgatctgtaatgtgcacgccagcagcctccgtttttacctaacgatctgtaaggatcacatggcacatctttctataattaatttgatcatgatgaaggttggaaaattttcgtgtgcagttacattggacctgtctaaattttctcttgtttcaattttatatcatatgttattttcagttactgtttgtggctagtatgccccgtcctcatggagcaggaacggctgttcttattattatgacattaacatttggtgatgggatatagtgcctttaggcactttcaagaagaaaaataccttttgtttgttatcggcggtagtcaatctcatattccagaatgaggttcactaacttttctaatgctcatggctgccttttacagctccaggcatttaactggagtagaacaaaattattaacatttatggcaagcttattatatgctagatactaagcatttatatgcctggtacatgtaaactgccccatttggagtcaagctcaacaacttccccactgtgtgaccttgagcaagttacctaacttctctgtgcctttcttttcctcacctttaagtggggatgataataattctgcccacctcatagcgccctatgaagattgtgaaaattaaatgagtcaatatatgtaaacatataggaaatgctaaataaagactatcatgattaatatgttctttaattctcattttacacctcaggaaactgaggtggagagacgttaacttgtccaaggtcacaaagctagtaagtgacagactcaggactcatacacaggcctgggcctgtgttcttggtaatttcactcattgtaattggacgagtttattaattgacttctaataaaataagtgtattcaactgatcaatgtttaaaaactgttcatcaacctggcaattaaagcaaactatacttttttaaaaaagacacaaaagaatttattctgtaaaggaaaaatgatagttttacttagattactacctaaggaagcccttctatcttatatgtcatccatttaaaacctaatttacaaaatgccttactaagaaattgtctgtcttggccagtgtgctctctggccccgaaatcaaggtgaccctcatggggacaatctcttctagtggatgataaagttatgcagttatctaaacatttttggaattcatttgtatttgtagctggcagtattccttgagttgagttgcacaagtttatattccatgtattgtattgcaccttgtacctaagtctatgttgaggttttaaaagattcgtcttagttcgagaagtcctgaattttgtaaacaagtatcatgtgcaaataaaatgttctctagtcaaataaatttgggaaatgttaacataaagtttctttactgcataacttgccagaacagttactacactaatgtgctttatgactctccaagattcccaaacttatttgaccaaggaaaatgttgggagcaagttttctaagaatcacatttttccactcataaaacctgtgattgtataggctttgatctgaatccctctccctcagcctttgcatttctctgctgaggactttgttcatgctcatatggtgacttctctgtcccttgatcactgcagttgtctttctctgggcctgcatgccctctgaatgctagcacacacaattccaggatactgtgctgagaggtggttcccaagctcatcccgctgatgcccagcatgttgacctttgggtcacagcagcacatcacactgcctttcttctgagaatattttgtagtgactcataggcctctttgtagtgactcagtaactcagaccatcatctccaaactctttgccctctattccactggcattatttccttttaatgtcaatataaccaatgcaattttgttttccattcaaaacaaatttaaatgtcaacatgttggttgttgctaggacctatctatgaaattgagatggtcctgaaacccttaacacatggtttccacttttttaaaacagttattggccacacttaagtcttctgtgcttgaaatccgaatttaatatattttattttgacattagtatttaccaggtttttatttgtatttctcttttccaaagctctgggaaggaagagaggcaaaacaactgtatctgcaaatgggaaaaaaggggggctttggaaaaaaattatatatagccagaggcttatgcctagagaatcaatctctacccacgtatacatagccaatcatgacaaccactgtggcgttcctttgtttcccttccctacccaccatacatatacacctgttcactgaaacattgcttgaccagtacctgagacttggggtgcccagaactgtatcattcctgctattgagcagaatacaatactgtgctttagggaagacaggacttgtgaaataagcaaagcaaatgtgtaaggtgactttgtttaaatataaatgctacagtagtcaaaagaggcaagaattttctaaagttttcatagaggaggcaggcacctggactctgctataatagcactaagataggcagagaggcccagggaggcattttaggcaagtggaaaacaagagcaagggtatggagctagaaatgagcctggtatttggggaaagttggtctcaactgcagtggtagttgtagtgcctgctggaattggtgacatataggatgtagcaactgaataagaggaagaaatccaagataattcataagttttgagtctgcaggatcaggaatggtggtgttgccattgagagaaatcaggatttggttaaagagaaagtttagacgagtttgaaatgagagagcacatatgtatgaaaactaagacaggagcttacaccaggctcagagtcagatgcactcagggtataatgggtgaagcatctggttgctctcgacagtctcactttgaggactctaacaaccaccctcccacgctgcatttcttttcccacctaatgagaatagcaggtctttgttttgaggggcagctccccagtgccgtatctatactctggccaaaggtagaaatacagtacaactgcgctataatgctctgagtaaggtctagaagattgactcatgcaaaatgcacatcaagttattgtgaggtcctgaaatgatatctggggcttgggcagaggatcgttatagagtttgccctaccactcaaatgctttgggaggtatgcttcctttacacctctcaaatgtgcttctggtcttctggcttaggaagtcaaaatttaaacctagtcctctatggaaaaatgggctcctgtaacatcctgcagaattattaaaataaaacaaggacctagatggataactttcatttgcactcactcagctccaaatcagcatgatccccaaagtctcttgcagctcagaaattccatgaagctagcttacttttcctaacaagaaaatccccttctagaaatgcccatccgctatttgtaaactttcttagtaaactgataaatagatcatttgcccttaaaacaaacttttaatttcaactctgaaagacatgcatatatgtccttcagaatcttaccttttaaaatggaaactgcttggaagtggcttttacctggggaatatgacatgcatgtgtctgttatactgccttcctgccaaaataagtgtgtctttaggcacgctctttgcatattctattgctaactacattttgccagacactgcttgtgaatgcagtatgtgtgagaccactgcccagcttcctgtagtgctagtcctacatttccacagaactcctcacctagccaaattcttgagcgctttgcagtcagcagcactacctgaggctctgcctgagtgtcactttagttgtcttgcagaaagcttcagatgtccttggttctatttaggttgtgcaaatagacatatgaggtttggttctggttagtggttgctagtaccagatcaccttgcttactggtgagttcattcaaacccaaaaagtcacacctgtgtcctgtgcgcgggtgctgcaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggtaactgtttacattttgcttatttctttgattttgctttcaagtaacttggtttctattccagtctcaatattctgaagtctttggttttatttttgatcattcctttccattaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtacacatgttgcttaattattttccattgtactgggactctcgtaacagagtactccataaacttttctttttctgacaggtcaggggagtacaggagctgttgcttaagcttttgcctgatgactaacctggtatgtatttctatttctcctctgtcctccccctctttgttttggctctattcagttgtggtgattttaatgatttttttttccaggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcattctctgattacagatattttaaataagctggtttctataagaacttcaagaaaaaccattttagctgcttaactggcacctttctcaggaagtaataacaccaaatattgctgattcctaggaaaacatttactacttgtaaagaatttcctgagttaaagtagttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcagaagaaaattccacgtagaggggctttaaagtctttatggaaaaaagaaaaataaaaatcatttttcttgttttagttttctggatatgccgcagaaggatccgtgccagaagcaagcctgtgagatacagaaatgtttacaaggtagtatattgtaaaatgctttaaaaatatttttccactgtgaactaactataagagaccaattattcttttatctgtattaactcttttttaagaatgtaacgtatatgtaattatcctgaagattctcttcattgtatcatcaaagatgcagaaaataaaaagtaatgtgatcaaagctaggggttttcactccaggtgattagcatcacctggagatctttaaacacttacctagaacaattcagacttcctagggctagggctaggaaaaaaagggttttttgttgttgttgtttgtttttactaaaaggctagttttaaattggttggttatacttcactgcagctgacaattcactttttaaaagcaatctggaagaggtgcggttgaaataacaattggaattcaggctgccaaagtcatcaactaactcttaaaggcagaagtgaatctcgactaaagcatatttgaggtgatttgtccatttgtccagctgctaagtttgaccaaatgttagaggattttagttttctaatcagtgaatgactgttgccagaagagcaaatagaaaaagctataaggctatctgaatttgaaaaaattttaataagttttcctcactagtaaagtaatagatggagatggaaggtcatgaaaatatagaaaggtatgaaggaaaaatgttcagagttcccccaaagattcaccaccaaagaaatcctttgtttgtgtatctccttggacttttagctttcattcttggacttttcattttttgatgttagcaatattttataaaatcttttagattaaaatctggatgtataataatgccattttagtcaaacttcttccctccaactttaaggaaaaggaaaaagttttttgcatttaattccttctcccaaataaaaccttaccttgtttgaaataacccatagctaagggaaaaaaataagttaaaaagagctggtgacacccccttggcagtgtgggaggattaagaactggaaagactaaaagatgacaagcaccgttataaggactttatacgtattaagcctttcatccatgaggtagatgctactatgacccccatttcataaaggggaaaacagacacacaagttatgtaatttgactagggtcacatagctagtaagaggtatggtgggaatttgaacaccccccgccaaccccgcccttggtctagctccaaatctggactgttacccaccttgctatactgcctttctaatcagaattgtctttcctatcctgagctaactaccatgtactccattttagtactgggggactcattaactgcagctgacctagagtctttaggtcaggtcctccttaacttagtgtttatgtatagtagggatctgcaaatgttttatgaaaaaggccaaacaagtaatattttaggctttggaggccaaaggcctttgttgtatatattgtgtatgtgttgtgtgtttacaaccctttaaaaattaaaatccatttttagctcccagctgtaaaaaccggctgaatttgaccctaaggctgcagtttgccaattcctgatgcacagccttagtaggggaggtccaacaatcagcttaaactgtatgcaaaataatgtgtggtgtatgtgcattttcctaattcatcaaattagtgaccagtaataaaaatgatgttaaaaaccaatgtcctagaaaaaggtgcatacatgctattaaccttaaaggaaattatatattaaaatagctttcaaccactttgtaaatcatactttccctaacgaacctgtcgacaggtctctaaattagaaagaattcagtggactttggtatatcttctttcttccagttccataggtactgaaagtgaaaaggggtgggaagcactgatctaaacctccctgtaccttagtcctatgagatcatgactagagtctgcctgtatgtttttcagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagag

SEQ ID NO: 38156 - DNA, 264590 bp, Homo sapiens; identical to SEQ ID NO: 37812

SEQ ID NO: 38157 - DNA, 66383 bp, Homo sapiens; identical to SEQ ID NO: 37889

SEQ ID NO: 38158 - DNA, 197653 bp, Homo sapiens
ggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcaggtaaagagcgggaaggcggcgataatgctgtcggggcgggggcgagggaacggtgagccggtggggacagaagcattcagagcccttatcctccctccccgcgcttcccacgtcttctagccagtggggtcggcacagggaggagaggagaggggttgttttgtctcagaaagggagtggacgtgtgtgttgaaatttggtgcggggatggtggcgaagccctttttggtgatctacacaaatgggatcaggacgtttctatgtgcattgtgaagacggtgtgtgtgtgtgtgtgtgtgtgtgtgtgacagaagggcgggggaggaagagtggaagagggagagagaatgataatgataatgaatgctgcgtgagcaagcagaagggagcagaagtcaaataagtagttcttgggtggtctggccaatggaggtagaggatgtagagatgcaaagagctgtcagagccacaggtgttaggggttatggggtgaaagagtttgtcatttctaaaactcccgtttttcttaaacattcagctcactcacgtttaagacttttgaagaaggtctggttctcaaatggccacttgtccccagcctcagtaatatattaaagcaaaaaaggaaggatatgttaaagttctacttcctgtgtgacacgatgaaagtacttcatctttgtacccttatcttccctttttcagttttacattaccatttataggaacttattttaggagctaaaaacgtggttcttcagtagcattatgaatccactactagttcattaatttactggatacggaggtgtgtatgttcactaagaaccaataatttatatttctgtacaaggtagaaaatatatgtttttaaggtagcacaaatcttacctatctcaatgttctggaatttcaaccatcatttattttgtcttgtgtacgtcagaattctggaaactgaattttgatttttagttttagatgtctataaaatatttatctctcagtattgcttatgaataactagattacagattgcttattctagctcttaaaaagcaatgtcatctaaaatgtgacatttgatgacacattttatatgttactcctatagcaatgtgagtccaaatctcctaatattctgtcattcaattttggtgcttggcattattaatatggtagtgtaatattaagtgtatgaatgtagacttatgtttgtatgattatggtacagtatgttgaatgcatttgtggtgggatagtctttcactctaagaaatgcttgttgtcattaacgggtaccactaagggaaatagttaaagaagtctaaagactgacttcaggcagctttattgcatcacatgactactgattttgttttactacacttaacattttttgtttttacaatgctggaattgtttgttcagaatattattgtaataaccagcgcagaaaaatgtttatcattattccaaaaatagatgaaaccattttcaggatattctatgtctgtatttttgaatttaagaaataacatatagacctctgggtgcatgttttaaagcttggtacctcccatagtacagtttgttatttggatccataatcataaatcacagataatatgatatgtaggtcatgagaacctttattctcttatccccatagatcacaagtatttcctgtggcccttatttgtgtaatttaactaaaaactcaaaattacatatttaaattatctgccaatgctaacttccaatatatttctgccttctctctttagtcaggtaatatactagcatagcatctgaaattattttaagtcattttattgacattttcactattttatattattaaagcaaatcacatattaaaacacacatgaagtattaaaaaatattacaattaaaacttttggaattggaaatttggattacactttattttcagaggatattttcaagaagtatggaagtgagttggggcgtatttatgtttaaagaaatttaacaaatcagtgtttttcaggttttaaaaaaacttatttggaaagttgctaacattttatgtttgactgtaattaaaatcttttttgaggtagagaacgcttcaagaatagatgctgtcagcaattgtttcatgtatttcatctaaaaatattgttagcattgtacatgattcttttcataattcaagtgtattgggtaatagtatatgactagatttagagtaacattatagaagtatttatattggtttgaatattagagatattgctggcttatttagtctatttctttgaaactgaggagatattggtaatggtgttgtagttaacagttgagtgctcttagaatgcatggtactatgctagaattccaaggtagagaagataaggaactaaacttttcaggggtttaaagtcctttgtttttagaaagaagaatatataatcaaaagataatgactgttaaaataatgttgcttagatgtatctgtttgtgttccatatgcctattaaactaaatcattatatgtcatatgtactgtttgaaatttcacctgcttaaaagggataggtactcaagtgtattcttatttattatttttctttctctttatttttctgtctgattatggcagttctatgctatactttcaacatttgttccctctccctttttccttcccctataaaaaccattccatagaaatgtaaaaaaaaaaaaaaaaaaaaaaagaggttgttattgttaactcacatgtgttgtgtaaagataccattgaaaaagtggctatctagtttgatttttagttatattttctgtggagtcagtcttgaagacctatgctttttataaaatgttgattattcttttggttatatgaacagaaaaggacttacagaatttcgttgttgaaagcaaattttgagctgccatatgcattacaggcaacctttgatttttttcttttctacaacaatggaaaaacaggtttagcctggataattgaaatcaaaggacaatcccaaatcttgtccatttaatcttctctcacatccaaatattttgactaggactagcagcaagaataatcttgatttatgtgatttttttttttctctagacaggcaagaaagtaagaggaactagaaccacttccctccagcctccttcatttgtttaatcaccctttaaataatggtttgttagtggcttgcaatcagaccttctcattcatcctcattcatttgttttaggacaacaaattttaaaaggaaagctctaagaagatgttattttctgtttactaaattagcaaatgaaaccattgttaaaagaagaaaatagtgattgttagtgctctgaaaaatcaaaccaaaccaaacaaacaataaataagtgatcttgaggttttgttcacatggcactcttgattagaaataccacattttccctactgggaatttttagaacattagaaaattttttcccacacattgattataatgtgtgaatatttttttcacacaatattatttagggtatgtaatcagtcccctaaagggattcctgtaggggcactaggtgaagagtgcaatttatttgaaatagaggcagaattttttcaatgctgagtatattacggtttaatttccacctttccaaagttccatttataatttggtcaacattttggttttatttttcctatgagaattatttatggtgtatctagtgtcccataacttccttctgggacattggctgagtatgtaaagggaagagtgccacctactgagtcaccaatagtcacctacctccttagcacctgggttttcctatggagcaagaacaagcctgccccatttgggcagcaatcactaaagagcataaagttgatatgagaacatttaatctcaaaatgaaatctatcgtacctccaagatattcttttctagaaataggaatatatgtaaattaagggactagaggtttacagagttttttgtatgggctaaataatatagatgaattaagatgtggtgttaggaaaattatttgcctattttaagtatataatgtcctgctttttcttgggaggagatcttttggcatggctgtccattgaaagtattttcatctcattactatataaggctcttgatactacgtacagtttttatagctacccaatccaaattatcattggttttcttcaaaaagaagaatctaaacatattaaaaaattagcattatatgaaaaatttgcaaatgggcttattgctcctgttaccagcattaaagtattactagaaagaaggtagacacaacagagtaggaaaagctgctggtgatttgaaacacagtttagttgtctcataaatttcagattaagtgtcatatatgggtgataaaagtggcataggctagattttatatactcatgattcacttagtttgtctttttcaattaaagctaagtctctttttcattccactgaatttacatttctttttcaatcacattctgaacacattacaatagatgctgcctaaaactgaatatagtgtaaatctcagactaatgtgttattcactgtggcttctttgaaaatatgtagtaaaaagattttgattattgtaaggtgctatttatcaagagtcatcttttagggttgaaagatgttcagccctacctttaaacagcccagctttctatcaaaatacatcatttagcttcccaaagtcaattttggaaattttgtccaatgattggattgtaagactctggtattttttacccattgtaccatgagagctcttgtgccagttcatgtcaccttttccatgtttgaaaagtccacagttcatctgtaacctgtaaaagtgctaagtaatcagggaaagacatcagttagaacaatcaataacttttcaattagccattttccaactttgggcatttggctctgttgatttgcatgtgcccagtttaattgatttttatgtttatcagtacctgtttggtcagagccataccctgctttaacagagaagagcatgtcttttttttttttttttcctgatggtagcttacattctagggtaggatccctatcatattaagtttggtgacagcacatctcaatgaaagcagagagaaatctggcccaattcacaatgtagagagagatgtggaattaagttagaaaggccatgggggtgctgtgtgattggttttacctttattttattgatctgcggctaagcatatggtggtagattcagcccaattcttgcgccctccccctcccccatacaattcaggccatcacagaggctgagtgtgtgtatatgcatgggccaggaggtattgggtggttggaggactaggcaggaagaggaggtgttacctttgtgacttgtttttaacctccagtatgcaagccctattctaggctgtttgatagtcgggggtggtgaggacaagtggccaaactgcttttcaagagtgggaatctgtgctagatactacatccagaagctgagagttactttatcatttgcaaaaaaatttaaactgttctgacctggtgtagttccaccttttcactatgtgatctgtgtagaagttggcagaaagcagttagtgtgtgtgtgttagatacttgtcccaaccacttgcgactccagggaaaggtggggtggctgttttttaggaggtctatatgttaaaaggggggaaaaaggaagattggagtactattcagtgatttggtgtgtttgcctcttaggggtctccatggcaattgagagatttctaacttaaactgctcaagattgctgagccagtatacgtcaacttttaattttgttttcagaccttaacatttatcgacagagcagttgtaaatctgatcttttcagaggccttctcccccagatccttacagctgtaccgtgagataaggtttactcttgacagtgttaaggtgtattaggagctaaaatcccatcacgtttactttcaccaggataactttttcctgctgatgacttgggctggggtggaggctgatggagataggggtaattctggggttaaatgcaagcagtgtagactctgcagtctatttggctgccggcccggaggcaggagatgggggtgggtgggggtagttagacctggtagttaaaccctttcccgcgggcgcagagtgggcctcccacgcttctctcccgtggccagtatgcgtgagagtgtgagttgagcccctgcctccgaggaagaattctaaaaaccgggctaagggtcgagcgagggaggctgaccttttcttgttatcaaattactgcgtttccctgaattacgggcactcaggaatggtgaaatctacatattaaccgaggaacacgaccctcaaaggaaggtagaagaaggctaacgctcttgctagtttactgtgcttgctagtttaccgtttgcagggctatttagagcacaataagaagcttcaaatctcttctccaaccagccagaggaacacttgattcgcccaagactcttattgcttgcttttgaaatattaccctggctctgagctacaaagccacagatccagccccatttgtctagtgagggctctgccccagacccggctctccatgctcactgctccgcctgagaggaaccctggggtttaacgctgaagtgcgtttctcagagggcagagctggagcatctcgcagccctacaacttctttgcggcgcttggtctgtctttgcgttgcgagatcaggatcggtgtgttgctcagacaccggccgaacgccaccggcacgtctaggagtctcctgtgcctggaagaggctggtttcattcgattctaaaagaaacgggtaaagtgtagattttaagaaataacctagatttcaaaagcttaaaaaccaaccaagtttggttgtggacagtcaacaaactaaaattatttcgggaactgcttccagtttaaagtttttttttttttttttttttttttaagcaaagcagtttctactctctccacatcacctttgagaaataatcacgaaaaagtcactgtttattaaataattttagttgctttaaaccttttctgggaaaagcttaggaataagtatattaaaaaaggctactctaaaaaaaaaaaaaaaaagaccatacccaatctctgaatttctggcatccttgaaaaataccgattcttcctacagtcccacactctttcaaaaaaaactttgtcataaaatagtaacatggatcagtattttaaaaacatgtttgggggcgttagagggcactatgtagagtgtttattgcagccttttttttttttttctgaatttttataaaactgaaatgaccttttaaagaaaaaaactcttgggggcaattcattgttattacttccagtgatagaaaatagattgtttgtttaaacttggattgtataatgaaaatataaaataggcaattaaatactcatggaagaggaaatcaaaggcaaacattgagtgaaaataacattaagcagactattccccagtcattgggccagtgattcttcctattgagtctggttggaagacgaatcagcagtagggatgttgcttcttcccttattccactttcttgcaaaagttactgtaatgatctcaggggagccagtgatcttttccatttcagctaatatcgaaatatccaaaggttgcttgctgttctgggcacaaaatttaaagcttttagagcaacatgcttcttcataagttttgttattttgaattcactttagaagtctgtgtctaatttgcactggtactagattatgtctctatgtcccccacatcaaaatataactcaaagaaagagaagctgtgacatttgctttcatttcattttcatacttttttttaacacattagttgttaatataactcaaggaaagggaagctgtgacatttgctttcatttcattttgatacttattttttaatacatcagttgttaatataactcaaggaaagagaagctgtgacatttgctttcatttcattttgatacttaaatttttaacacattagtcgttaatagacttcaaaccataagctattttttttaaattattacagtattcttaattattttacttgtcatattgacttagtgaaaaattacctgtacacatttattatgaatgtataaaagtttaattggctttcctcattggatcaagatacttttgtaatcaagaattacaaacattctatcacatatactaggttttaaatggttaattgtaagtacagttgaaagattattagattattatactactttgaactatttatacgtaatattgttttgatgctatacaaagtagttaaggaaaaagaaagtaaaacacaaatcccttccatatgaaataatcaatgatttatagccatgcctacttaaacatctttaatgatatcctccatattagatatttcaaaatgaggtgtgaaattctgaaaataaaattaaaattgcacagtatttcatgaataataagaatggaactagtataaaaattaaacctgtaaggacttgttggaattttacactagagagacccagacagcaccgtaatttagaagtttactaaaattaaaaaaagaggctatgagggaatgttacatgaagccacagaaatcttgtttcttggtgactatatttttatatagtggaagaacttatgtttgtacttcttccttaagaaatatttcaggtggtaataccaaggcaagaagcaagagctcacaaaactacacagctggttatcttttttatttgagggtagtcagaatgagtgtgtaggtaggaagaaggagggcttgatttgggaatcttggctagaaaagtggatttactttttcctttaaagcattacatgttggatatacctgaaaattgattatactagggaaaacagacccttgccagagacattagcttgtattgacataataatatgaatgacattttcacacaggaacttacaaaatactagaaaatgatattaacacatgcttaaaagcttggtgcttgcttccatataaagaatttgttttatggggcaccatagtttattaaaacttggtgtgtgcttcttccttgtttaatgatgccaaacatccaaatagtatttgctgtggtaagcataagtagaacttacaaattttattagctaagtggtgatcagatttgttcaacttagtatttgaaacacacttcaactgttatgctttggaatgataaataactataacaaattgtacaggtattaacacttatatgtagaaacaatcattgtcctatttatcttcacaaaacctttatttcttataatttgtatcctgtttcttatattgcatggtttagatgttgaaacatttgtagcagatatactgaaaggagaaaatttatccaagaaagcaaaggaaaagagagaatcccttattaagaagataaaagatgtaaagtctatgtaagtcacttaccttttgtttactgatttcttacatagaagcagttttgtaactaacattttaataagaaatcgattattatggagttaaatttttcatgttccagtttaactgatgttaagtatttttgaagggcaaaaaatatatttccactatatagtttttaaacacagatatgcttatcatagtacccttcttgattatgtatttttctgagcattctagcagagttcagctgtttattttgattatctgagggtatatttggtttaaatgataagacaaaggtggattgaggactttaatatacagaaaatacctgacactgaagaaagagaattcttttgttactactttaaatgaataaatgtaatatatttacatgtcataagtattaaagatatatcctcattttactactgtacttagatccttaaaaattattttatttaaaatttttaagcattttggaattgtcatttcaggacaggaattagtttttttctaatgtatatctaggtgtgtatttttaatatagattttggattttaattattgttactgattagaccttgttttgatttttcaacctcatttaaaaatatgttctttgttttgtagctatcttcaggaatttcaagacaaaggtaagttttcatgtttggcaaacttgaaaatttttttcctctgtggaaattttcaataggataatctaacacatactgaaatttgatagttggaattaaaatttagatttccgtaatgtgtacttagaccttcaagatgagagtgctagctccccctgctgagaagaaaattaaaaagtatatccagaatttactctgcacagtcttctgatgcggaaatcttaggcatttaacattcttaggttttgtgtttcttagagtacattgtggcagaaatttgttaggaaaggtaaaaacgtgcaattacacgtggaataacttggtgaagcagaggtgagatactaacccactgccatttaacactgcagagattattttatagtggtggtgggagaaggtcctgtggctgagtgctcacaggtaatgtttttgaaggatattttgaaaacagtgtaaatttttgtttgagaacaaacaataaaatctttttcaagtgaaagtttttattttccttgtggttattttgatatgaatacataggggccatagacattttttaaagaagggaattcagtttcatttttttttgaaatatgtgagaatgctgataacctgattgtctccctctagatttgagagacagctgcttagcagactgaaaaccagatcaggaaaggtataggaacttcctactactttatatattcaattctttaggggaaactgggtgtggcccttacttccatgatacttattcataggttatgatgtacagcttgtggatgctggtgtgagggttacaatatgaggttagttaacctccatggagctaggttctgggtttgaggaagacacacagtatggcatcttctaactgaagctagcagatcccagagtaaatcatatttgtgccaactggtaagtgagaaggtggtaacagtttcaataaacaaagaacttaaccagacaaacctaaaatcaattaaaaggaagtcacagtttattttcccattagatcatcaagattggtatgattgaagggaatgagaagagatttttttttcatattaagatttttaacacttaaataaagaaatgagcaggaaactattccctgtaagtacccagttttttttgtgctctacaagaaatcctaaactatgggtttaattatgctacattttgtttagacgaatgtataaatgaatttatgcattttaattacgataacttttattatgtagtatactttatggaagaatattagatatcagattctgcctctcttaaaaggcatattatttccagtgattatcgaacttgcattgtgctttgtggcttaattatttgtacatttaaaatttttaagctaaaaaagcatgatatgaagtaattgtgtaattgcatatggatcagtaatagttgggaagctttccctttggtattttgttttagaattcgttcaggtgtgtggatattaaaattacattactgagatacattctttgtctctaaagagaatggaaatttatatggtatttgatagaaattgaaaaatgagcataaaatggagttcaaatagcatagaatttagagattgctcataatcattttcctctgaataagtcatttgtagttcaatactgctgtattgagttaactaatcacaaagagtgcctgttcagaagtaagcctgtagatgaattagatgtataccttggagaaatatgagctgagtacttttatgccattgtgtactcaaagtatattcagctttgttctaaaaagactattcctgtactttgttaggcatagtaaagggtacagacctaatagttgcaaagtaattattcaatatatagtacatcttttttaaaaataggaatttattttcaggtctctacattgagtaaattcaattctaagtacgttttggtggtgctgccttttctccaccttacattttccctttgaggttttggattatctttatccaagaaggtctgggcagaagtccttttggctgctttcccgtcctttctcttccctcttgtctctctctctagtcaatgtagggtcacattgtgaacataacctttttcctcctttctacctttacacccttattttatttacatatatgcatatatgtattttaaatgacagttaagtatcattttgatgtcactattgggggggtaaaaaggaccaggtagagagttcttaaataaaaagagttaattcagatttattcatatctaataagtcggttattaatttctctaaggcacacagatgtgtatcatccttccttacttccctcacaaatccttcccttctactctagataatctcccatcctgagatttaacaatacagattttacagtttgaggtatttcttttttttttttttttaattattatactttaagttctagggtacatgtgcacaacatgcaggtttgttacatatgtatacatgtgccatgttggtgtgctgcacccattaactcgtcatttacattaggtatatctcctaatgctatccctccccacccccaccacccctcaacaggcaccggtgtgtgatgtccgccttcctgtatccaagtgttctcattgttcagttcccacctatgagtgagaacacgcggtgtttggttttttgtccttgcaatagtttgctgagaagacagggtctctcactctgcgtctcaggctggagtgtagcggcaccatcttggctcagtgcaacctccgccttccatgctcaaatgatccttccacctcagcctctggagtagatggaactatatagtagatggaactataggtgcttgcctccatgcccagctaattttttttttttttttttttttggtaaaaacggggtttcgccacgtgtcacagactggtctcgagttcctgggctaaagagatcagctgcctcagcctcccaaagtgatggatcacaggcatgagccaccctgcctggctgtcaattcctaaaatttaaaattaattgagttgatatggtagttgaaacactaggctgcatagatcttaggagatttttttggtatttccatttttttgggtgagaatagtttacactggtagaaactcgttttattacagtggcttctagatactgaagcttgtgtattaggctaatttttcacttgtttatattcatttccatagaaagctattgttttaaaactttctttttcatttattaaaattcttcttttatctttacatgtgcaagtcttgattcccctattgaagagatctgacaaattgccgctttagaataattatcagctgattttctaaattccttaattttacttgtacttaggaaagatttgaatctaatcagctagaacacttcttgcttagtctagtccttgttattcatttgaaatattgcttgttttatctggaacagatagttccttcttatatccttcaaagtattgtacgtgacagaataacctagtttctttttttcttttctttttcctttttttttcttttttttttgagataggatctcactctgtcatccaggctggagtggagtggtgtgatcatgactcactgcagcctcagcctcccccagctcctttgggaggctaaggtgatcctttttccatttagcctcctgagtagctgggactataggtacgctgcctgtgtattgtatttttttgtagagatgggttttcgccatgttgcccaggctggtcttgaactcctgggctcaagagaccacccgccttggcctcccaaagtgctgggacttacaggcatgagtcaccatgctcggccgacagaataacctagtttctaaccgtagatttttacttgcaatattgcctcatattataaagtatcctcccgaatttaggcttcatgcactggaattatgctatgtgattatttcagcattgttctctatcacataacaaggtcataggtctcttagttgacttgaaataattatttttgcaatgagaatatgttactatttagtaaatactgttattgactaataagaattttctaatactgtatatattaagtacatgataaaaaaatttgggctatagttgtgtcttgatcatgtattagtctcagttttctccagagatgatttaggtgtgattactttctttatagaatgatgtactgaaataagataatgtgaaagtacatagtaggtgtttaataaatattaatgcatattctcagattcaacttcatttgtcaagaagatttaagttaatcttgattcataaattcagttttcaaacaatttgggggaaaatgatcaattattaaaagaagggcatatttattagcattagtcaaatgtttcatgagatttttttttcaaatttgtaaaatgttagtgtctacagctttttttttttttttttgagatggagtctcactctgtcgcacccaggctggagtgcagtggcgtggtctctgctcactacaacctctacctcctgggttcaagcgattctccttcctcagcctcccgagtagctgggattacaggcatccaccaccacgcctggctaattttttgtatttttaggagagacggggtttcaccatgttggtcaggctggtctcgaactcctgacctcaggtaatctgcccaccttggcctcccaaagtgccgggcaggtgtggaccactgtgcccggcctagtgtctacagttttgaaaaaggggaatatactgcttcaggtgctagagatagataaaagtctcattttctcctttaaaatctttttgctctaattgtaaaaaaaaatagattttgccttaatattttattgatattgttaaatatgcatagatttacttagaaagcagtttcctttgaccttctcactcatgctgtttcttaagtttattaatggactaagaatagcagaataagaatagcagaaaagtctgaagtttggatgatgtttaatttccttttttaacccttcctaacatagtgtgttttctgttgaacgataactccacagtgaaatctgaggaaataattcacagctttttccttcgaccacctacccccaccattggccttgtaaaaatgtcttaagcatgtttgaaatgatgggacctgtagtagtagaagtatatttcacaggcagtgcttgaaaaatggttttttcttattttaaagctctgccccagttttgtgccagaagttgtctttagtatttgcatgccctcctattgtagaagaattatgaggagaatcttcctttcattgacctagattcttcagagccttaagaatgaaacttttcctgaagaaatgacaagttaaatgcttaattatgtatatttagctatatattattacttgaaaaattagacaagtgaactatgtagagaattagaaattaatttattttcattagagtaatttttccccatttgtcttccagtaagaaggaatggttatcactcagattttaggtacaggtttagtagtatcccttatccaaagttcttgggaccagaagtgtttcagattttggattttgggacatttgcatatatataatgagctatcttgggggacggaacctaagtgtgacactaaattcatttatgtttcatatacaccttgtaattttgtgcatgaactaaagtttgcgtacattgaaccatcagaaagcaaagatgttaggcatggaattttccatttgtgttgtcatactgacactcaaaaagttttggattttggaacattttggagttctgttgatttagggatgttcaacctgtatattacttcatttcctgtttacctgattgtgtttaaaataggactgttttgaaaaaacaagcaacaaattgggtaaatcagcttcagtggttgtagagattatgactgttcagttgttgttgggctacatctctaggcatttgggaaaatgttaattgataatgaaccatatcagaaagaatggctaatagtaatttgatcccagctagtataaatttaaaaatgtttttcagaaaaatatgctgctgtagtatgattaaaccttgagtttgttgcaatgtttgttactactgaaattataggaaggtaagtcttggatcattgtcttttattctgttaactttgtatcgttaattaaacttttgaaagttgtgggataaatcaaatgcttttctagggaaacaagaaacagtattaatgagcaacaaccccatcattatccttgtgagtacataacagggacacattcatgtcttttctttgtgcaataacttttacaaagaagtatttttaaactgatcattaattttatgaccacagaaatgagatgcaaaatttatgctattgtcagtggcacaggctcacagcaccactgacattttgtgtgattgtaatagaatggctgccaactaatgattctgtagacatttcatttgagtgtgcttttctttagatgtgtgattagctgtaatgctttcacttatgtctgtaaattatattggatatgtttacctgatgcctattgttgatttggagttcagttttgtattacataaatgcaagttgaacttttttttttttaatttatcgaagtctttgcaggtataactacaaatactcagcccctggggaggaaaaatgctttgcactactcaacagtaacccctgcgttcagttaaaactccttataagacagcagcttttactctttattgggtcgaaaaaaaaattaggggggaggaaaagggatggaccatcactggaacaatggtaagatgaagaagaccatcttgaaaaatgatgtgtcctttccacttaatgcaggttaaaaaggggctatccctgtatatatagcatatagattctttgctctctgagttaattcaaaggattatggggagaaaaaaataaggaagaagtgaagccagtagcagtacttaattcattttgtcttaggtaaatgtaaacatcacactgatttaaaaaaaaaaatacttgcagtgagctgcaattcttagaatgggtaagttgaagacaatttcattttaatatataacccaaaagcgttttatttttattttgattttttgagacagagtctctgttgcccaggctggagtgcagtggcataatcttggcccactgcagtggcatgatcttggctcaccgcctcccaggttcaagcagttctccctgcctcagcctcccgagtagctgggattacaggtgcctgccatcatgcccggctaacttttgtatatttagtggagacggggttttgccatgttggccaggctggtctcaaactcctgagctcaggtgatccacctgccttggcctcccacagtgctgggattacaggcgtgagccaccgcacccggtctattttttaaaataaaaaccgaaaccatgactttctataaaagtcaaaaccatgactttcataaaaaccaaaccatgaaagcctctcaggtctttcacctgttagtgatcagtttgtgtagaataaatactctttactttgagtttatagctttagtaatgaactgttgatatgtatgtatatatttatacatattcgttgaatatagaatcgtgtttgcatttgtgtgtatgtgtatataaatgcatatatacacatatatatatgcacacataataatggatgttatcaaaggataataaactacttctaattttaaaaactaagttttaattttttctgtttacttccacctagaatttaatataatttaagcctgaatatctgaatttttttcaaaatctttgctatatattatttggtttcactgttggttttaaatagttataatagcaaaatatgccacatgctaagttctagtaatgtttttgaagtatcctaatacttttttttgcagcaagattttttttgtgtgagatatgaaatattcttggaaaattcataccacaaaaattcttaatttcattaagaatgtaaagatactctaacaactaagagtaactgagaatttcttgatccctactggtacatattccatgaactgttgtaacatgatcaaaatatgtttactagcactttatgaagttccttcctaccttatatttgaaatcagagcactcttcttttgttaaaaaaatttttttttagagatggggtcttggtctgttgcccaggctggaatgcagtggtgcagttatagctcactgcagcctcaaactcctgggctcaagcggtcctcttacctcagcctcccacagatgtgactataggtgcaggccaccacacccggctaattgtttttatttttatttagagatgtggtcttgctatgttgcccagcctggtgtctaattcctggccacaagcgatcttctggcctcaagcatgctgagtagctgagattacaggcgtgagcactgccaccagcctagcactcttcttttcataagagaaatattgtaagggatcattgagtgttctgaaaaggactttgaacatctgaaaagaaagagaaattaagttccaaagaatgagtagtatttatgtgttccttagaattttaactgtgggagtaacatcaccatatttactgtacctagtagtagaatccctaaggatgacaatatagccatctctatgttctgcccttatcatcttaatgagagatgtctctgatgacagttgctcacaaagtggcaaaattataaggaaataggaatatgtatttttaaaaaattatttggacagtgttgtcttgagagaggctattttctctaccaaaaatgtggtaacaaatagggtgacacccatcaaatgggtgtcagaggacaaagatacccttttggagagacaagtagcattaatctgaatctgccaggaactgtggttcaaaagtaatactataggcactctgcggttcctatggggattttccttgtgctttaagggtaatccctgaggtggctgtttttctgtcaggtaacttgaattcaacagtcaaatacttaatgtagaattaagcatacttttttctttgttgtgaaatccgggtgacaaatgaatgcttatgtgtaactgggctagcaaatatttgtgtttttttaaaaaaattattttaaatgattatatggaaaaaattgaaaccacaagatcttgtggagattaattagcctaaaatagaaaagtcaatcaaaaaatcgaccaacgaacctaggatttgaaaatcaagttggaaactggccagaacattaaaaagtaataacataccattgaatgaaactgaaagtgtctagtttgtaaattacccttacttgaatttaaaaagattatgaaaattttaaagcagttttttctataaaagattttaaaagatttgtgctctggaaaatgcaacagattatttttaatcctctctaaaaatgtataaaatgtataaaaatgtataaaatgattttatacaaaatattcatacagcttcaaattattagtttctcatcataatttttcaaattattgaataggtaaatggaattacttgtattatgttttctgttgtgcttcctgggttttgttgttgttgttgttactgttatcttggttttgttcgtttggatatacactctgttttaccctgcttctactttttggattcttctttgtagagatcatcataattttggactatatccttttgtgtcataaataagcaattgtataatgaccttcaaaaattcttactatatctaagttacaatggctataaaataaaataagacctgtttttacctagttttaaaagttttctttgtttttccatgacaatgactcaatttactagtagaatttacctcttctaacaaagtaacattaacattaagtaacattactttaaatggctaaagtataaaaggcagttctctgattttttttttttttaacaggtgatgcagaagatggggaagaatatgatgacccttttgctgggcctccagacactatttcattagcctcagaacgatatgataaagacgatgaagccccctctgatggtatgtgacattttcccacgtaactctgacactcacacaaaacaatgctatatatatgggtggtagttttatgagaaagcagatgaacatagaggcttcggttaacttacctttaccaaaaccttttaaggaacagaagagctctctctagtggttctggtgaggttttcctaagtatgtagttggttctttttcttggaaattttctttactaaaatttttgagagagtgcctgtatcatcatatgaatattattagtaacagtttgatagttaatttaatattatcagattcttgcttaattttattatgctacttgaaggcttactgtattatttattttataaataataaaaaagatttttgatctatttttttctgaaaactttatacaaaatgagttaataaaatattaagttaattttccgacattgcctcttcacactgagacaggtttttatcaaatgcttcttttaatgcgcattttcatttttatattgtcacttaaaagtggaccatattatgcagtaatattgcagtgtttgtattaactgaattagtaataaatttatctcttagtaatttctaaaagctattgaatgttgccaaagttatgaaacttgtttttagtgtagtatgtactttctctgttatagccattgagtacatctgcattatagaaaccttataagggtaatatatagttataaattaagaatgtgtatcaataaattagtcatgcatattaatttgtagcactcaaagtttcacatagacatagaaatgaataataccttctgccactatgtgatgatcaaactgtgcagttccatctctaaatacaattgctgaatgaaaatatgcttcctgcaacagagcactccacattttatgttatccagattattccctttggaaacataaattgcttttatgaggtataaaattatgtctgttgcagaacggggataagtcaagtacatgcataagtgataaacattctaaccagtgattcagtacaaaacaatctttttttatatccagaactttgtacaaagtgtagcaataatagtcatatctattttatgttgaattttatgcttcggcaaacatttaatttctatttttaaagggagggtttttttttgctgttatattcactttctatcttttaaagagataagcatttcttttctcttcaccaaaacagagcattaccctttccaacctcatcttcaaaagcatttctactagaaaatgttttataatcaaagaaataatattttcaggcaaaacaatgaattattatttaagtggtactatttttcagacacattacaattgctttatttctctgtaaaatgttggtatatatgaatgtatgtgtgtatacacatacacagacagaatatttatactaagagagacatacggagaatatattcatagactatatagacatagtttcttaaaatagcataaacattttgatatacaggggagtgctatgtgtattcttgaaaaatttgcaacctaaaaagaaattcaacaattaaatatctatgagagccagaaatcttccagtagcttgttagaaaaagtaaattattattaaattatagtgcatttacattattgttttctttttaatagtaaataatttatcatatatttttataacaaaatattcaggaaatacactaaaagattgttgttaaaaggttattttattgattttaaatattatttaataacatttatatgtaacatcaagtttttttgttaatagtgcctattcattagtgtttaagcaattcttgagcagattaaaacttttacctgtagtattactcatttttgatatataaataatactgtttttgatactttcacattttcttctaagaatatcattattaaaattaatttttaaactaccacttggacatttaatattcactctaaaatatcatctcaatgtatcagtttttctctcttcaacttagattttgtgtgtgttctctttcctttgatgaataaatttgcttcattatgtgacctcagtccaataatatattaattataaaaaagataatgcatttaacaataagcataaccgaattagcacaggtcaccaaaaggccttttgtcaaatcagattgttgttttgtccttttgacttttaccttatggaaggcactaagaaagtatctaaacttcaatgggttataaactctaaacatgatatgtatttttcataatgctaatgtaattttcaaggtactgaaaaggtcaaacctgcacatctctatgtgcattctaagtctgtcttttgctttaatatttatttttctctattcctctggttcaaaagttcactcagttcccaaatggccacctaattttccagttattcccccaagccatatgtgttttggtttctttatggtttattaggtactgtaggaaagcagcataagttatatcttctaatgaaattcaagcacacttcagtgatgcttcgacttgattgctggtagcaattaaatcatagccaaggagaataatgcataatcttacaaggtccaggcaccgtatagaaattgaatggggatgaaaacaacaaaaagaaagtttccaaaccctgccaggtacgttgttttcagcctgcctttttttttttattggccaactgcctgattgatagcaaaatcataacttgctgcatgctaacaggcagagttcacttgtaggttattgtgagctgataaagggttagatgcagttttgattttcgcattggaccttggtacaccagattaatggaatttcaatgagagactagagtagccacagctttgtcagagaaacagatggagattctatagtcatgtctactcattaatactagttgcctgaaaggtgtgctgcttctctatacaaaagagttgatataattgatttttgagttgtacattggaaaaaagtaccttattgattactagaattgtaacatagatggtgacagatttttgtatagcttgtagcttaaaaatattgtactttgtaaatttttcttttccctctttggaaatgcttcttatgttttatattttttgagaagaactacattttgagaccaatagcaaaaaaagagagaatgacatgccaaatacctttttaggaaaaagaataagagtctgtattttatttataaatgattgcatgactgctgttagagtttcattttgatattctatttagaagaaagtatacttattagaagtttcattttattagctttatgcttgatttttttctggaaaacaaaaaaatcgtaatagtttctagactattgtagatcactgttagaagttttatgctatcatgtggctggatatattggagtttcagtataaatggtgcatgtcagtaatcagataaagttagagataatgagatttacaaccttaaagaatatccctttctgtacactttaaaatgtttaggcactaaggtgggtagatatagagtagactttagacaccatataattacttgggtttccatttttctattctgaaatcatttttcattcatttttgtcatttgtgaaagaaagcttctaactatatagcactatggaaagtctctaaggtaaggtgaaaggattcagtgagctagaagacatatattggctctgcccctcgacgataggtcgaaggatcccagtagatgtatgttacaaatctgattcagtcctagaccataatcactttgtggataaaaatctgaaacctctagggtgtgaatacaggaaggctaaaatgaagctgaaaatatagaacagtcatttattgtcctggtgtctttctaactaaaaatttctgaataacctaggttactgaaaggctgtgggcattgcgagacacaggtttgtgtgaagaaatttttttttaggaatggaactattttttaaatctcagggattaagaaaaaggctgaactattatcataatttataatattaaaaattttttttggtatacttttctttacaaaaatccaatgtacaaaaatttggattaataaagcatgtaaatcattttttccaacagatttctttagagagattgtctccaggatgcctataaataattagctcttagaaagtgtctaaaacaggcttagatataaacctgtccgtgtgcacaacataaatttaatgtaccaaatttttgaggaagactttttttgtgtaaaattaggtgtagcactaatcagttcttacaaaagccacgaaatagatgttttacttttctctcatatcagtagagtatgaaacaatgtttaaaactggaaaaaaaggtttttttcaataacttagcatttaggataactatgaaacaatgtttaaaactagaaaaaaaatttttcaataacttagcatttagggtgtttttaacccactatcatatttttgacacctaaaattatcttttgtattttgttctaaaaaattcaattaatttgcaatttgcacatatttttgcatatataacatgtatcaacatttcacttttgtttttaaaatttttgggttgtcttaatatgccaaattgctagcttatatatgttttagcagtttaataacaatgattattttagtcattgtgctatgtgtatagcacagtttcaagtattttggtggaagagaagggattatagttgaggaaatgacagaaagtagaggacatatttttaatcctcaaggtatatattgtgcaattggggatataaagtacacagatgtaaaatatttttgtgatacaaaggtatatattagtaaataaaacacatagccattgagaattatctttctaagtttttatgctattgatcaggaaaattcatcagaataaaacagagtggacggatgatactataacaaagtggactagatacgaaagactgcaaaggttaagtaaaactcaacattatgaaaaataatgcatctttaattcagcaaattagcagttatttacacagtacatgaagaggagaacaagatacttggacagggcaattgggggtgaataagataaagttcctatttttaagaaaaatgtaatctagatggcaggagaagataatcacctagaataaggtaactagcaatctaggttatattaaaccagattccaaaaataataaatactacgtgctacaatattcaattgatttagtctataccaaggcaagtagttggtttcattgattttacttcctgatgtattggctgaatcagccatatgttttagcatcctgtcaaaaaaaccacagcataaactttatgcctaaattctaagagattgtggagggagggccttttatttaagtgagttttatgtgggtcttgaggtttgttgcagagaatgggaaaacaaactgaaaagaacttttggagttcaagctcagaaaccaggttttcattataattgatgataacttttttgtcaaggacaagttgcttaggcctttttggatttttattttctggtatgtgaaatgaagagtttgaaccgggtaattgcttagacgttccctagagcactaaatgcttgtgtccccacatttcagaattagtaaattgaatggtggcagtgaggtgaggtgatctgcatggggaagatatgggtgacgaccagaggtggtattgaataggaaggagtggagggggtcttggaggtaggtgcatgatttatagtaggagctgaatgccaaattaaggaatttacctttgatttggtagtcattaagagatccctgaaggagtatactgaagtgagggatgcagatttgagggatattgtcctggaagttaaatgtaggttaaatgaaggcgtagagaccatctagtggaggtagcaagctaaatgctttgctacattacttatttttaatcatgacagtatctctatgaagtagagtactatcactatttgacaaatgaggaaacctaaaatagagaggttaagtgatatgcccaatggcatatagctacatagtggcagaactggaatttgaattcatgtctgtcaactgtaaggattatgctctgctcttaaaagagttactttttccctcttccccagctagcatactgctctgctgcttttgattaagggagtgttgataagactctgggctagagaggtggatattgtactgaaaaggaagtgattttctagccctttcctactcaaagtatggtcagtagaccaacagtatcagcatcatctgggagcttgttagaaacgctaaatctgtctccacctaatatagtttggatatttatctccgcccaaatcacatgttgaattgtaattcccagtgctggaggtggggcctgttggggggtgtttggatcatggggcaaatccctcatggcctcgtgctatcttcgtgacagtgagttcttgtgaaatctggtcatttaaaagtatgtggcacctcccaaccccactctctgtctcttgttcttttaccgtgtgttgtgcctgctcccgctttgccttccaccatgattgtaagcttcctgaggctttctcagaagccaagcagatgtccagtgccatgcttcctgtacagccttcagaaccataagccaattaaacctctttctttttcttattattatactttaagttctggggtacatgtgcagagcgtgcaggtttgttacataggtatacatgtgccatggtggtttgctgcacccatcaacccatcatctacattaggtatttctcctaatgctatccctcccctagcccccaaccccctgacaggccatggtgtgtgatgttcccctccctgcgtccatgtgttctcattgttcaactcccacttatgagtgagaacatgcaatgtgtggttttctgttcttgtgttagtttgctgagaatgatggtttccagcttcatctgtgaccctgcaaaggacacgaactcatccttttttatggctgcatagtattccatggtgtatatgtgccacattttctttacccagtctatcattgatgcatttgggttggctccaagtctttgctattgtgaacagtgctgtgataaacatacgtgttcatgtatctttatagtagaatgatttataatcctttgggtatacacccagtattgggattgctgggtcaaatggtatttctagttctagatccttgaggaatcgtcacactgtcttccacaatggttgaactaatttacactcccaccaacagtgtaaaagcattcctatttctccacatcctctccagcatctgttgtttcctgactttttaatgatcactgttctaactggtgtaagatggtatctcatggtggtttgattttcatttctctcatgtccagtgatgatgagcttttcttcttatgtttttggccgcataaatgtcttcttttgagaagtgtctgttcatatccttcgcccactttttggtggggttgtttgtttttttcttgtaatttaagttctttgtagattctgcatattagccctttgtcagatggatagattgcaaaatttttctcccattctgtaggttgcctgttcactctgatgatagtttcttttgctgtgcagaagctctttagtttaattaggttgcatttgtcaattctggcttttgttgccattgcttttggtgttttagtcatgaagtctttgcccatgcctatgtactgaatggtatagcctaggttttcttctagggtttttatggttttatgtcttgcatttaaggctttaatccaacttgagttaatttttgtataagatgtaaggaaggggtccagtttcagttttctgcatatggctggccagttttcccaacagcatttattaaatagggaatcatttccccattgcttgtttttgtcaggtttgtcaaagatcagatggttgtagatgtgtggcattatttctgtggcctcttttctgttccgttggtctatgtatctgttttggtaccagtgccatgctgttttgattactgtaaccttgtaatatagtttgaagtcagatagcgtgatgcctccagctttgttcttttttgtttaggattgtcttggctatacgggctcttttttggttccgtatgaaatttaaagtagttttttctaattctgtgaagaaagtcagtggtagcttgatggggatagcattgagtctataaattactttgggtagtatggccatttttcatgatattgattcttcctatccataagcatggaatatttttccatttgtatgtgttctctcttatttccttgagcagtggtttgtagttctccttgaagaggtccttcacatcttctgtaagttgtattcctaggtattttattcttcttgttgcaattgtgaatgggagttcactcatgatttggctgtttgtctattattggtgtataggaatgcttgtgatttttgcacattgattttgtatcctgagtctttgctgaggttgcttatcagcttaaggagattttgggcagagatgatggggttttctaaatatacaatcatgtcatctgcaaacagacaatttgtctccctctcttcctgtttgaatacccttatttctttctcttgcctgattgccctgaccagaacttccaatactgtgttgagtaggagtggtgagagagggcatccttgtcttgtgccacttttcaaagggaatgcttccagcttttgcccattcagtatgatattggctgtgggtttgtcaaaaataggctcttattattttgagatacattccatcaatacctactttattgagagttttttgcatgaagggctgctgaattttatcgaaggccttttctgcatcttttgagataatcatgtggtttttgtcattagttctgtttatgtgatggattatgtttattgatttgcatatgtcaaaccagccttgcatcctagggacgaagccaacttgattgtggtggataagctttttgatgtgctgctggattttgtttgccagtatttcattgaggatttttacatcaatgttcatcagggatattggcctgaaattttctttttttgttgtgtccctgccaggttttggtatcaggatgatgctggcctcataaaatgtgttagggaggagtccctctttttctgttgtttggaatagtttcagaaggaatggtaccagatcctctttgtacctctggtagaattcggctgtgaatccgtctggtcctgggccttttttggttggtaggctgttaattactgcctcaatttcagaacttgttatgggtctattcagagatttgacttcttcctggtttagccttgggagggtgtatgcgtccaggaattcatccatttcttttagattttctagtttatttgcatagaggtgtttatagtattttctgatggtagtttgtatttctgtgggatcagttgtgatatccccttcatcattttttattgagtctatttgattcttctctcttttcttctttattagtctggttagtggtctatctattttcttgatcttttcaaaacaccagctcctgaattcattgattttttgaagggtttttttgtgtctctatctccttcagttctgctctgatcttagttatttcttgtcttctgctagcttttgaatttgtttgctcttgcttctctagttcttttagatgtgatgttaggttgtcaattttagatcttttctgctttctcttatggtgatttagtgctataaatttcctctaaacactgctttagctgtgtcccagagattctggtacattgtgtctttgttctcattggtttcaaagaacttatttatttctgccttaatttcgttatttacccagtagtgattcaggagcaggttgttcagtttccatgtagttgtgcggtgttgagtgagtttcttaatcctgagttctaatttacttgcactgtggtctgagatactgttatgatttctgttcttttgcatttgctgaggagtgttttacttccaattatgtggtcaattttagaataagtgcaatgtggtgctgagaagaatgtatattctgttgatttggggtggagagttctgtagatgtctgttaggtctgcttggtccagtgctgagctcaagtcctgaatatccttgttaattttctgtctcgttgatctaatattgaccggtatcattgtgtgggagtctaagtctctttgtgggtctctgagaacctgctttatgaatctgggtgctcctgtattgggtgcatatatatttaggatagttagctcttcttgttgcattgatgtctttaccattatgtaatgcccttctttgtctcttttgatctttgttgttttaatgtctgttttatcagagactaggattgcaacccctgctttttattgctttccatttgcttggtaaatattcctccatccctttattttgaccctttgtatgtctttgcacgtcagatgggtctcctgaatacagcacacctatgggtgttgactctttatccaatctgccagtctgtgtcttttttttttttttttgagacggagtcttgctctttgtcacccaggctggggtgcagtggcgcgatctcagctcactgcaagctctgcctcctgggttcactccattctcctgcctcagcctcctgagtagctgggactacaggtgcctgccaccactcctggctaatttttttttgtgtttttagtagagatgggtttcaccgtgttagccaggatggtctcgatcccctgaccttgtgatccgcccgcctcacagtttgtgtcttttaattcctagttacagatttttgaccctctgcatacttttttggtgctggggtggtagggagtctagagttatctgacacactgctcagcttctctcttggttgcaatgctcatggagaaggcttctttgggagctagttcgcttgcttagagaatgagagagtggagtttgggatttagcccgaatacacaagcctttactgccagctgcttttgaggatggacccaagggttctagctgctttgattacagttctttaatgagttcttcatcatcctgtatctttgcttgtagcatctctgagtcttctctttgtgaaaactagcacttattctccttggtatcctcctgggcttaggtgtcctctgctgtgtcttcattactccagtctcatctgctttccagttgcaaggaattactcaaaaattttggtccactttctttaccttttcttgattaccagttttattaaagctttcttctttttttcttttttagagatggggtcttgctgtgttgctcaggctggccttgaactcctaggctcaagtgatcctcctgcctcagctgagactacaggcatgcaccagcatgcctggctcaaggctttattctttaaaaacaaacaaaaggaatttcaaggaaactttaggaggaaaggttgatgcttagtctatgcttcctttttaatgacaccaagaggctgctgtatcctaaaactttttcataactagtctattagaatcattggaagaagtagctccctggctaccagtcaaaggtagtccaaataagtatgtcagtcaagccttagatatagtcacttagagtgaatactagatttctagaagaaccaagatgctataagcaatagaaaggaactgttctttcctgtaaaaggactacagtgttgttttgggtaaaaggtatgcatatctaatagttggaaaccttaccaactttattcagttgcagaaatgtgtggcattgaccataaatactctaagaggttaaagaaggaagaagctattgccaactggtgtcagtggttagatgttttatggaagaagttggagtttgaactagaatttagtaagggtggatagaaatttaattagtagagaatggaaggaagaatactttctacataagttaagggaatgagggacaaggggaaacggagctggaaatgaccatagtttgatgaactgtggaaagactaacatgactgagaaaggttggagaatgggagatgaggattgacaagggtggcatgtgaaaagttttggctctggcttcaggtatttattttagagtgactaaggtatgggataggacataccttagtcactctaaaaatgaaacatagtagttaagaacatactgcctgggttcaaatacttcattgcctgtctctgtgacctccagcaaatttcttaacttttcagagtcttctcatctgtcaaattaaggataataatagtatctataacctatggttattcttaggattgagtaggataaggtatataaaaagtttagaatacttcctgacccatagtaaagacatattaaatgtgagttactattgttatccagtcaattttagggattatcttaaataaattttcctttttgtgttagacacaactgtttgtgagtgttgtctaacttctatactatatagctcatatgttttactggctaagatgaattttgtaggatttgcagttggaagttttagggattccatatacacaatcattttttcaacagggtattctgtgttgaaaactgttagtggttaaatttgctatagcaaatatatcatgcctttttcttgaacccttgtacttctttgtgccttggcttctttcttttgagtaatgagcatgtaagaataaagaaattttatacctggaaaaattttatacataggcatcatgagccttgggaaggagtcactgtgtttgatacatgagcttgatagctagtgactaaaaatttacaaacttttaagaacatttgaatgagtttggactgcattagaagatcacttatgaagctatatatgaaaataagtggggaaaaaatggtcccaaattattaggaaacaaggctgccaatcaaaacctcataattctcattcaagaactgaatggtataatgctaaagacaataacaaatccaaacagaaaaagtagtacacataactaaaatgcagggctgcaaagtcattagtagcaaataaatgccctgttaataaataagcccagagaggattagggcaaaactgtatattatttttacaaaaattaaacacagagaaggtaccattctccagctttcacatgtgcttatcaaagtatttctttttcaaaactcagagtcgatatcagggtccttgcttcacacttgaggaaaaattaagtatgctatagatttaaaaataacataaatactattgaagaaaatatctctgcaaggaagttataagaattagctcaggtaaattattttcttgagctcgttatatatgaatagcacattgatttacagaattgagggtaagacttaagcaattttaaaattaaaccttctaaaattatggcttgagaagacatgcatttattgagttaaaagagatcattttgattttacatagtttaccaacagtttaggggtagggtctaggattcttaaagtatttttttttactcactttattgagatatatttaaccatagaatatactaatttaaagtatacaattcaggtggtttttaatatggtcacagaattatgtaagtataatcccagtcaattttagaacattttcatctccacgaaaaagaaactccatgccatgagtagtcactctcagttttctcctaacccttctcctccatctctctcaaaggcctaggcaactatgaatctaatttctgtttctacagatttatataatgtggatatttcatataaatggaatcatatatcagaactttgtatgtctggctttttttacttagcataatgttttcaaggttcatccagcatattaccagttctttattcccttttatggcccgataatgcttcctgtgtggatgtgccaccttttgttcatccatcctcaattgatggacatttgtgttgtttactctttttgactattatgaataatgcacatttgtgtaaaactttttgtgttaatatattttttcatttttcttgagtatatacctaggaacgaaattactgtatcatatggtatattttggtttcattttttgaggaattgccaaactttttccaaatgactgcaccattttatgttccagccagcgatatgtgggggttctgatttgtccacaattctcttcaacacttactgtcttttttatttcggccatcctagtgaatgtgaagtggtatcttactgtagttttgatttgcacttctgtaatgactaataatgttaatcacctttttatgtgcttattggccatttgtatgtttttagagaatgcccacttcaaattcttttcttatttttcatttgggttggctttttattgttttttgtttgtttgttttgagccagagtcttgctttgtcacccaagctgtagtgcagtgtggtatgatcagggccctctgtagcctctacctcctgggctcaacgaatcctctcaactcagcctctcaagtagctgagattacaggcgcatacgactacacccaactaattataaattaatttaatttttttgtagagacagggtttcacttttgttgcccaggctagtcttgaactcctgggctcaagcgatcctttcaccttggcttcctgaagtgttgagcctcccaaagtgttgagcacaggcatgagccactgcacctggcctatttattgttaagttctgagttatttatatattctggatactagttgcttatcagatatatgattggtaaatattttctcagtatctacaggttttcatttcactttcttgatggtatccttgaagcacaaaagttttgcattttgacgaagtttaatttatctgtgttttcttttattacttgtactttatttatttatttttttgagacagagtctcgctctgtcgcccaggctggagtgcaatggcgcgatcttagctcaccgcaacctctgcccccactgggttccagtgattctcgtgcctcagcctcccaagtagctgggattacaagcgcacaccaccacacctggctaatttttgtatttttagtagagacggggtttcatcatgttggccaggctggtcttgaactcctgatctcaggtgatctgcccaccccggcctcctaaagtgctgggattacaggtgtgagccaccgctcccggccatcacttgttcttttgtgacgtgtctaagatgtctgcctaactgaagattctatttttttttttttttgagacagagtctcactctgtcgcccaggctagagtgcagtggctcaatcttggctcactgcaagctctgcctcccaggttcacgccattctcctgcctcagcctcccgagtagctgggactacaggcgcccaccaccacgcccggctaattttttgtatttttagtagagacggggtttcaccgtgttagccaggatggtcttgatctcctgacctggtgatctgcctgcctcggcctcccaaagtgctgggattacaggtgttagccaccgcgcccggccttgctataccttttaagctcagtgaactcttgaattctctagcctttaacatcgttcgttaaaaagaattcttattttgtttatataccgctatcatttctagcaacataatacacagatttgaaatgtaaatgaaatgtttgttgcattgcaaatacaaacctataatcacatgactcttctttcatatcagttttccttaagttatttcagagaacacatagtctaatagatcattttgttgactttctgggttctccggggccaggctttgtcaatacatagttatagcggtgggatctaaggggtgctgtgatcatggtcttagaaaaatggttactgttgttagcttaacaaaagaaagttagtttgtttatttgaattgatctcttctctcttgttaagatatgtatgtatgtatgaatgtatttatttatttattttttccctgtgtcagtcacataggggactgagacacaaagaggccatgtgaattttctaagcagcacttgctatcagtgtgtggcctaaagactggtcctgatttgtgatctatttgttactggtcaacgacaacataagtacaaaaattaagaataagcatttagaaatgtttatagcaatttgatatttctgccttatctaagtacgtgatcttttttctagtaatttatgtttttgttgttgttgttatttttacaaaaatagtggggtttgtgatgtcttgggaaaaactggttctttaccacagattgaaccattgatctaggttcagagagaattatttacagtagtgccagaactattttgattgctggactttttattttgaattcctatatctttctctgtatcttcctccatagccatagtcgtattttaatttaaatgtttaggtttattttcactatggagaaactttaggccttctaatcccacatttctcatcaaatatactttcagattccaatgtcataatcagatattaattatatttttgtatgagagtcaagcaatggagcgtgctgaaagtttttcatttggaatatctagagaaaagggtaattgaatttgaatatcaactaattctttttcatacctaaaaagcggaaacatataatgccatatttaaagactatgtcagaaagtaatttcatgccagagatgcttttgtgttgttttgtataaatgcctccagaagctcctccttgctttttaataccacctgtgagcttttctattttgaacatgctcatgtctttctttaacactaaaggagtttaataagaattatattttaatatcaaaaatagtaaaatttcttaccacggggaaaagaaatacacatatatttctttcactgaataggacttattttggtgttggtgtcctgggatctatgtatgttataatcccctaatacgcttaaaataggatttcttttctaaaagaaaatatgtcttataagatgtaattgatttttaaaataaaagtagtaagaaagggtaatagtgtacgttttaggcaaagtgctagatggaataaaagtttatttcaatagattttacttttagctattttagacttgggagaataaaatgattaataaggtatgtcactgtctttaaggaccttatttatagattagtagagacaggagagatataaatatcaactaattcaaggcagattggtttaatcactattacaagaaatatagaaggagaaagaagacggtaattatggtgggaataaagacagacttgataacattaatggcatttgaaccaggtctaggagaataagatttttgatatgtagaacatggaggtaatagtttttcacatttgtgaaacagcctggtaaagggatatattggtcagaactctttgaatggacaggacagaaaaagaaacccaactcaaactggcttaagcacaaagcagaaagggaagtttattggttcacttgtgaaaaatgaatagaattggaatcttgcctcttgcccacctagatccaggtaggtgttcaaactgtaatgagtattcccactcacatactgctttcctatgtgtagcttcttcttagagacactgtacccataggatggctgtggcaaagatgaccacccaccagcagcttcttagatatttctaccaggttagcaaccccattgaaatagagatctctcaagaattgcagcaggaatccttggcttgggttatgtgcttattctaaatcaatcactgtggcgtgtgtgtgtgtgtgtgtgtgtgtattgcacgaattggctaggtctggatcgtgtgcccaaaaaagagtttgtggagaggggtaaggccagcttcacctgatccccatggagatttggggaggtaccattctccaaaggaaaactgaggtagtcttaaagaaataagcaattcaaaagcaaagagcaggcaaaaacagccactaaaggtaggatatgtgaaagtatgactaaacttaggtgttgtaaaaatgtgtatagagagaataaaaggctgggatagataatagttatagatatacattcagtagtggatatttcaagttcattagaggagagtataatgtttatgcagtaggttaaaataattatttagcatgctaaattttgaattgatttatagagagaagagctggaggcaaaaataaatgttaaaactgtctagactggttaatttttaaattcttattatttttcacttatttattttcattaattcttcaaacctttcataagagctgatgttccagttagtgaaagttctccttttttttttttttttttaactgtttgctgtttggccattatattctttctctttttagcaatgtatgagaagagaggattaactagataaaataaaccaatcacttttacttgttagcacctatatgaaaaggtacaattgtatagattagaactaaacaaaaattagatttttagattgtttgaatttaatttgtcttggatagacatgctttttatttattttttcctaatttctattctttagtaaaaaacaattgaggcagttagcgaagatacatatattataccaaggttaaaaaaaagaggaaatcaaaggtggggaaaaggaggatacataggaaaattaaagtaaggctagtattaatatctgtatctcaaatgcataccataagtactgtagcttttgctggagattacttacttatttgaccctcggcttgcttgctttctttgccaatgcaaagaaggaaaactgattaggtgcaagatttatagtgttcttgctataaaaataaatcaagtactcaagagaaatacagttcttagtacctgtagcactaggacctggtgaaatttctttcaagggggctttaaaaagaacgtcatataatgtggtaaataaaaaccacaagagtatatttaataatgctctggagttctttctgaaaacatccaccaacataggtatgtagcataatgccaaaatacagcttaggacaagtcatttttgtgtggggccaaaataacagtctagatcaggggttggcaatctacagcccatggagcaaatttggcttgttgctatattttatagataattatacatcacagccatacgtatttgtttacatattgtctatggctgtgttcatgctacaacagcagcagtatgtagttgttacacagaccatagtcccacaaagcctggaatatttctagtctgacactttactaaaaaagtttgtccatccttggtctagatacacaactcactgatggattggtttaaaattgagacagtatacaaagtgtctagaacaagggtctcaaactgataggccaagttacaaatttggcctataggtatattttgtttagccaaaccagtatttgacttttgaaaatttctgccaacccagaaaaattcagatttatgccttctctgggaaaattggatagtctggcaatactgagcttacgttgtgtttgtcatcctttaaaaaggatgcaccctctttttccaatttgtattccttactactatattacctcccagcacactattgtgtgcattatgtctacaaaaccccacacatactgtaattttaaaatgctttattgttaataaatgtcagcaatcatcttagccctcagagaattataacctttttgctggtcgagggtctcgtctcaatgtggatggctgctgaaggttggggggctgtggcagtttcttaaataaagacagcaatgaattgattgattcattgattgattcttctttccatgaaagatttccctctggcatgtaatgttgtttgctaccattttacccatggtagaatttctttaagaattggagtcaatcctctcaaaccctgccactgctttatcaactacgattatgttatattccaaattaattgttgtcatttcaacagtgttgttagcatcttcatcaggagtagatcccatcacaagaaactactttctttgctcaccctgagaagcaactcctcatcccttcaagttttatcatgagattgcaacaattcagtcatatctgcagggtccacttctaattgtaggtctcttgccatttccaccacatctgcagtgtcttcttccattgatgtcctgcacccctcaaagtcatccatgagggttggaattaacttcttccaaactccttgcacttttttgttatgaagatggcttctttccttaaacctcatgaaccaacctctgctagattctaacttttcttctgcagctctcatctctgttagccttcatagaattgaagagagttagggccttgatctgggttaggctttggcttaagggagtgttgtagctggtttaatcttctagccagaccactcaaagtttctccatatcagtaattaggctgttttgctttttgcttgttttttttttttttttttttgagacaaagtctcactctgttgccgaggctggagtgcagtggcatgatctcggctcactgcgacccccacctcccaggttcaagcaattctcgtgcctcagcctcctgagtagctaggattacaggcgcccaccaccacacccagctaatttttgtattttcagtagagacgaggtttcaccatgttggacaggctggtctcaaactcctgactgcaggtaatcctcctgcctcggccttccaaagtgctgggattacaggcgtgagccaccacacctggccaggctattttgctttcttatcatttgtgtgttcactggagtagcacttttgttttccttcaaggacttttcatttgcattcacaacttggctgtttggcacaagaggccttccttttggcctatctcgactttctacgtgccttcctccctaagcttaatcatttctaccttttgtaccttttgatttacagtgagagatgtggaactctttctttcacttgaacacttagagcctttgttgggtaattttttttttttttgagacggagtctcgctgtgtcgcccaggctggagtgcagtggtgcattctcggctcactgcaagccccgcctcctgggttcacgccattctcctgcctcagcctccctagtagctgggactgcaggcgcccgccaccacgcctggctaattttttttttttttgtatttttagtagagacggggtttcaccgtgttagccaggatggtctcgatctcctgacctcgtgatccacccgccttggcctcccaaagtgctgggattacaggcttgagccaccacgcccagcccattgtagggttattaattggcttaatttcagtgttgttatgtttcagggaataaggaagcccaaggagaggcagagagataggggaaggttgagttgtggagcagtcagaggacatacatttattattaaagtttgctgtcttatatgagtgcagatcatagtgccccaaaacaattagatggcaacatcaaagatcactgattatagatcaccataacagatataataataatgaaaaaatttgaaatattgtaagaattaccaaaatgtgacacagagatacaaagtgagcatgtgcaattgaaaaaatggtgctgatagacttgttccacaagggttgtcacaaacctgcaatttgtaaaaaatgcagtatctgtaaagtgcattaaagcaaagcacagtaatatgaggtatgtttgtataaatacagatgggtaattgaagaccaaatgacatatctgttacgtttactactttggctcatcagttgtcatacttaacagaggtgataatggatgaagctatcaccacagaaataaagaataaagattggatttggcaaataaaatacttacattaataattattattaattatctgacaaatgctaatgtatcagattaagcaggcagagataagagttgtaaggaatggatcaaatgacaaataaattttagtttgttatgggagggagctggaagtgtagaagaaaggaagggcttggtatacttctggggaactcaggcctgggaagaaccggagtgtaggatcaacttgatgggtgggacaaaggggagtaaatagccaggggtagaaccaatggtagacttcatgattatgcttaacgtgaatcttgatacttagattcttttctcagggaggtgatattatctataaagaaagtggaaaggcagataagaaagatcaagtttgttgagcttgaaggagtattgagaatccagtcaaagatatttaagagggagtctgagatatggaatagagatgtggcaaatcattgatttattcgcctaaacatgtttaatatcatgagaaagagaagactttccagagacagtagaatgagatagatgagaagatttagaatagagacattttctccaactttcctcacaggtaaaccaggagaattgctgcttttgtttctaaacctgtgattctattttacagaattttagaagccattaattactttcattccttagtatgattatagtcctggtgatacattttatcttggtcattttctttggcgttcatttgaatgttgatgtgatcttaggctttttttcctccctctttgttttatctaattatttttctccatgtaattcaggcatcatgttatgttactatgtcttgtcctggcaacttatataatattaagcaatattcaaggcagatcagatgtacttttagtatctgcatactaaattttcaaggactttaaaaaagataaactcttatgtttcatcatgtcatgagtaaatagtactgttgtcgtcaaatgcacagattattgtatcctatatacctgggtttaatcctggtttgacactctgactttgaacaaattattttctgtttaagccttagtttcttaatttgtaaaattagggataattaatagtatttcaaaagattgtagtagggataggtacataggacatgccaatgttagctcttggttactgtaatgtcacaagatgaccaagggatggaataattgacttgattttagtacatattttctttggaatttttatccatgtttgaacataagtagtttaatttgtgttggacaatattttatttaatcatatcatattgtgagtagctaaaagataactgattatttttatgatttaatattcaactttttgctaataaatatggcaggcatttttacgtggtggttcataaatgtcatgacctgtgtgttgacctatgttaaatttctgtgatcttttttatttgggtgaatcgtatttagcttcctgtctgttagatagtaggaaagtaatgaaacaatagcatatgagaatttgatcaaaatgaaccttaatcctgagaagcattaactggattattttgttagaaatatgccaatggatttaaaatgtagataatcttgaaatttcaaatgatttcattctttggttggttgtttacctacttgatgaccaaaaaagccaagatatgtagttactgtcacattaaattcagaaaatattttataaataaagcttcattttaaatgtactaggaggtaacttttgagaaaacttattagtagatactgttttacaagtggaaggattatgttttgtgacaattattaacagttttaaaaatcaagttcttaaatatttgattttttaagagataagatctcacaatattgcccaggctggaatagtggctattcacaggtacaatcatagtgcactacagccttgagttcttgggctcaagcaatattcctgcctcagccacccaagtagctgggactataggcatgtgccagtgcgccaggcttatatttgatttttttaaattttctgagcacttttattttaacttttatgaataatttcaaacatacagacatagaatattataagaaaacttacatgtatccatatctcagcttgaacagttatcacctcgtagacagtagtcttttgtttgtacttgctctacttgctccttctagattattttgaatcaaattccacatgccattcctaaatattcccagatatataatatagatagtgattattttaaaaacaaccttaatactcttatcacaccttaaaaagtagcagcaattacctaatattatcaaacatacagatataaggcatgtaaagatgctgtcttttaacaactgaaggcattgaaaaattaacatttcagaacgtgattagtgttaaagtggtttttgtcttgtgaacactgagaaggggagaaagcatgggaaagttcttttttttttttaagtatactttaagttctgggatacatgtgcagaatgcgcagctttgttacataggtatacatgtgtcatggtggtttcctgcacccatcaacccgtcatctacattaggtatttctcctaatgttatctatccctcccctagcccccaccccccgacaggtgcaggtgtgtgatgttcccttccttgtgtccatgtgttctcattgttcaactcctacttatgagtgagaacatgcggtgtttggttttctgttcctctgtttgctgagagtgatggtttccagcttcatccatgtccgtgcaaaggacatgaactcatcctttttttggctgcatagtattgcatggtgtatatgcgccacattttctttatccagtctatcattgatgggcatttgggttggttccaagtctttgctgttgtgaacagtgctgtgataaacatatgtgtgcatgtgtctttatagtagaatgatttataagcctttgggtatatacccagtaatgggattactgggtcaaatggtatttctggttccagatccttgaggaattgccatactgtcttccacaatggttgaactaatttacactcccacgaacagtgtaaaagcatttgtatttctccatatcctctccagcatctgtcgtttcctgactttttaattatcaccattctaactggcatgaaatggtatctcatcgtggttttgattttcatttctctaatgaccagtgatgatgagctttccttcatatgtttgttggccacataaatgtcttcttttgggaaatgtctgttcatatcctttaccccctttttgatggggttgtttttttcttgtaaatttgtttaagttccttgtagattctggatattagccctttgtcagatggatagattgcaaaaattttctcccattctgtaggttgcctgttcactctgatgacagtttcttctgctgtccagaagctctttaattagatctcatttgtcaattttggcttttgttgccattgcttttggtgttttagtcatgaactttgcccatgcctgtgtcctgaatggtattgcctaggttttcttctagggtttttatggttttaggttttaagtctttaatccaccttgagttaatttttgtataaggtgtaaggaaggggtccagtttcagttttctgcatatggctagccagttttcccaacaccatttattaaatagggaatcctttccccattgcttgtttttgtcaggtttgtcaaagatcagatggttgtagatgtgtggcattacttctgaggcctcttttctgttccgttggtctatgtatctgttttggtaccagtgccatgctgtttcggttactgtagccttgtagtatagtttgaagtcaggtagcgtcatgcctccaggtttgttctttttgcttagggtcatcttggctatacgggttcttttttggttccatatgaaatttaaagtagttttttctaattctgtgaagaaagtcagtggtagcttgatggggatagcattgaatctataaattactttgggtagtatggccattttcatgatattgattcttcctatccatgagcatggaatgtttttccatctgtttgtgttctctcttatttccttgagcagtggtttgtagttctccttgaagaagtccttcatatcttctgtaagttgtattcctaggtattttattcttcttgttgcaattgtgaatgggagttcactcatgatttggctctctgtttgtctattattggtgtataggaatgcttgtgatttttgcacattgattttgtatcctgagactttgctgaagttgcttatcagcttgagattttgggctgagatgatggggttttctaaatatacaataatgtcatctgcaaacagagacaatttgattttttaaaaagaaataaacctgtgtcatgtgtctatctatatgttttataattaaataaatttaaagtcttaatgttgttgtctgcaattgtatcaactggaattctaatcctttggatggtaaaaatgcatgagacataggtgttgttctttatatacatgatatttggattttatataataataactcctttagttgacaattgttccccaattttttttcttgctctgttttactatccactgagttttaatagtgtccgttatcatgaaatatttcctctctgctgacattcttttaaatcccctgtctttctgttctgattttcatctaaagatgtatttcaatgtatttttataaatcttgatggatatataaacctatagacctgtgtgaatgtatacactcctgtgaactagctgtactcctctgagactataaacacattgctggtctgttatttagtccagatatataaagattgaacagctttttatcccaaaatcatggtgggggaatgtgtaataaggtgttgaaatgctgatgtccatttaaaatgttataaatgttttaaacaagctatttgaagtatgcatacacaatttttgtttgatgaggaaaagtgagttaggtgtggtttaggtaaagcatatcctctcagattaatttttccatcactgtgactgtgcccacaacaggggttcagatagtgcactgagcaaaccatgttagcaattaatttcctatccttttgtaacatgttagaaaatgtgtcagaaaggtttcagtgaactttgatcaaattagtttatgcctgtgatttgactaatacttttctagaatccttgtgaatttagtcttgctttcatacttagcaactaattaatcagaacattttttttgccttatcaaatttctttgctagagaaatctaattgatctgttactgattgttgtttgagacaaaatccaaaggccatctcttagtgtaattactaatatattaagtgcatcaacacatacttatattgtaaaaattgacagtctgaattttcttatttttaatatcttagtattcttaattttcttaatatctgacttactacaactagagtaatataaaacagctgtaaaaattgactgtattttaaaaattgatagcctaaattttcttatctttaatatcttagtattcctaatattcttatcttaatatctggcctactaaaactagagtaatacaaaacagctgtatgtattcataagtgataggaggccaaagaaacaaaaattttttctcagcataagctctgccagttaatgctgaatatgtaactatttttcatttcaaaagtatgagtaaaattgatattttttcataattgcataaattaacaatgcacttatcttttatctaccgtgtggttggattttgaacgtgtcttgcgatgttgctacttctttagcattctttatatagcacaaagtgggaaatgcttctttttataagcaaaaacatgaacaaaacatttgttagaaaacgtgttaagtcagttatttagccatgagatcatcatatgcaaccattatctatttataattctccttttggaaagtaaatagaattttaacaaatgctgtcatttaatgtcaagcaaaatttcaaaaattttttaaaagcctgatttttaagtaatggagctatactaaaatgctttagtgtttattgtatgtggattttatgcagttgggtcaggttatcaatataattgactagggcttaagatgaaaaactgagattatattctactttttactatatactgttttatcattcccaactaagtttggggctacttaaaccttgaaaaatttactgatgtggtatttagaatctgttatttgggtatcataggaagaatgtagtgagttggtggtaattgatttatcctccatcatactgaacctcccactcgtcttccactttgtcctcccttgggcaataatcacagggtcgaactgccaatctgtagacttaattttttccagcagtaccatctggctccttggcaccataagttatattggttctttgtggctgttactgagtttgtcatattgttagacagctgatgggatgttttttgctattcgacccttttaaaactaattattgatttttatttagagaatcttctttggccatttatgatagcatggcaggattttattgtgaaaaaagtagaatgcacctaaacaaatcctatattatgtgtcaaccttgagattctattctctgtattgtattctgtctagttctttagtagctctccctttcaagagagattaaaattaattgtacaggttttctgtttcattcaaacctgtatgtgtttttaaattatttgaatttgcatttaaaatcctgttattactgcagtcatttcctagtcacgaatgtttagaagtccctattagtggcacagataaacttctaatacccagtaatactttatccccttaaaaaaaaaaagaccatttgtatattatcttgtgttttattttgtagataggtggttttactgttatgtctaatgacattcataacaatttaaaagagtaattttgaaaggtagttctgagtttcagtaattaaaaagaatagcctaagcacatttctatttttcatattacacttaactagatatttttgatgaaggcaaaaattatttgacctatttgtttctaaagtaaggatcataaacaaaaataaataatttttttaaactcttgaatctgcatatgaagcagttcattttgcaagtatttatcatatttgattgcatttatttttaatggtacatgataaacgtcttttagaaagttttaaagtagttattttagaacacaataaacatcttttacaaggccctttagaggttttcattcatataaaagtgtttctcttgagtttaaatatttaattagaatctgttaatctatgttgcattataataatggcaggatactgatgtgttggaaatatttacactgaatctttttttttttttttttttgctggtgtaagggtgtttgaagttcctaaagagtgatttcgctgggattattttaataccaccatattagaagcctgctaactacaaactggactttacagaatattagataaaatatacagctaaattgctgtgatttggttgtgatgtgatttcatttaaagtatgtaaagaagaggagcagtaaatatctctctgtaagaggagctaaatcagatgtcagtgaaatgattcatgtgccaactggaatagttaacatgcattttattctactgtctagcaggaggaggtgggctatagaaaatgaattctccactaaataatttacaacaattatatcaaattttaataatgagctaagaaggcatacatatgattcatgttctcacagtttcctacattagagattaattgtgcttttgttaaacaaaaatgtactcttataaatatttttaattagtaaatcatgattagttttatatttatagagtagcatcgtttgatcaatttttagctgtagcttcatatgaagctaaaatatcacagctaaatctgttgtctcaaatgccagctcatgagaatttgctcctaatatcaagaaacgccctgaattgtttgttggctttatcttaactcaaatatgtaaaggggacagtagaacatttttctttcgaatcacagagagttcagtgacctttctgtggcaaattacatagaaagaaaatatttatattcatttaaaataacctctgtgaagaaatagtctcattaccctgtttgatcaatttcttgtagcctgagctgtagcatgctgctattgccattggttgatggaatacactgagtagtggctaatggtgatggtgctcatcaggaagggttcagccagcggtcagcaacaaataattcaagactgtttctaagtttgtggctggtggaatttgctttttgccccaagccagcggcattgctgagctgggctatttgattagaagagaggcatatttgcttcttagcaactgcacatttgcacaacccatagtcctttactgcctccaaaggttttccttttgtggtggtagaataatactttattgttgattgacagacaaaagaagttctaatacaaggcaagcttataaccatttttgttgttgttggctttaaaaaatttcagctacatacgccattttttgaaaaagtatagacaaaaggtatgtatagtgtaaatcagtatggaaaccccaatatgctagatttttaatatattatcaaggaggtttgcacagcatgaatacaattgcatactgttacttttgtgcctagcaggttcaatgatagaaaatcaattctgactccagtgtatgtacctatatcaatattctgggtgtttgcagtctccaactagaattaatgctagagaaaatttaactaataatttttaaaaaaattgaagttagtagaacatctatatagctttgtcacatttaagaactagtttttatataagattagaagtcaaattttgaattctgaatacagcgtgagtatagaatttggaatatagttctcacaggaatgaacttacctttaatagaagacagaggtatttataactcaacagttaagaaacaagtgagaaaagataaatttggggaggacagtttgagttttatgatcctgggaaaccaggaccggaaaaaaacaggcttttttttttcttttttaaaaaagcatggttttatggcttttctcactgaaactgtatggttaggacttgaatctcaagattttaaggaagatggtataaaaagtgatacgaccatagatgataattttattcttgcattatttttggtaatagttttttaacatacctattataccttaaagaaataatgcgaaactatttgagtcaatacattttgatatacatcatttaaacccattgtttaacatattttgtcgacgtaattcatggtaaaatgaaatggcatctgtaagattaattgccattggttgatttttttatattctatgaagttatgtttagaacatatggtgcttttttaagggatttttttttgtatttttgtctcctaaggtttagaacagatatgagaatttccgtaatttaagatgaacaacagaaaagtgcactggtgtgaattatccagttcacaaatcttgaaacatgttttgggatttagggaagttaaagcaagtgcagacattaacatagacataaagtgtatatgggcaaatactctcatttcccagtaaaaggaccttaggatatatcagtatgcataatatgaccatcactctatttacttactaagacatagccattttagtggcaacctagagcccaaaagagggaaaagaagtgaggttgagtgatttgatattgcaaggcagtaatatgcccctttgtatcaagcagctgtccctttgcaatttcggttaacatctttgaaacagttcccttaaaaacaaatcagggccctaggaggaaatagaaaatacttttaagagtggttttaaattgtttaaaaattaacatgcctgcaaataaattcccaaagttaggatgtgactttaatgttatataaattaaggttatagcttttgctagcattttacttataaggtaaattatgggaatttgatgtaataaggaaaatgttctttaaattactaaactctcttgcaaatagttgcaaaatggcattttaaaactctaatctactacattaaaattacttgtatttattagtctgtatcattagatggcatttactactaagtgcccttttcttctcttttaatagcttaacagtttcttattttgggatacataacaaaagacagttttcttagtggggctttatgacaattatcacctgcaggtggaggggggatctgttttattactgactagtttcttccctccatctcccattgcaaatataaaaagtacaaagtaatgtacaaaatggtgttcttttggacttaagtttttacatataggtccatttgttgagagagaagaggaacagagacaaatagaggtttctggtgcttttctactaggtaaagagggtgtagggacagggaaagagaaagatggtgtggtttggggatatggatgggattttttaatttgttcaacagaaattttcagtgctccagtggcttcctgaagcctttaaggtaaaatcaatagagaaatatatcagaataattttcagtggcatgcatgatgaattattgttttattattgaagaaactatggcccagagagattaggtgatttgcccaaagctacacagcaaataatggtggagctgaggtagaaatttaggtcttttttttctccaaagcctacaatctttttctggtggaacacgaatacctgctcttcaggcttgttgtgtttagggacatgagctttggatgctaacaaataagagatgaaagctctgagacttgctttgtgactggtcaaactacttgacttcattttatttttattttttaatttaaaaaactttaaattgacaattaaaattatatatagggctgggggtggtggctcatgcctgtattcccagcactttgggaggccgaggtgcgcggatcatgaggtcaagagatcgagaccatcttgtgcaacatggtgaaaccccgtctctactaaaaatacaaaaattagccaggcatggtggcgtgtgcctgtagtcccagctacgcgggaggctgaggcaggagaatcgcttgaacctgggaagtggaggttgcagtgagctgagatcgcaccactggactccagcctggtgacagagtgagactgtgtctcaaagaaaaaaacaaacaaaaacatgtatatatatatatggtacacagcatgatgttttgatatgtgtatacattttagaatggctaaatcaagttatttagctcaagtgttacctcatgtacttatatttttgtggtgagaacctttgaaatccactgttagcaattttcaagtataagtaggttaagcagtcaccgtgatgtacaatagatttctgaacttactcctcctatctaactgaaattttgtatccttggactagcatctccccattcctcctattcctcagtgtctggtaaccaccattttgctctctgtttctgtgagtttgacttttttgtttttcttgttttctttttttttctttctttttctttccttttttttcttttagagacatggtccaggctggagtgcagtggtgcaatctcagtttactgtaacctcaagccatcttcatgccttagcctcctgagtggttaggactacaagggtgtaccacaatgactggctaatttttttatttttgtggagatggagacttgccaggttggctagtctggtcttgaactcctggcctcaagtgatcctcctgcttcagccttccaaaacactgagattacgggtgcgaaccactgtgcccagcccaactttttaacactacatataaattaagatcatgcagcatttgtcttactgtgcctggcttttttacttaacttaatgccctccaggttcatccatattggcacaaatgacaagatttccttcttttgaaaggctaaatggtattccattttatacatatactacattttcttcatctattcatcttcatggacacttaggctgattccgtatcttggctattgtgaataatgctacagtgaagatgggagtgcagatatccccttgacatactgattttgtatcttttggatatattcccagaagtgggattactggatcatatggtagctctatttttaattttttgggggaagctccatactgttttccataatggttgttctaatttacattcccacaaacagtatacaaggctttccatttcttcacatcctcacaaacactggttatcttttgtctttttgataatagctgttctgacaggtgtgaggtgttatctcattgtggttttaatttgcatttccctgatgtctagtggtattgaacattttttttgtatacctgttggacatttgtaggtcttcttttgagaaaagtttattcaggtcctttgcccactttttttttttttcttgtgaaacgaagttttgctcttgttgcccaggctggagtgcaatggtgcgatcttggctcactgcaacctctgcctcccgggttcaaatgattctcctttctcagcctcccaagttgcgggattacaggcacatgccaccacacccggccaatttttgtatgtttagtagagatgaggtttcatcatattggtcaggctggtctcaaactcctgacctcaggtgatctgcccaccttggcctcccaaagtgctgggattacaggcgtgagccaccgcgcccggccagaccacttttttattgagttttgttttcctactattgagtctgttgagttccttatgtattttggatcttaaccccttaccagatgtgtggtttgcaaatattttctcctattccataggctgtctcttcactctgttgattgtttcctttgccgtacagaaactttttagtttgatgtaaccccatttaccaacttttgcttttgttacctgtgctttgggggtcatatctaaaaattctttgccaagaccaacatcatggagcttctcttctgttttcttctaatatttttagtttcaggtattccacttaagtctttaattcactttgagttgatttttgccgtaggcattgttgttatacccattttgtacatgaagaaattaaggtatagagagactaggttacatgcctagtaagtatcggaaccaaggttgagacccaagccatcttattccaaggcttgtcccttcctttttttttattatggtaaaagacacatattatgaaatttacaattttaaccacttttaagtatacatttcagtggcattaagtatattcacaatgttgagtaaccaccaatcaccgttttcataatgttttcatcattgtaaacggaaactctgtatccattaaacagtaactccccattcacccacctccctaccctctgctcccacaacctctattctatttttagtctctgaattggcctgttctaggtacttcatgtgagtaaagtcatactgtatttgtacatttgtgtctggcttattttacttagcataatgtctttaagggtcatcatgttgtagcatgtatcagaatttcattctttttttaaagctaataatattctattatgtatgtataccaaaatttatccattcatctgttcatggacatttatttgggttatttccatcttttggttattatgaatactgcagagcctacacttttgaccacagccctatacagatgtattaattatttattgctgtatagcagattacccctaaacctgtgtattattttattatcacagccatacctcagagatattgtgggtttggtttcagaccactgcaataaaatgaatattgcaataaagcaattcatgagttttttgatttatatgcataaaagttatgtttacactatactgtagtctattaagtgtgcaattagtattatgtctaaaaaacaatgtgcataccttaatttaaaaatactttattgctaaaaaaagtgctaacaatcatcttacccttcagcaagttgtaatctttttgctggtggagcgtcttgcgtcaatgtggatcactgctgactaatcaggacagtggttgctgaaggtttgggatggctgtggcaatttttaaaagtaagataacagtgagttttgccacattgattgactcttccttccatgaaagatttctctgaggcatgtgatgacatttgctagcattttacccaaagtagaactccctttcaaaattggagactgtattagtccattttcacactgctataaagaactacctgagacagggtaatttataaaggaggtttaattgacttgcatttccacatggctgggggcgcctcaggaaacttaaaatcatggcagaaagttaaagagacacaagcagcttcttcacaaggtggaaggagagacagagagcaaggagggaactgccaaacacttttaaactatcagatcttgtgggaactcactcactatcacaagaacaacatggggaacccccacttccccgatgatccaatcacttcccaccaggtccttccctggacacgtgaggattataattcgagatgagatttgggtggagacacagagccaaaccatatcagaggcaatcctctcaaatcctgccactgctgtatcgcctaaatttatgtaatatactgatccttccattattgtcatttcatcaatgttcacagtgtctttactggtagtagattccatcgcaagaaaccactttttttgctcatcctaagaagcaactttgcatcccttcaagttttatcatgagatttcaacaattcagtcacgtcttcagggcctacttctaattgtagttctcttgctatttccatcatatctgcagcgactttctccactgaagtcctgaacctctaagtcatccataagagttggaatcagcttcttccaaactccttgcacttttatgttatgaagatggcttctttccttaaacctcatgaaccaacctctgctagatttcaacttttcttctgtggcttccttacctctcagtcttcatagaattgagcagagttagggccttgagctgcattagatttcaccttaagggagtgttgtaactgatttaatcttctatccagaccactgacacttcatatcagcaaaaaggcttttttgctttcttaccatttgtgtattcactagagcagcacttgtatttaccttcaatgactttacctttgcattcacaacttggctgtttggtgcaagaggccagctttcagtctgtcttggctttcaacatgaatttcttaccaagcttaatcatttctagctttgtttgtttgctttgcagcctcaaattcccaggctcaagggcttctcctacctgtttcctgagtagctgggaccacaggcatataacgccatacctggcttatttatattttttatattgatttgtttatttattgattgattgagatgaggtctcactatattgcccaggctagtctcaaactcctgggctcaagtgatcctcccactttggcctcccaaagtgctgggattacaaaagtgagtctagcttttgatttaaagtgagaggtgtgtgattcttccttttatttgaaaacttagaagtcattgtagggttattaattggcctaatttcaatattgttatgtctcagggaatagggaagcccaaggagagggagagagacaaggggaagagtcagtcagtggaacaatcaaaacatacacaatatttatcaatgaaatatgctatcctatatgggtgtggctcatggttcccaaaacaattacaatggtaactatagatcaccgtaacagatataataataatgaaaaagtttcagatgtgaaaattaccaaaaggtgacacagagacacaaagccaacacatgctgttggaaaaatggtgccgatagactttctcgacagagttgccacagaccgtcaacttgtagaaggtgcgatgtctgcaatgtgcaataaagtgaaatgcaataaaatgaagtgtacatatatttattattaagtaataaaccttttattctcacatttctgtgagtcaagcattggggaatggcttagcagtctctggcttagaactattcatgaaattgcagtcagaattttagctgaggctgcagtgatccgaaagtttgaatccactttcagggaggctcactcacatggctgcaagttggtgctgactgttgtcaggaggccttggtcccttttcacatgagtttttccactgtctacttgagtgccctcatgactttgtagctggcttcccccgaagaaagagccgagtagaagctatatatttttttatgacctagtctcagatgtcacatagcatcactttagccacattctgtcctttagaatcaaatgggtgaagttgacccccattcaaggggaaagggattaggctctgcctttcgaaggaggagtgttaaggaatttgtgaactcattttaaaatcagcatacctgattagaataatgaagaaagtaatcactggtaacagaaataattcctacaaaaattatggtatacaactgtctagagacattttctgtacatatatgacatcatagtctgttgattgtttcataatctgattaaaaattttttattttaaagagacagggtgtcactatgttgcccaggctggtctcaagctcaagggaacctcccacatcagcctctaaagtaggtgggaatataattgctcaccaccatgcccagctttataatctgatttcaaaactaacccctgttaaaattgtagtatattatctgtctagagacattttctgtgcatattagacatcatattctggatactgtgttttatactttaattttttcatactataggaaacatctttccatgatagtaagcattttttatacattggctgttaatcttttaaggatttcccaataatggtatttcactgttaactggcttttctttttactagttgatggtgaatttaaaaaatattttattcattatttgcatttttaataaattgcctttttatttattcctgcattaaaaattggcactttttttttttttttttgagacggggtctcactctgtcacccaggctggagtgcagtggtgctatttcggctcactgcaacctccgcctcccgggttcaagtgattctcctgcctcagcctcctgagtagctgggactacaggtgcgtgccaccatgcctggctaatttttgtaattttaatagagacagcgtttcaccacattagccaggatggtctcaatctcctgaccttgtgatctgcccgccttggcctcccaaagtgctgggattacgggcctgaaccaccaggcccggcccggcacattctttttattaaacattatgtgttaaggattctaaaacattatcatgtaaggtataaatatttcttctttgcttataatttgtggtattgattaaaacaaattgtagaagtatagagttagaaaggataacagaggaaatttagtccaacacttctttttaaaatttttttaaaattattttttaaaaaattttgtgggtatatagtagatgtatacatttatggggtacataagacattttgatacgggcatgcagtgtgacataggcacatcatggagcatgggccatccatcccctcaagcatttatcctttgagttccaaataatccaattacattctttaagttattttaaaatatacaattaagttactgttgactataatcaccctattgtgctattcaatagtaggtcttattcattctttctatttttttcatacccattaacctccccctccaatcctccactactcttcctcgcctctgataaccatcctctacactccgtgtctatgagttcagttgatttgatttttagatcccacaagtaagtgagaacatgcagtgtttgtctttcagtgcctggcttatttcacttaacataatgatttccagttccatccatgttgttgcaaatgactggatctcattcttttttatggctgaatagtactccattgtgtatatgtaccacattttctttatccagtcatctgtttatggacacttagttgctttgaaatcttagctatcataaataatgctgcaacaaacgtaggagtgcagatatctcttcagtatactgatttcctttcttttgggcatatatccagcagtgggattgctggatcctatggtacctcaattttttgtttttttgaggaacctccaaactgttttccatggtagttgtactaatttacattcccaccaatagcatacaagggctgtctgtcattcacatgctcgtcagcatttgctattgcctgtcttttggatataagccattttaactggggtgagatgatgtctcattgtagttttgatttgcatttctctgatgatcagtgatgttgagcaccttgtcatatgtctgccatttgcatgtcttcttttgagaaatgtctgttcaaaggttttgcctattttttgattggattgttaggcttttttcctgtagacttgtttgagctccttatgtagtctggttactaatcccttgtcagaggggtattttgcaaatattttctcccattctgtgtgttctctcttcattttgttgattgtattctttgctgtgaagaagctttttaacttgatgtgatcccatttgtccatgtttgctttggttgcctgtgcttgcggggttttgctcaagaagtctttacccagactaatgtcctggaaattttctccaatgttttcttgtagtagtttcatagtttgaggctttagatttaagtctttaatccattttgatttgatttttgtatatggtgagagataggggtctagtttcattctttcccatatggatttccagttttccaagcagcatttatttatttatttattgagacagagtcttgctctgtcaccaggctggagtgcgatcttgactcactgcaacctctgtcttctgggttcaagcgattctcctgcctcaccctcccgagtagctgggactacaggcacgtgctaccatgtctggctaatttttgtatttttagtagagactgggtttcaccatgttggccaggatggtctcaatctcttgacctcgtgatccacctgcctctgcctcccaaagtgccaggattacaggcgtgtgctactgcacccagccccaagcagcatttattaaagagactgtcttggctgggtgtggtggctcatgcctataatcccaacactttgggaggctgaggcgggcagatcacctgaggtcgggagctcgagaccagcctgaccaacatggagaaaccctgtctctactaaaaatataaaattagccaggcatggtggtgcatgtctgtagccctagctacttgggaggctgaggcaggagaatcgcttgaactcgggaggcggaggttgcagtgagctgagatcatgccattacactccagcctgggcaagagtgaaactccgtctcaaaaaaaaaaaaaaccaaaaaaaaaaaaaaactgtcttttctccagtctatgttcttagtacctttgtcaaaaatgatttcactctaagtgtgtggatttgcttctgtgttctttaatctgttccattggtctatgtgtctgtttttgtgccagtaccatgctgttttgataactataactctgtagtatgatttgaagttagatatgcgattcctccagctttgttctttttgcttagggtaacattggctgttctgagtcttttgtggttccatgtaaatttgaggatttttttttctgttttggggaagaatgtcattggtattttgatagggattgcattgaatctgtagattgctttgggtaatatggacattgtaacaatattgattcttccaacccatgaacatgaaatattttttgatttttaggtgtcatcttcaattttctttataagtattttatagttttcattatagagatctttcacctctttaagttaatttctaggtatttaattttatgtgtggctattgtaaatgggattactttttaaatttctttttcacattgttcactgttgacatatagaaatactgctgatttttgtgtgttgattttgtatcctgcagctttactgaatttgtttctcagttctagtagtttctttgtggagtctttaggtttttccaaatataagatcatattattggcaaacaaggatagtttgacttcctcctttccaatttggatgcctttatttctttctgttgtctgattgctctagctaggacttccagtactgtgttgaataacagcagtgacaatgggcatctttgtcgtgttccagattttagaggaaaggctttcagtttttcctcattcagtatgatactagctgtaggtttgtcatgtatggcttttattatgttgagatatgttccttctatacccagttttttaaagcgtttttgtcatgaagggatgttgaattttatcaaatgccttttcagcatcagttgaaatgatcatatggttttcatccttcattctattgatatgatgtatcatgttgattgatttgtatatgttgagccatccttgcatcccagagataaatcccacttggtcatgatgaatgatctgtctaatgcattgttgaattcagattgcttgtattttgttgatgatttttgcatcaattattcatcaaatatattggcctatatttttttttctttctttctttcttggatgcgtctttttctcgttttggtatcagtaatactggccttgtagaatgaatttggaagtattctgttctgctctatttttttggactagtttgattaggattggtgttagttctttaaatgtttggtagaattcagcagtgaagccatcaggtcctgggcttttctttactgggagatgttttattacagcttcaatcttgttgcttcttattggtctgttccagttttggatttcttcctggttcatcttggtcagttgtatgtatctaggaatttgtccatttcttccagattttccaatttattggcatgtacttgctcatagtgtagacactgacaatcctttgaatttctgcagtatcacttgtaatgtctctcttttcatttctgattttatttatttggatcttctctttttcttagtgtggctaaaggtttgtcaattttgtttaacatttcaaaaaaccaactttttggttgatcttttgtatttttttaaaatttcaatttcatttatttctgctctggtctttatttatttattttttcttctactaattttgggtttggtttgctcttgcttttcaagttcttgaagatgcattgaaaattttcctctttttcaatataggcacttatagctataaatgtccttctgagtactgcttttgctgtatcacataggttttggtgtgttctgttttcattatcatttgtttgaagaaatttttcaatttccttcttcatgtcttcaccgacccgctggttattcaagagtatactgtttaatttccatgcatttgtgtagtttccaaaattcctcttgttattaattttgaattttattccattgtggtcagagaagatgcttggtagtttttcagtttttattttattttatttatttttttgagacagagtttcgctctgtcgcccaggctggagtgcagtggcgcaatcttggctcactgcaagctccacctcctgggttcatgccattctcctgcctcagcctcctaagtagctgggactacagacaccccccaccacaaatggctaattttttttttttgtatttttagtagagacagggtttcaccgtattagccaggatggtctctatctcctgacctcgtgatccacctgcctcagcctcccaaagtgctgggattacaggcgtgagccaccgcctgtttttttgaatgttttaagacttgttttgtgacctgacatatggtctattcttgagaatgatccatgtgctgaagaaaagaatgcgtattctgcagctcttggatgaaatgttttgtagatatctgttagatccatttggtctatagtgcagattaagcctgatgtttctttgttgattttctgtctggaagatgtgagtgatgctgaaagtggggtattgaagtctccagctattattgtatcagggcctatctctttctttagctctgataatattttccttatatatctgggtgttctagtgttgggtgcatatatatttaaaattgctaaatcctcttgctgaattgactcctttatcattatatagtgaccttctttatctcttcttattgtttttgtcttgaaatctattttgtctaagtatagcaattcctgctcttttttggtttccattggcatgaaatatctttttttatcactttgattttagtctatgtgtgcttataggtgaaatgtgtttcctgtaaggcaacagatcaatggggttttttttttcttccattcagcccgtctgtgtcttttgattgaagagtttaatccatttacattcaatggtattattgataagtaaggactaatacctgccattttgttacttattttctggttgttttgtggtctggtgttgtcttgccttgccttgccttgccttgccttgccttgtcttgccttgccttgccttgccctgccctgccttgccttgccctgtccctgcccctgtcccgcccctcccctcctcttttcccctcccctttttccttcccttcctttcttcctttgtttcctttcttgtcttcctctagtgaaggtaattttctctggtgttatgatttagtctcttgctttttatgtcttgtgtgtccgttgtatgttttttggtttgaagttactgtgaggcttgcaaatactatcttataacccattattttaacctaataaaaacaacactatttgaataagcaaacaaccaagcaaaaagcaaactgttaaacactctacagcttaacttcatcaaaaacatgttttaagtttttgttgtttttatttatatcttattgtattgactgtgtcttgaaaagtagttatttttgattggttcatcatttagtctttttacttaggataagagtagtttatacaccacagttacagtgtgatactattctgtgtttttctgtgtacttactgtgactagtgagttttgtaccttcaggtgattacttattgctcattaatgtccttttctttctgattgaagtacttccggttgcatttcttgtaggacaggtctggtattgatgaaattcctcagctttcttctgcttgaccaattctcctatttaaaggactctgatgccttcttcagtatgccaattgcatttttcagctccagaacttctgcttggttcttttttggtttctccttcatatttgaagtttatttccaccaaatctagtattctaggttagtttttttcctttggtactttaaacatgtcatgccactctctcctggcctataaggtttccactgaaaagtctgctgccagatgtattggagcttcattgtatgctatttgtttcttttttcttgctgtttttaaagtcctttctttatccttggtctttgggagtttgactattaaatgctttaacctttgggttaaatctgcttagtgttctataaccttcttgtacttggatattgatatctttctttaggagttggaagttctctgttattattattattcttttttcttttgtctcctctgactgtatattttcaaatagcctgtcttcaagctcactaattctttcttctgcttgatcaattctgctgttaaaggactctgatgcattcttcagtatgccaattgcattcttcagtatgccagttgcatttttcagctccagaacttctgcttggttctttttcattatttcaatctttttgttaaatttatataatagaattcagaattccttctctgtgttatcttgaatttctttgagtgttttcaacacagctattttgaattttctgtctgaaaggtcacataactgtgtttctccaggattggtccctggcaccttatttaattcatttggtgaagtcatgttttcctggatggtgttggtgctagtagatgttcttcagtatctggccatttgttgtagtcttcactgtttgggcttatttatacccatccttcttgggaagactttcagatattttaaaggacttgagtgttgtgatctaagctgtatctgctttagggagcacccctagccaagtaatgctatagaggtgccaccttgacagtcttggacaagatccgggagaattctctggattaccaggcagagactcctgtttccttcccttaatttctcccaaacttagagtctctctttctgttctgagccccctaaagctggggggtggagtaacacaggcacccccgtggcggccaccactatgactgcacggggtaagacctgaagccagcacagcactgggtcttgcccaagatctgctgtaaccaccccatggctactgcctattttagctcgaggccctggggctctacaattagccagtggcaaagcagccaggactgtgtcctttccttcaaggcagcgaggtcccctaatccccggtgggtccagaagtaccatccaggaattagggactagagtcaagtccaacacttctgattcatggatgaagatgccctattttctttatctcctccagatttctcctctacttttctcccaccaaatcttaacctattatgaccatttgcccaaatgttttgtgctctgctcatggtaaaggagtaagggatatacagttgactcatgaacaatgtgagggtttagggatgtcaaccccctgtgcttttgaaaatccacatataacttttgactcccccaaaactaactactaatagcctgttgttgaccataagtcttaccaacaacataaacagttgattaacacatattttgtatatgtattatatactgcattcttataatagaataagctagagaaatgttattaagaaaattaatgagaaaatacatttacagtactgtatttattggtgccacaagttgatatcatctatttatgcaatcgattatctgtccgaaatggcaggcagccacagctgcagaactcaatctatggtacatatcaagcaacccaacttttccttgtaatgtcatgaattttctctgcttttcagaggtactgttagcatcaccagtggcactttgtatgggtcccatggtgttattcaaggttttcagtattgcactaaacatggtaaaaaatatgtgagacccacaagagatcactttttactgcgatatgcaatttactggagaggtgaactactcacatggagatgattagtgtcaattagtgtcacatagcgttttaagcagattttcgtaacactcaagctcaccccaacagcaacaggagatggctatgatgttattaccaaaggacaggatatactacagttaattttatgcagttatgatttaatactacattatcatttgtttacatttgtgttgacttttcgtagcatcatgtatgatctgtggtgcgtaagtttggataaatactaactttttataatagatatttgtatgttttatggtggtaaatgataaaatagactagtatttacatatattttatgcattaatgacatacctttttcttgtttccatatttctaggccatgcaggtcatctctgagttttttcaaattgtcacagatctctaaaaaattttccaatatatttgttgaaaaaatccatggataagtggactcgtgcagttcaaacctgtgttgttcaggggtccactgtaattgatgcactgctatttgcacttatcaaggagccattcctaaataacccctaacaaccactaatgatgtattaagtatgaatcaccaggtagtgggagagattttattttttcaagagttaagtgacttactaagtttctcaaacagtactcttcataggtgcctgcttcccttatcattttataagactgtatctggatcatgaggttgttgcccagtaaatctaaatataacataggggcttaaatgatgctattgtttatattatacctcatatttttccaaaatggatttgaggtggctaaaattttgttccacttacagtgctgagaatcgtatcttgctaataaatgttgattacatttaattaactgcttctaaagttatcaaaatgaggttcttactaataagaagaaaaattcaaaaatccacttagaagtttattcatcctatgatctacgataagattaaaataagtagtatttagataatttgatcttattcaaaagcttggagctttctggtaggaaaaagtgataacacttagtatgttcatccagatgaataaattatttactggaaaggaccaacatctggatctttcacattcttcctctttggttgtatataactactgaagtttacctattgcaagtgataaggaacttggctagaatttcaaagaatgaggaatttgatggcataaactgaagcaaatactgtgtagcaagagtaacagtgaatttctgtgactcttctcttttgaacttttaggacattttctgtttattagtaaaatctctttaattggttctcaaacatgtgtccacttatgatcaacattgttttgtctgtgttgtgccaaacctctattaacctcaatagggaaggcaccaggttcaagaggctgaagaagagacccagagccagcaaacgagacatggggttttattaggaacttatatacgtacaggggagagaatccagtggtggctggctggacaagatatccaccttccttgcagtccagtggtggtgggctggacaagatatccaccttcctacagtccagtgctgcgggctgtacaagatatccaacttcctgtagtccagtggtggtgggctggacaagatatctgccttcttacagtccagtggcagggggttggacaagatatccacctttttacaatctaatggtggtgggctagacaagatatccaccttcctacagtccagtggcagcaggctggacaagataattgcatggcccagtgatggtgggctgggcaggaaaactgcaaccacttgcaaacagcatgcagtttatatagcatttttatttaacaacctcccctgaatgacctccacctggcaacttttatccaacccaaaactcagggcctcaatccatgttccatgggatgggccaggggctcagatgttccttatagacaaggaagaaatctttggattggtcactcccagattccctagcttggaacacacattcaggtatatctgccatacggggtcattctcagcgtatgctcagggcatgcttaagttattgctatcagggtgtctaccctagtctattcctttagccactttttcctccccctaggattactgagacaaattattataggtgaaatatattggctttgtaatttttataaatgaaaattcgaatgttactaacatctcatatttaaaaatataaaagaagatacactatttcctgagaaaaagtatcaacttaaaaaaaattgggctcctgctggggatagcagctcaattttcttgtttgcttttaatttgttatgaccatttccaaatagaaggattggatgaagcagctttagctaatatatcagaatttctgtagatacttaaccaactccttactctggctttgatttcttttgggctttaatttcctaggtaggcacatttcctgacagcccaggctaattaattgtattttaagcctgaatcttgcagctttacagaggctgtcaatattagcaagtgtaaaacttgagtcatttgtaatcgctctatatttcattcatctgcttttataaatgcagtttttctgatatatgagaggatcatcgactgtgagagtttaaagtggtttcagagattattttacagatgaggaaactgtagtactgatatgttaattgacttgtccaaagtcatacagcctgttggtggtgcttttataacttagattatgtacctcttatttgggattaagactttccatgtcttgcccttactggtctaacttccttgccaggtcacacaaaatactaattactatttatattgtttaatagaaaaaaattttaaaacttagacttatgaaaaggcaacctttcctagagaatttggtgtggtttaatctactgtacaatttgagttatcagtccttccacaaactgtggtggtgaagtggcttctcttgtatggatattgagctgtgaggaattcttctgtaaggatacttcagttaagattttcaatttctgattctagagcatagggttaaggaaagggccccctggaggattcctgaaccttttctcattttggagaattagcagtataatttctggtcaacatagtttggtaaaggatagttggcaattgtgcttttgcctgtttcacttgcagaagggtcaagtcaggtaaaagtaagtctgtcagactagggaagcattagcctagaaacagcaggtaggtaaggaagtttagcacttcagaaataaggccctgatttctagcaaacactatgtcactgctagtctggagtagcctaattgccattagaaaagaattcgtttcttaaagggaaaaatcatgaagaaaacttcctgagagctttattacattctttttatgaaattatttctgcaatgtattgattaatatctaactttaagaattttatgtaggcctttcaccattataattttgaaatatgaaaagtccttgcaaacattcttagattgccttctgtctgtctgccttgtaaaagatccttttagttaaatggaccatcctccttataaatgatgtcattagctcagattgaaaagacattgcctgcagggaaatcatttaattgaactaaagtgcctttatttctgtagatcttggaacagctcactcactcttattttcagattagataatttatatcagataattttttcagctctataaatgataaaatattaagaaaagtaatcttctttttaagatattttgatgtttcatagttttccatttatatctgagttagaatttatggttcttaaaatgcaaaatcttatttttcaaataaaagtttttttgttcattagactaaattattaatgtgtttgggatacacaggtcagtggctccaaaataaatgtatgtgagatatatagaaatgagtcaacttcttttactcaagatcttttctcactgtcctttttgtttttagatcaggtttatcaggtataatttacatacaataaaattcatcctttaaaagtgaacaatgtgatgagttttggtagctatatgcagctgggtaaccacttgcacagtcatgataagatatagaacatttccagcaccccaaaaagttcccttgtgctcctttgccatcagtaccctgcctccacacccagcccctggcaaccacttatctgatttctgctcctgtagttttgccttttccagaaggtcatatcaatagtattatacaatatgtagccagagaaatctggcttcttatacttagcatgatgcttttacaattcatccatgttgtttcatacctctgtagttccttcctttattgttgagtagtgttctgttgtatggatgtatcacaacatatttttctactcactaatgatggatgttttaattcttttcagttttgactaataggaataaaactactgtaagtgttggtgtacaagactttttgaaggccatgttttcaaatctctatggagtggaattgctgtatcctatgatacatgtttttatcagaaactcccaaaatgttttccgcaatagctataccattttgcatgcccaccagcaatgaaaataacagttgctttgcattttcacctttcttcatttgtattgtccctttcttcattttagtccttctagttaggtgttttaatggctatattgccttttaattctactgctacctattttaatcctagaattctaataatttagaaatacaaataaccaaaatagatagttacctaattgttagtcaagtctgctttaaagatactagattggtttggtttatggttctaaaaccaagtataagcataaccagcttttaaaaaattgtgtattgaggctggttgtggtggttcacacctataatccctgaactttgggaggccaaggcaggaggatcgcttgagcccaggagtacaagaccagcctgggcaaaaaagtgagaaccctgtcttaaaaaaaaatagaaaaaattagccagcagtgagccgtgatcacaccactgcactccagcctgggtgacagagtgagaccccatatcaaaaaaagaaaaaaagaaaatttttatattgaactaggtacaggctaataatcacttttggtattacagaaataaaaccattattatttctttttgtcatgttcctaaatatgtgatatgataatgctggctgaagcaacacatgtctcctcacctcttggagcgtgccctgttaagaaatgtattgaatttacttggcaactgtacatcctggattttttttaaattaaaacaagttttacaatctcaatgtgatgttcaagagttataccattgtactggttctatatatatttctttaaggaagacatttctccatatttgactattaaaaatatcgacagttttttgctatgaagtcctctggtgtcttaggcataatagaaaatgttgctatattcaagactttttatatagtatgagtatttagtaataattttaaggtcctcttgatatatggttcctgcttttctgtttggattagcattgttttgaaagtgagaaaattattttacatataaatttaaagctaatccaaatatttgtttagaatctccaaagtcttcactcttttatcccggatactttaaaaaacttagaaatgttaggatattagtttcaaaagcaagtatgaaatataaaatgttttattaaaatgaccaacatatgaatgttcttactgaggtagaaagttgtaccaaataggacagtatattaaatcccaacagtaattgaattataactggtaaaaccttttgttagtatttcttctgaaaactggtttgttcttaaataactgtacctcacagttacctgtaccaatgttttatgactcatattgtaaaattcacatgtaagatttctaaaagttcaccttactaatttagatgatttcatgttgtgtagctcttctgtcagtcatttgatgtgaacgacaccaaaatcagccacaacatccaattttctcttggtctctagttcactgctaggtcagcaaacttttatggagaagagaatgaaagggtagattgggtctgaaacaggtaataggcaggttttgtatccaggtgagaaggttccttgcttccagacctaagtaattagggggctaagaatcctcctataattcagctcataaaggtgtttaactatagaatgaacagttagaggtgatgattaattagcctgggcactttgggctggccagtgtgcaagcggtagtacatactggccatcagctggtaggcatgcagtcttgtaaagggctttctgctctgacactggtaatatatcattgcagctgtgccctttgattactgggagggcttgcagagtgattaatagccaggatcaatgtttctgcccagcacatgacatttggtcacagagcaaccatatacttattcccctttggcacaacgcttaggaggaatgaaggatgagacctgccaatttatagctgaggagattccagtttataaaatgagtcaactttgactgtacaaaattattccccattgaaataattagtgcggcattaaacacaattagaaccaaaactacaggagcatgcctgctgaattcaagccagttgacagatggttaaggcttgatatttggcggcctatgatgaccaagagttattattttgcgagaaaatgaaaaagcttgaaagtaaacagtggctacttaaaaaaattaggtaatatgatgcaaaatacacatttaaaaaacactggaatagtagaatattcagtgtaataactctataactgtaacacaaacaattgaatatctctgtgtgagtgatgcttaatgcattgtacgtcaacttaaagcagatcctgtttaaaacaaaattggttacatgaaggccacctgaatatgatatggtcttagttaatgatacatgttgggcctcaacttcctttaagtggcacttataaatcctactagaatagaaggtttttggacatcagatattattgtgaacttaactatgtaataaaaatgtttgagctaaaaatttttttaacctaaaaatctttaccttgaaatttttagatacgtaaattaagctttcttatgttcattatgtcagaatatattactataatggaaaaagaatgttttcctactttccaaattaaactttaataaatgaaaagtctatatactctaacagagtagaacaaatacattgtggtcttggattttgctagtgatacttaactaatggttcatactgtatttgaagtgtctgctgccattttgtggcattagctcacagagtattatactgtttctacatcaatggtagatgtgcttcttagtgcggagtcattttacattctgtttataattattccgaagagactatgttcagaaaattgtcagtctattttgtataccatagaactttgcgattaatttgtgtgtgtgtgtgtgcgcacgtgtgtatctgtgtatacatgtatatggtattaagcatataattaggggggagtgggatttaggatttggaaaaaattacaagaaatttacatgaatagaatttcagtttttcaacttacacacttgattagtgctagagttgcattttgtgctcatagtaacaaaaagtcagctttcttacctgatttttcttttgagctattataaaggggtataagattaatacattgtttggtgtttatatgctcctttattttcagttagaacagagccaatttaaattctgacagttttgggttatttaatttatgacatatttacatttcttaatttgtaatgtaagaaaaataagctaattattacttggatttatatactagttttttttttccttcagaatgctaagtgctttctgatttctcttataacatttttttctttttcttttttttcttaaccactgcgaagatgaagggatagaaaggttctttggcttaagatcacagccagtggcacagctgttgtaagaaaccaggacttgcttctaattatctactgattgttctggtactgtaacttcataacaatatgaaatgatcgcagtcagctttcattaagtctaataaaacatcttcaatgtattttataactattcaaacccattttcttttttgttcttagaagctatagtgattttgttcttatttgtccacacattccttaataccttcttctgaccaataacaaatttgtgggttgtgggagtttgaaaagaggtggtgatatgatttgaatatttgcccctgcctacatcccatgttgataatcccagctattcagggggctgaggcatgagaatcacttacagttgggaggtggaggtggcagtgagccaagattgagccactgcactccagtctgggcgacagagcgagactcggttaaaaagaaaaagaaaaagaaatgtaatccccgctgttagaggtggggcctgatgggaggtgtttgggtcatgcgggcagatccctcatggcttggtgctgtccctgcaatagtatgcgacaatgagtgagtacttgtgagatctagttgtttataagtgtgtggcacctccccctccctcttgctcctgctctgccatatgaaacaccaggtcaccctttgcctttcaccatgagtaaaaaagcttcctggccaggtgtggtggctcacgcctgtaatcccaacgctttgggaggcagaggcaggtggatcacttgaggtcaggagttcaataccagcctggccactaacatggtgaaaccccatctccactaaaaatacaaaaattagccaggcgtgggtggtgcacgcctgtagtctcagctactcaggaggttaaggtaggagaattgcttgagcccaggaggcagaggttgcagtgagccaagattgtgctaccgcactccagcctaggtggcagaggaagactctgtctcaaaaaggaaaaaaaaaaaaccatcttgaggcctcccagaagccaatcagatgctgacaccatacttgcacagcctgcggaaccgtaagccaacgaaacctcttttctttataaattacccagtccaagatattttttatagcagtgcaaaaacagcctaatactggtggttaaaagtcatttgtggctgtgaataagagcaaaattctgaagtcaaacgaagaccttagcttcattcttacctacattctaatatgagatagctggatcttgagtgcatgaaaactaaaaatgagtttacttgagaacttcaaggctttagatttctactttaactttatttttttgtcccatgtggatatataatgtgttcaaatgattaaaaattaattagctatgggaaacagagatgcaaaatgttgagttaattacagattagataattgctgtctaaaaaagaatgatctgtagaaggaggagagttaagttaaccttaaaaaaaactgggcaattttataggtagaataaagtcaaataattatatgttcagaaaaaaaagatattctagaactgtcagtttgtacagaatgtatgtgtttagatacagactgagataatttgcatactaaaagagctcatgaccctgctcttgctagggcacgtgtttattataattaagaatgttttcctttatggagcacatgcacacaggcacccgttgaaagtgccaggctcgccactgccttaggtcccctattactctgcctggagtgctcttcctcactccctcccaccttcccccatcttgacctgactgatacttttatattcctcagttcagctcattggtcacctcttcagagaggtcatcccagacaacccttcctaaaatagttctccaagctctgtcatcattctccatcccattagcctgttttacatttgccattatctgaaataatcttacttatatgttttttacttgtttctcctcactagaatgtaatttctgtgaggttagagaccttgtctgtcttgttcaacactgtatccctaattgtagaatggcggatctttaatgaatattggtttaatgaattaatttaacttttttacattaaatgttaatcttagttaaaaagaaaaaattcccctgggtcctaatttcccccatcttgattaccaaatagtttgtatagaattgccggtacagcccttagacccagacaagaggagcccctgtactttggagggccctaattgggcccttttccagttgtgccctgtcccacaggttcagttcttggggtgaaggggaggtgcccaactcatgtctgcatctcatttcccctcacctcatcttctagactatattccagttcccagggtccctgaaatccctactgagatggccccaagcttgctcccagggcctgtatgggcctcttcaatggctctgtcttatggtagatggagcatattactgctgtgtatgtctataggcatgggggtaactatggattgtgtgcaggggactgtggacagggcatggaagggtgggcatctccacaagcctcctttgggtatcagatggagccagggtagggaaaaaagaaatggggatttcttaggagtccaacattctaaatttgagcccagtcttccttattattataatggtgtatatttgtcaagtttggaggatagaccatgttttggttaacagattcattagcttgatataaaacttcttaatatttagacatatgctctgtgggcctccatttatattcttgtgatatgccctttgatgtcaagggaaggtttgagtgttgtatttaaaactttgtttcctcggccgggcgcgatggctcatgcctgtaatcccagcactttgggaggccgaggcaggtggatcacgaggtcaggagatcgagaccatcctggctaacatggtgaaaccccatctctactaaaaatacaaaaaattagcccggtgtggtggcgggcgcctgtagtcccagctactcgggaggctgaggcaggagaatggtgtgaacccaggaggtggagcttgcagtgagccgagatcgcgccactgcactccagcctggacaacagagtgagtcttaaaaaaaaacaaacaaaaaaacactctgtttcctcacaggatcctaaaggcatgatcttttttccagaacttgggtatattgaaagagtttagtaggtttttaatgaaggtaaaaactatttgcacacctcatgagcaaaaaaatgacagttcagttttgccccaacattttattatgaaaatttccagatgtgcctcaaagaattggaagaattttacagaaaatacctatttatccaccacttagatcttattttcctgtccttgctttatcacatatcagcttcccacccctctgtatattcattagctcattcttatttacagttttttgatgcatttcaaggtaaattgcagacatcagtatacttccccctacacatttaggcatgggaattaatttttaacaggagagggaaaaactttactgtagatgcttaatgttttaaaaataatttttctgtataatttgttaaactttcttatgttcactcttcaataatgactttgaactcccactgtgtgtcagccttctacagaagatgcctgtgttgatcattatttgttaggacttgatgcagcacatgttgatttatatccagttttgtttaggtaaatcaggctttgagaatacagagataaatatgaatgattcatcacctttagagacaaattctggttgaagagccacagacagcaacatggagagttagagtgcaggatgagaagcagtgatattctggtagatattttatcgctggctttcacagaagaagaaagcctaatttgtagcttgtggcctttacagctttccattgtgtaaatactctcaccgtggaggaaaaacttttgctccatcaacttaggtctgaatgattggggatcttcaaattaactgacaataggtagattaacaggagaaaagacaaggtttattcacacatatgtggtaactcaacaataggtaactccctgaacagccagaggtaaaggtttgtataccagcttaacaaaaggaagatgtttagggctttaaaggatggaaagttctgatgagactcgtttacataattttttttttttttggaatgtccctgtgcccaaggttagtgcctccctaactggagatgggggtagtggggtgaaaaagtgagggtggaattgtggcagctgactattttaatgctctactttagtcagataagggcagttcagataagatttcttttttttttttctaagacttataattattttatttcattattattatactttaagtttcagggtacatgtgcataatgtgcaggttagttacgtatgtatacatgtgccatgctggtgtgctgcaccccttaactcgtcatttagcgttaggtatatctcctaaagctatccctccccgctccccccacctcacaacaggccccagagtgtgatgttccccttcctgtgtccatgtgttctttttgcatctgcttttaggtttctggtccctttagcaaccaacatgatgtcactgtggaggtgggaagagatgctaacagttggcttatgatccagctccaggtggtttcagcacattactggaagcattatgatagaggagagcctataggtgggatttccaatccagagggaggcatcctggaagatatggtacttaagctcactcttaaaggatgagtatgagttaaataagaaagggtgggagagtgggtcaattaatgttggatttgtagttggtttgttctggtcttggtgggtcttgtatatattgctaaagagttcagagataatcagagaaatattggtgggggaaacgggtaggggagtcacatttttctccccaaaacatcaacctagtaacggtatggattggaggaagaccagaataaaggcaggagggaagaaggagagaacaaacaagatattcttaggaacacaagtcaacagaccttggtgattgacttggagaggagacagtcaacaacaacgtctggatacctgctttaggcaaattcatggggaatgatacattccaccagggtaatgcaaaaaggaagaatgacttgggggaatttaaaaataccaagttgtaactgctttggggacatgcgagtgacagtgtgggcagttagatactggtctggagctcaggagagtgatctgagttaatcatatgtatttcaggagaggcagaaagaatctggtacattctggtgttcttttttatacatgtgtcttagtccattcaggctgctgtaacaaaataccttagcctgggtaacttataatcaacagatatttatcgctcacagttctggaggttgggaagttcaaatcaagatgtctggtgagggcttatttctcataaatggtgccttctatgtgccctcacatggtggaagagcaggcagctctctagggcctcttttatgagggctttaatcccattcgcagtgattctgcttttatgactaatcacctcccaaaggctccacctctttttctgttttagagacacagcctcagtctgttgcccaggctagagtgcaatggcatgatcatagctcactgaagcctcaaattcctagactcaagtgatctacccacctcagcctcctgagtagctgtgactataggcatgagccatagtgtccaattcccaaaggctccacctcttaatactatcaaccttgggggttaggttttaatatatgaatttgggggggacacatatttagaccatagcagcatgtttctaagatgtgttatttaatacaactcttttttcagttaactttttaaaggtaaaaacaaacttttaaccaatctgttcacaagatgcctaagataatatttacgtattataaattgatgtagctttacatctgattttattctggtaaatcaggctttttggctaattgaggtttatcactaccttatattaattatcagttaaataattaccaggtgacttttcagtggcaacaagaattttctcaacatatacccaaatgatgttataatggcttatagcatatttagtggtcagcaaagtcatcagactcctgctatatgccaggattgtgccaagtattgggaatccatcaatcctgcccctgtgaaacttaaagtctagtggagaaaatagatactaatcacagaagcatagaagcaaataaaatcagtattatctacaagttctaataagctcatcctataaaggagaggtacatgatgctaacagggaaacttgatctattcagggaggtcagggaaggcttccttgaagaagaaacaggatgaggtttgaagagtgtctatagtgtgaggaacagtgtggaggagagtgatcagagtagatgctgctaggaggctatttcagtccaggagagatgacaatggctggtctagaaaagtggtggaggtgctaaccaagacagaagtgatggcaatccttaggaggtcagatcgtaggtcttggtgatggtttagcaaagggaggtatcaaaaattgtcctagctgttgatttaaagtcttgtgttttatttaggagttagcgctgattcactgtttaaatgaaacttaaaatggcaatttcacaaagcctagggagaatgcctagtttctttgtaaaggtgtccattaataagtctccttggaactaaggatttgttgcaaagttgactcatcagctgttttagtagcagataaatatgcaaatatctctgaaaaggcgcagtagcaccctggttggtatttgcacttccatcttcttttaacagatttatggattttttaactgttataaattgaagtcatatgaaaggtgggctaatatgcctttatttttttttccagaaagacttcatttttttaaatgaaggaaatagggaaaaaccccacaaaagattatttttctgttgtgttttagatgcaccctgctctgttcaaagctactgtcatgcaatatgcactgttttacatagtgtaagagggtcacatttatattgattctgtgttgatgagggataagcttccatctttgtcatcttttataacaagtatgtctgttggcagggatttagtaagattggataaatgtcttcttttgtgttaatgacaaaaaggcaacagctctagttatcttataaaataaacattggtaaataaagttaacattataataggaatttgtatattatagtgatctctgaaagtgaaactttgaaatttataaacatatccttaatacactatggcctgagactcagatgatacgtagtacaatagcctttttgcactggtttagccatgattttttatgtagtatgttggactggagcaagttagggaaaagattgggcccatgaattagacattactcctcatgtgaaaataaattttgctttttgaacatctaaaagttgggaaagctgatcacaattactttggttttatatatggaggaattatgaccaagagggttctgtgtttatctatgtgtatatatgggcaaactagcttaccacctgtttttgtacagcctgtaagctaagagtggtttttatatttttaatgattgaaaaaaataaaagcaatatttcatgagatgaaaataatatgaaattcaaatttcagtgcccataagttaagttttattgggacacaatcatgctcattcattacgtattatctgtgactgctttcaagctacttcaaaagaagtaagtagttgtaacagaatctgtctggccactaaagctgaaaaaatgtattatccatccccagtctagatagcccctatgcaacaatggaaattatttaggtcattcaaaaccaaatgaatgcttctgagagacagatgacagaagcatgagttgaactaagcagaataaaacaactttaccacaataataattgcaacagctaccatttattgagcatttgctaatgtgccagatactcttcagggcacttttcacacattaactcatttaatccatacaactctatgagccactaacatatctcattttacaggaatcagcacagagaggttaagcaacttctccaaagtcagtcagggatgaaacaggccagtttggctgtctttcacacttacctcagtgattttctcacatgtacataccttacaagtactttctattgaatatattatatttcttgagtcagagataacagtgttttcctttggttgaccctaattgcttgttctcacttcaggcactcctggtttgtaatgtttgtacataagagcttagtcagtgcaggtcatctaatttcaaatagaaattatttaaacctgtttttaatgatgactttagcagattggattattgtataacaggctctcctgtcttaaaacacaaattacttgttttttaaaagcagactctaggcatattttctgttgtttatatctaatttatgaccaattcaataatttttccctctacatttttttaacatgttatgttacctccctgaccaaaatcctccagtaatttctcattgccttgaaatcaagtcgtgcatgaacattttccctcagaatcccaataagaagctaatcttaatttaaacagtatattttatagaatgatatgaattgaaatgctttgtcatgtggttgtcaattttgagattagggaaagattaaaatgtattccatttctgtcttagatattaattgggatatttgatgtcaacgaacaaagttgcattttatctttattaaatttcattgagtattgttaggcttcagatttttcccatctgtaacatagagacctacttataaaatgaatggaattatttccattagttcagaatttgtggtaataagggcaggtaattgtattctgtctgtaagtaaaagtagaattcactgtgtaaaaatgattgtagaggaaatatcttattacaatcattcttttattttataaacagctatttaatggtagcaattacaagtaatccttaataagtttttaaaagcaggatgcccccatcagacatttttatggaattattgataacatatttgaattcacatttctattcacaaattaagaacagttattactgttttatgaaaaatatctttaaaaattaaatcttgtcactcattcaaacttactgcctcctagttcatttcaactagtgggcttaacttactgagtcctttgaaattctagacttaagtttagaatgtcttggctattaaagcagacattacatagtctgaaaaatagtctttatagctgcttttgatgttgacagtgaagatcattgtaattcatttatttacttcaaaagttatatcaaatattggagaggaaataaatttattttgctttaaatttattttatatattatatacatgtatacaatatgtatgtaatttgtattacatgtttacattacttgatcccaaaatgtatttcttttagacacagaagaaacatatatgtttgatgtaaggtgttacctgctttcccagataagtaacttatctgaggtcatgcagtttttagtggctgaatttgaactgggaaacctggacctgactcctgaactaatgactttgaccaatgtgctgtactcttcacagacataaacagattaatatagtgaagaataatggatgcagtgatagaaatatgtccatcagttcaaagttctttgctgttctttatgtcctttatatgaatttaaaaatatgagaatgtgtgcagcactgattgttagcggaatcatagtatggaactagaagggcctagaacactgtcaaattttgctctaagtactttatataaattatttcatttagtcatcaaattgagattggtgcttttattgttcccttctgcagctgaggaaactgagattaaatgtcgtatttccccaagggagcctaggctaaacccagccgtgttcttttaagtactgtgaattttgcctccctgaaatgcttttcccccatcccttaaaaataagtgctttcgtatataccaataatgattttcctagaacaaacaacttttagacttgtcattacaattcttatagcctggcagtgttctgacttaggtctcagtggttaggaatcaatttagggtcatcaaaagggttctgtgctaccttttgctatagaactaacaaaatataattaataggattggcatttcaaaatttatagcttataaaattatatattctcaggatttaaatacctataatcagttcatttataggtgttgagttgttaaaaaaaaatgagtatgtagtatgttaccaggattttaccaggtatgtagtatttaccagaacttggtctgttttcctgtttttaccttgaaataccattcatgcctgtctttgacatgtttcttattactcctccctagaagtatcttgtttgtcttgacagaacactctggacttttgtgatatattgttaccatcattatttggtattcttctgtttatgtatgtaaaacaaggagcagctgctttctgccagcattttgggtactcatttatattcccacattggtgaccttaatttgaaacacactgctaccatgtggataagcagaagaatacactgcctaggggtgtagattgatcagtctgttatcactggttaaaggcatagcaagaaaattgacagaagattaaaactaaataattgaggatcctacacatctgagaaaataatatcaaatattcaaagaactattaatgtgtacttttttaatagcaaattttatcaaaagcaaatcttatttcctcttttttgtccccatttattctcttaggggagaaaaagatcttatgtctgaaaaaaatccataacttagactttattttgtgttttattcaagcatctagaaagcttatatcaactacttcatgtctttttctgtcgtattcaggagggtatttgagtgtcatcctctggagttgaagaaaccagatggctgctgtacaggcaaatgtatttcatgttaaaatattttttaaatttttttctttaagtttataatattttcagacatttaacattttttcctctgaatattaaaccaattaatgatttcaactcttttgacctcctggaagtcccagctacattttggtttcctgagaaagcactccagattcctcatttggagacctgaatcactggtttgtgagacagaacatttgggaatggcatgtagtttggaatgatgacagcacaggatgtagatgtgccagaggtgagagaaggtggagaggtagacaagagatagattttgaagggctttgtatgttgtgctaaaaagtcaggctctatcacatagacagtgaggagccattgtaagatcttaatgcaggaatgacatatcagatttgtgataggtgtctaagtaagaggaccttggcagaagtatggagaatggccttgaaataccagaagtagggacaagctgttgttgttgatccaaaagaaatgataaattataagagcttaaagaaatggtagtgaggagtaagaggagggcataaactcagatatttcggagatagagttgatgggacttagagactgattagctatggagggtgaaggaaaagaagtagagatgagtctgaagttttgagatgactaaatagatgtgatgccattcatagagatagagattataggaaggaaaggaggtggttggaattaggtcagtcatacagaggaaggaggtaatgagttcagtcttagacattaaatttagaagataaaacatttaggcatttgaaaatatccatatggaatttaagagaaagatcttggccagagtcttcagcatacagggggcaatagaagttataagtgtgggtaaaattacactgggagggtgtgtagaattttagaagtgaaaacactgaagatagaatgctgggaggatttcaccattaaggacggggataaggggcataagagtctacaaaagtagactgaaaaactgtataaaacgaccaggagagaatggtttgactagaagccaaaggagaagagcgttttaggggagagatgagtcagtagtgtcagctacttgagaaaggtaagtactaaaaattgtccattgaatatgcaatcagcatatgagatatccatggagcagtatgtgcagaagtcaaattgtagtggattgaggaatgaaacatgaaaagtagagaagcaaactactcttctaaaaagccaggtagaaacaaactatgctatatgcataccttggaataccagtcaacaataaaaaagaacaaactattgatacacatgacaacttgaatgaaactttgggcagttacgctgagtgaagaaaagtcaatccctaaaggttacatactgtataattccatttatatgacattcttgaaatgacaaaattatggaaatggaggacacagagtggttgccagaatttagggaagggggcgtgggagggaggtggttgtagttataaaagggcaacaggagggatccttgtggtgttggaacttttcaggatcttgactgggtgcatacattaacctacacaggtgatgagattccatagaaaacacacacacacacacacacacacacacacacacacacacgtacaagtaaaactgggaaatctaaataatattggtgaattgtgtcaatgtcagtatcctggttgtgtaattatactatagttttgtaaaatgttaccactgaggaaaactgagcaaagtgtataagggattctgtattatttctgagaaatgcatgtgaatctaaaagtatctcaataaaaatttcaaaaaaatttaaaagtcaggtagtgaaggggagaaaagaagggacaatagccagggagttgcaaagttaaaaggggaacttgatcatgtttttatgttgtggaggaggcagcactggagaaggagagattgagatgccagggagaaagaactttctctgaatcaggaggaaaagtataaggttgggtgtgaatatgaatgtgtgtgtatatgtttatgagaaaagcgaagagagttgcctcttgatagtgtttgtgtgcatgtaaatctcttaagattcacaaaaaaggaccctaataattgcagattaattttgtaatcaatggctgtgacagactttggtattgtgaatttaaaagatccctttagaataagaattagcaactctttagtccaaatcaacatgtgtgatgtgataccatttacctaccacagacagtaacaaatcaggtgcttgttaacttacatcagttaccgggctgttccttttattgcagttgtagtctgataactcaaaatattttcaacagggttaaaaaaagtctatctagattattggtgttatccacatctctctgacctagaatttgaatcagcaccatgaaacactttactatttatagtgtatcttgaaatccaaagttttagaatggtattgctggcttcttaggctttggcaaaagaagtggtggcatgattcatattcattctgggaaagagtgagtgaggatagtcacctggaactgaggggttggctattcacaggagagatgattttgactggtagcatatacacataggtgtgtatgtatatatatatatacatacacacacacacacacacaacttgatcttgttctttcttccactgacacttcgcatttcagtaaggtaaagaagcggggatcattttttccctcctttctgccttttgcatattatgtggggtgtgtgtatgtgtgtgtgtgtgagaagactttctgtcttcaaagtggcctttgatatgcttttatttttattttttatttttttgagacggagtctcactctgtcacccaggctggagtgcaatggcacagtcttggctcactgcaacttctgcctctcgggttcaagggattctcctgcctcagcctcctgagtagctgggactacaggcatgcaccaccactaccagctaatttttgtaattttagtagagacagggtttcaccatgttggccaggctgatctcgaactcctgacttcaagtgatccacccacctcggcctccagaagtactggtattatgggcatgagccaccatgtcctgccaataggcttttaaaatctgattttacctgtaaaaaagttggagtgtaggagaaagaggagacatgtaccaagtgataattcttcaaccctgcctctccccacagcactgggctttcataccttattgtcataccttacagtagccttaccccaggtattgatgttttagttgcaatttgattctgtttatgtgttaagcttctataatatttatggttattgttttgtcatatcttgctgcttttcagtacaagatataaactgagatgtgagataactgcaaaacctgtattgtctttgtttttgtgcctccctagggattcttgacatatatgtggttcattataaatgtttattgttcattgaataatgactcatgccttgtggatgtgagatggagaccgtgtgaaaatacatattattctgaaataaagttatcagaaattgaagttaggaggtttagttggagaagaaaaagggagaaattgtgggaaggtgcctagcactttatcctgctatccagttgtagaatcgctttattaaactggcatttgttgatgttcctttggaaatgtattagctggaagatgcagaatgaatgtaactgagaaaagcctgtaacataccaagaaatacctaaggcaaatgctaacttaatacaaattatcttgccttcatcctcagaagggcaataaatctcaattccgataaccagcaatgggaaaaaagaaggttttcacctttatatcctcaatggagagataggaagagaaaaatgtaaaatggcatctcattctagtcttctgatatcctcagccaatctgtaagtaacagccacagtaagggtgcatgcagtaatgttgtgtggctgctagttgtagacctacataattacatgcctgaattagctcatttgtttcagggagtttaaaatgagtttcagtgccaaaccatgcagagtgtatttctggaaaatatcatcttcatcttatgtgggaatgtattttatagataacagactggatcttcaagaccatcactggatttatctaataaaactacataaaggcaggtataacagagttagcgatctcactggactcagccttattgtaagaatgtaaaatttcccattagtgctaaaagtttattaattaaatattccagattctatgaacagcagaatgaacatgtataactctaaagtgatattttataacttccaccaattaaagttacaggccataaaaatacttggttcccacaaaacaaacacacacgtggattgagtttcacttggaattttttgtgaccatttgaatgtttgccaaatgctttgtaaagtgctgcatacaagcactattcacaatagcaactacattgaattaatctagatgcccctcaacagtggactggataaagaaaaggtggtacgtatatatcagaatactatgcagccataaaaaatgatatcatgtcctttgcagcaacttggatgcagctggaggccattatcctaagcaaattaacacaggaacagaaaaccacataccctatgttctcacttgtaagtgggagctaaacattgagtacacatgaacacagagatgagaacaggagacagtggggcctacttgactggggatagtaggaggagggtgagggtcaaaaaactacctattgggtactatgctcactacgtgggtgaggaaatcatttgtacaccaaaccccagtgacacacaacttacccttgtaacaaacctacacatgtacccccgaacctaaaataaaaggtgaaaaaacaaagtgctgcacaccaaaaaattcaatatgctttggtttttctgatatttatatagtgtttattgacttaaatgaaagttttatttccttctgagggaaaaatttgcctttatagctcaccatagttattacaatttggcataaaaattaaaattaatcttttggtataaagtataatccccatagtacatgtctgtatttaataaccattatttatttaacatgcatttattaaataatgatcttccaggcgataggaataggaagatgaataaaactttagtggtcctgccctcagatagtttgtgcccatacctgcctatgtccaaacccgtttgttattcagtataactttctcttggctggttttctggtatcatcttttagctacatattcaaagaataacctgcataaaagtgcatcagcttttactttgaccattttattttctataaaaatattgatttttgctttatacacaatagttattgttttcaaaatctactaaatcagtggtacttttgtcaggttcatacatttattaaccaacagcttgtaaattcctgttttataggtaaagaaagtaaatattaaattgcagacataaagacagctatataaatatgaatattttattaaattatgtaagtatatactcttctacttattacacaagcatgcatattcctataacatactatataaaatatacatatgcagctgactccggcctagattttgtgcctatccactggtatcacaagttcactataactttgtgaatatcagttacatcccctacgtatcattagatgtacagtagataggtcttattggattcaacttgttgacttctcttccctttaaaccaaggctaaatttggacaacagttcaaatttgtttttgttgtcaagtctggaagaaaagttttagaaaccaggctctttgattacaataggcgagtgtacctttaggtttgagtcctagactgattatcatctaaaacctttattatcactagctacacctagggaaaggtggcatattaacaagttgtaacacttatctcacaggaacaatacttgctttgcttttgttggatgaaatttataccataccgtctaatataaacaataagataaaatgactgctgtgttatagatcataactagaaggttcctgagaggagttataattttatttcctttgaaatattattaagtaagacttatctaaacagttgttatacttgtctccacttttagttttttttttctcagacatgtataaaagttatgtagtaggattcccaggcaagatggccaaataggaacagctccggtctgcagctcccagtgagaccaatgcagaaggcaggtgattactgcatttccaactgaagtacccagcttatctcattgggactggttagacagtggatgcagcccaaggagggtgagcagaagcagggtggagcatcatctcaccggggaagtgcaagaggtcagggaactccctaccctagccaagggaagccgtgagggactgtgccatgaggaatggtacactctggcccagatactatacttttcccacagtctttgcaacctgcagaccaggagattcccttgggtgcctatgccaccagggccctgggtttcaagcacaaaactgggtggccatttgcgcagacaccgagctagctgtgggagttttttttcatactccagtggcacctggaacaccagcgaaacagaactgttcattcccctggaaaagggactgaagccagggagccaagtagtcttgctcagcagatcccacccccacagagcccagcaagctaagatccattggcttgaaattctcactgccagtgtagcagtctgaagttgacctgggacacttgagcttggtgggggaaggggtgtccaccattactgaggcttgaataggcagttttcccctcatagtgtaaacaaagccacccagaagttcaaactgggtggagcctaccacggcttggcaaagccactgtaaccagactgcctctctagattcctcctctctgggcagggcatctctggaagaaaggcagcagcctcagtcaggggcttatagataaaactctcccatctccctgggatagagcacctgggggaatgggtggctgtgggcacagcttcagcagacttaaatgttcctgcctgctggctctgaagagcgcagcagatctcccagcacagctctcaagctctgctaagggtcagactgcctcctcaagtgggtctctgaccctgtgcctcctgactgggagacacctcccagcaggggtcgacagacacctcatatgggacagctctggctggcatctggcgggtgccctctgggacaaagcttccagaggaaggagcaggcagcaatctttgctgtcctgcagcctccgttggtgatacccaggcaaacagggtctggagtagacccccagcaaactccggcagacctgcagaagagaggcctattagaaggaaaactaacaaacagaaagcaatggcttcaacatcaacaaaaaggacgaccactcaaaaactccatctgaaggtcaccaacagcaaaaccaaaggtagataaatccatgaagatgaggaaaaaccagcacaaaaaggctgaaaattccaaaaaccagaatgcctcttctcctccaaaggatcacaactccttgccagcaagggaacaaaactggatggagagtgagtttgatgaattgacagaaataggcttcagaaggtgggtaataacaaactcctccaacctaaaggagcatgctctaacccaattcagggaagctgagaaccttgataaaaggttagaggaactgctaactagaataaccagtttggagaagaacataaatgacctgatggagctgaaaaacacagcatgagaacttcatgaagcatacccaagtatcaatagccaaatcgattaagcagaagaaagtatatcagagattgaagatgaacttaacaaaataaagcgtgaagacaagattagagaaaaaaagaatgaaaaggaacaaagcctccaagaaatatgggactgtgtgaatacaccaaacctacgtttgattagtgtacctgaaagtgacagggagaatggaaccaagttggaaaatactcttcaggatattatccaggagaacttccccagcctagaaagacaggcctacattcaaattcaggaaacacatagaacaccacaaagatactcctcgagaagagcaaccccaagacccataatcatcagattcaccaaggttgaaatgaaggaaaaaatgttaagggcagccagagagaaaggttgggttacccacaaagggaagcccatcagactaacagcggatctatctgcagaaaccctgtaagccagaagagagtgggggccaatattcaacattcttaaagaaaagaattttcaacccagaatttcatatctagccaaagagcttcacaagccaaggagaaataaaatcctttacagacaagcaaatgctgagagattttgtcaccaccgggcctgccttacaagagctcctgaaggaagcattaaacatggaaaggaaaaaccagtaccagccactgcaaaaaacatagcaaattgtaaagaccatcgacactatgaagaaactgcatcaactaatgggcaaaataaccagctagcatcataatgacaggatcaaattcatacataatactaaccttaaatgtaaatgggccaaatgccccaaataaaagacacagacctgcaaattgtataaagagtcaagacccattggtgtgctgtattcaggagactcatctcacatgtaaagacacaaatagagtcaaaataaagggatggaggaatatttatcaagcaaatggaaagcaaaaaaaaaaaaaagcaggggttgcaatcttagtctctgataatacagacattaaatcaacaaagatcaaaaaagacaagggcattacataatggtaaagggatccatgcaacaggaagagctaactatcctaaatatatatgcatccaatacaggagcacccagattcataaacaagtttttagagacctacaaagagacttagactcccacacagtgacactgggagactttaacactccactgtcaatattagatcaacaagacagaaaattaacaaggatattcagaacttgaactcagctctgaaccaagtggacctaataagacatctatagaactctccaccccaaatcaatagaatatacattcttctcagcaccacattgcacttattctaaaattgaccacataattggaagtaaaacactcctcagtaaatgcaaaagaacagaaatcataataaaccatcactcagaccacagtgcaagcaaattagaactcaggattaagaaactcactcaatactgcacaactacatggaaactgaacagcctgctcctgaatgactactgggtaaataacgaaattaaggcagaaataaataagttctttgaaaccaatgagaacaaggagacaacataccagaatctctgggacacagctaaagcagtgtttagagggaaatttatagcattaaatgcccacaagagaaagtagaaaagatctaaaatcgacaacctaacatcacatttaaaagaactagagaagcaagaacaaattcaaaagctagcagaagacaagaaataacaaagaccagagcagaacggaaggagatagagacacaaaaaacccttcaaaaaatcaatgaattcaggaactggttttttgaaaagattaacaaaacagaccacttgccagacaaatcaagaagaaaagagaagagaatcgaatagacacaataaaaaatgataatggggcgatcaccactgatcccacagaaatacagactactgtcagagaatactataaacacctccttgcaaataaactagaaaatgtagaagaaattgacaaattcctggacacatacaccctgccaagtctgaaacaggaagaagtcaaattcatgaataggccaataacagattctgaaattgaggcagtaattaatagcctaccagccaaaaaaatcccaggaccaaatggattcacaggcgaattgtaccagagatacaaaaaggagctggtactattccttctgaaactattccaaacagtagaaaaagagggactcctccctaactcattttatgaggccagcatcatcttgataccaaaacctgacagagacacaacaaaaaaagaaaatttcaggccaatatccctgatgaacatcgatgtgaaaatcatcaataaaatactggcaaactgaatccagcagcacatcaaaaagcttatccaccatgatcaagtcggcttcatccctgggatgcaaggctggtttgacatatgcaaatcaataaacataatccatcacataaacagaaccaatgacaaaaaccacatgattatctcaatagatgcagaaaaggccttcaataaaaacagcccttcatgctaaaaactctcaataaaataggtactgatggaatgtatctcaaaatagtaagagctatttatgacaaacccacagccgatatcatactgaatgggcaaaagctggaagcattccctttgaaaaccggctcaagacaaggatgccctctttcaccactttcattcaacatagtattcaaagttctggctagggcagtcaggcaagagaaagaaataaagggtattcaaataggaagagaggaagtaaaattgtctctgtttgtagatgacatgattgtatatttagaaaaccccatcgtctgagcctaaaatctccttaagctgataagcaacttcaacaaagtctcaggatacaaaatcaatgtgcaaaaatcacaagcattcctatacaccaataatagacaaacagagagccaaatcatgagtgaacttccattcacaattgttacaaagatagtaaaatacctaggaatacaacttacaaggcatgtgaaggacctcttcaaggagaactacaaaccactgctcaaggaaataagacaggacacaaacaaatggaaaaacattccatgctcatggataggaagaatcaatatagtgaaaattgtcatactgcccaaagtaatttatagattcaatgctatccccatcaagctaccattgactttcttcactgaattagaaaaaaactactgtaaatttcatatggaaccaaaaaagggcccgcatagctaagacaatcctaaacaaaaaagaacaaagctggagacatcacgctacctgacttcaaactatactacaaggctatggtaacccaaacagcatggtactggtaccaaaacagatatatggagcaatggaacagaacaggggcctcagaaataacaccacacatctacaaccatctgctctttgacaaacctgacaaaaacaagcaatggggaaaggattccctatttaataaatggtgttgggaaaactgcctagtcatatgcagaaaactgaaaccggaccccttccttacacattatacaaaaattaacccaaggtggattaaagacttaaatgtaaaacctaacaccataaaaaccctcgaagaaaacctaggcaacaccatttaggacataggcatgggcaaagactttatgacttaaacatcaaaagcaatggcaacaaaagccaaagttgacaaatgggatctaattaaactgaagaccttctgcacagcaaaagaaactatcatcagaatgaggagacaacctacagaatgggagaaaatttttgcaatccatctgacagggggctaatatccggaatccacaaggaacttaaacaaatttacaagaaaaaaaaacatcaaaaagtgggtgaaggatatgaacagacacttctcaaaagaagacatatatgtggccaaaaaacatatgaaggaaagctcatcatcactggtcattagagaaatgcaaatcaaaaccacaatgagataccatttcacgtcagttagaatggcaatcattaaaaagtcaggaaacaacagatgctggagaggatgtggagaaataggaacgcttttatactgttggtgggagtgtaaattagttcaaccattgtggaagacagtgtggtgatttctcaaggatctagaaccagaaataccatttgacccattaatcccattactgggtgtatactcaaaggattataatcattctactataaagacacatgcacatgtatgtttattgcaccactattcacaatagggaagagctgtaaccaacccaaatgcccatcaatgttagactggataaagaaaatgtggcacagccaggcgccgtggctcacgcctgtaatcccagcactttgggaggccgaggtgggcggatcacgaggtcaggagatcgagaccctcctggctaacacagtgaaaccccgtgttagataatattaggagaaatacttactgtagatgatgggttgatgggtgcagcaaatcaccatggcacatggatacctatgtaacaaacctgcacattctgtacatgtaacccagaacttaaagtatgataaaaataaaaataaaaaaagataaaagaaaaaaagaagagattatgaaaaaaagttatatagtaaaggtaaaatttttaaaaacatctgtgtataaatcaatatattttaaaaattattaaaatgaataatagaattggaaagaaggttgtaaattatctagtctatgcctctcattttataagtgaagtctagaaagattgaatcgtctaggaacgcacacgaagtttacggttcaacaggagtagtcttctgattcctgatctatgttttcttcttcttctatagagaatgactatgctattcctattttttattgcatagtttttctcaatatatgcactactaggtactgtacctagttgctggatggttacaaaaatattaatgtagacacatatatacccacaccttcctatacacatacatatcaagtcacgtttgcagactacctgggaaagaatcacctatttctcttgaaattattgaatttccaaactgctatcttttgtctagctttcatctttgtcatataaagagtatttgacatcttcatttatttttttaaaaaaggctggaaacatcatttgagatgatgatagaagaacagtcatgtgctgcctaacaacctttcagtcaacaacgaattgtatagttgatgatggtcttataagtttataatagtgtatttttactgtgccttttccatgtttagatacacaagtagttaccattgtgttacagctgcctacagtattcagtagagtaacatgctatagggggtttgtagcctaggagcaataggctatatataatattgcctaggtgtgtagtaggctgtaccatctaagtttgtgtaagtacgtgtcatgatgtttatacaatgacaaaatcacctaatgatgtatttcttagaatgtatccctgttgttaagtgatgcatgactgtaattaactccagcaagaatctttgaattctaaatctatagatgttaaaactagtgaatgaaagtttgaagaatgggatattttacgtcatctcaaagtatctctctgtgagatacttattatctataaagtgaaaaacagtcatgtgacagtggagaaatatggcagataacaccttaaataagtgatgaaaattaacatcatcagggatggatagattggtatcatgttaactcctgacatggtgcactgagccataataatgggatgagtttcataaattttttttgcctttgtaaatttttggaatcccttggaataaaaaattcagactttgtatcttttatgtctgagtctacaaagaaatttatggtgctactagatcattttcaatgtgagcacttattttcctttgtaaatattttcttatgtggaaaatcttggtaactttggttttatccatgtaactaaaaacacaagaaaaatgtttttatttatattcaagcaagtaaatatttggtattattaaaatataattgaaaatatttatagaaacctgagatctcagacttgaagacaacattttcttcagaacaagtaaacttcaattggtcagtgagatgcacaatgctgttttctcattatatcctaaagaagaaactaatgcctgactagcaagtttgttcagttaaaatatattgttaatgaggccaatgttgttacatactggaacttgtaagggcattattttgttctctggctatacatgtaacattggcaaattgggttgcaaatttatgattttggttacttgggtgtctaaggaagagtctgaaaggtttttgaaagaggttataaatttctttcctttgaatcattcagttaccttcaccttaaaaacttttttactatttcttagaaaattattttagttgtattgaaaaacataagctgtttatgggcatcaatttttttttttgtatttttagtagagatggggtttcatcatcttagccaggatggtctcgatctcctgacttcgtgatctgcccgcctcagcctctcaaagtgctgggattacaggcatgagccaccgcgcctagctgggcatcactatttttttttaaaggcaagcattagcgtctttaggatatattgggcagtattgcatgtgtgtgtggatgatacatgtacatatgcatacattttacatacacgtgtatgtgtttatatgggagagaacattaattgtatgtctagagtcttaagattcaaaggcagttcaaagacagctagcaatagaacaaaaagatttccatatgagtaagtatatagtttgtataacagatgtgtggatttttttaatttttaattttaattttaatttttttagagacagggtctcactctgtcacccaggctggagtgcagtggtacgttcacaactcactagagccttgacctcctaggctcaagcagtcctcctacctcagcctcccgagtagctgcaatagatgtttttttaaaaagctatgaataaattgaactttgcaatatcataatttaaatgtaccagggaaatgtcactgtttcaagatagtatgaaatagcattggtgactgtggcctgtaagttatttttatggttcaaaagagttttgaaatttacttttcttagctgctggcaaacttctctacttatctaatcttctacatattcttgacatggaaaggtcaccctattatatatatgtatattttggagacaaagtctcactctgtcgccctggctagagcgcaatggcacaatctcagctcactgcaacctccgcctcctggcttcaaccaattcttgtgcctcagactcccgagttgccgggattacagatgtgtgccaccatgcctggctaattttttctatttttagtagagacagggtttccccatgttgcccaggccggtctcaaacgcctgagctcaggcagtccgaccacctcggcctcccaaagtgctattacaggtgtgagccaccatgcctggcctcgcctataatattgccctagtattgctgtctttttattcattctgtgcctcagcttccttcagtaaagcgaattagagccagttgtcttgtaggatttggtgatatatataattctctttatagcaaattccactgactagaaaattattttgcttagtatctgaaaaagacattgaattataagattacattttaaaaatatgcaacatactatatgagatatctatgcattacattggagatgtcagcctaaattttcaaatgctagttatcatttttaagctcttattcatttttgacattacagatttattattcctaaataaggttaaaattattaaattttttaattgcagtattggcttttagttattttgaagactgtgttgcattaaagtgtaacttgatatggaagagggactattgctacaaataattgaattagaaagaaaactggaaatgctttcctctctggtttttctttcctctcttttcttcactacagatttatttttaaagaccagttgcgttttccctgttccactttcgcgcatttcattccttcattactacagactatcttctgcccatactacctcttccctgatatcccaacaagatcactatatcctcttaatttccatattcagtgaacagtttccagtagttctctttcttggcctttcggaagcaacttatactactgactattgattcatttcttttctaaaattctatatgcttttggcttctggtcagacagttctttcatgttgtttctttttggccttcctttggcctcctctttctcttgaggaggaatgaaaactataagatgtaatcgcttggttgatattccacctaaatttgacacaactacagtagtcaccccttatctgaggttttgcttctgtggtttcagttgcccacagtcaaccagggtccaaaaataggttagttacagtataataagatattttgagagaggccacattcacttaacttttattacagtatttattattaatataattgttttattgtattattaattgttgttattcttttgcagtgcctaaattataaatcagaccttatcataggtgtatttgtatgggaaaaaacatagtatatgtaggattcggtactatctgtagtttcaggcatccactgggggccttggaacatatttcccatcgatagataagggagcgtgactataaccagaagttatatatataaagtagttttgttgtctttataaaaaaatcaattcctttaaaaagatttcatttactctcttgggttaggaaataatttttctttctaggcctattttctactattactttgacatgaatttgcattttctttccttttgagtagtttcagttagtttagaatttcaagtagtttgaattccaaggattcgtggaatatgtgaactgaaataactctgttaaggaaatttatgttggatctttaagtaaaatttagtgtaattcctaaaaaaagatctgtcattttatctaattgttagggatgattaaacttgttattttatatctttaacatatgtttcttttagcacagagcactttacttaaagtattgttcatcacttttcagtgtggaaatgcatctttttttcactcaaagctttgttttaagcattaagatgcttttttgagattttcttcaaatgtagaactttgaagtagctgagtactgtcacttttacttcacacacaggaattctttaaatggttctctacaaatgggcctcttttcttggccagaaaacttgtatttacctttattttaaagatggggataacaggaaatgctttatgaataagcattctacaataatcaacaaaacttgttcaaaccaaaaatagtgatctatttcccaaggagggtgagcttaataaatcagataactggagttgagaagggatagtggtgagtctgtttgtaaactttgggtttctgaatgttaattttaagcttcccttttaaaaggccagggtttgtagagcttatcctgtcagcaatatcctgtgtcaattgtcaggtcatgtttagcatgtggagatgtattaatctgccatagctagcattgtaagaggctgggataaagagagggctcaagcagatgaagagggattaactgtgtggattgagcaaactcctcaatcactgaaccagtgattttacaaaggattagctgctgcttttacaaatattgattactgatttgctactcagaatggagatgacataacttgtgcggttgctgtgtagtgcgctatgtgaagtgtacatcattcatattaatggatttgtcatagctattatagaaactgacagattgattatagcagcagttgctagagctgttatggttaaggttgtgtcagtatatctattaaaacttcaggattttagaagtttatagtatagccataaaattcatttccccaggtggaatttggaatactagttattacctggcacagttatttttatgcatatttttacatcagtttgaagacatttaagttgacatagagcaaaaatacattattgtgttatttttgtaatatcaacaaatttagattcatttcatttcggaaaatttgtcataaatgccagctttctaaacaagaacatgtctagttcatgtggacgtccaaaaatccgtttgtatttttcccagatcaggaattgttttgaagcctttggctatgtttctgtaagcacatggagatttttggaaaaggtagaaatatctgggtaattaaaagttaatggctattttattttcacttaggtaactttttattactctaaaaatttagtagcaagaattagaattatctatatcagagaaaatatgttcctttaatttttttaagaaatcatctgtcttgcaaatgttttctttatgtcacaacaggaaagcttttcagtgagttgagttgtatcttaaagggtaagctgaaagctttctaggcaatgatagtggtgaggagtgggtaagtggagaaaggtgagggaatagcacatttcaagcagagtgaaaacttgtgtgggtacatgagacttggactatttgaagaatagccaggtaggtgaacattctcaaagtagtaccttcatatatattgggaatattgttttcaaattgtatcattgtactataaaactatacttgtattgattaaattaaattttatagatgaatgggtggcatttttctggctatgattttaataatataaatcgacttaaattacttaaaagcctattttttgttttacagttttaaaaattgtattatataaaattttaaatgtatagtacatgcttataacgaagttgttccctctctgcaaaaggaaaaaaaaaattccctacactccctagaagtaagaactgctaacagttctatgtgcccttccagacttttttcctgagttttaagaatacatatatgtgctagaaaaaacatggaaccagatatttcttaaattttaaaaaatagtgtatcatgctggatgcagtggcttacgcccgtaatcccagcactttgggaggccgaggtgggtggatcatgaggtcaggagatcgagaccatcctggctaacacggtgaaaccctgtctctattaaaaatacaaaaaattagccaggcgtggtggcacgtgcctgtagtcccagctacttgggaagctgaagcaggagaatcacttgaacctgggaggcagaggttgcagtgagccaagattgcaccactgcactccagcctgggtgacagagcaagactccatctcaaaaaatggccatactggcatttttaaaaatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaaacagagatatagaccaatggaacagaacagagcgctcagaaataataccacacatctgcaaccgtctgatctttgacaaacctgacaaaaacaagaaatggggaaaggattccctatttaataaatggtgctgggaaaactggccagccatatgtagaaagctgaaactggatcccttccttacaccttgtacaaaaattaattcaagatggagtaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacagaatgggagaaaatttttgcaatctgctcatccgacaaagggctaatatccagaatttacaaagaactcaaattcacaagaaaaaaacaaccccatcaaaaagtgggtgaagggtatgaacagacacttctcaaaagaagacatttatgcagccagcacacacgtgaaaaaatgctcatcatcactggccatcagagaaatgcaaatcgaaaccacaatgagataccatctcacaccagttagaatggtgatcattaaaaagtcaggaaactacaggtgctggagaggatatggagaaataggaacacttttacactgttggtgggactgtaaactagttcaaccattgtggaagacagtgtggtgattcctcaaggatctagaactagaaataccatttgactcagccatcccattactgggtatatacccaaaggattataaatcatgctgctataaagacacatgcacgtgtatgtttattgcggcactactcacaatagcaaagacttggaaccaatgcaaatgtccatcgatgatagactggattaagaaaatgtggcacatatatataccatggaatactatgcagccataaaaaaggatgagttcatgtcctttgtagggacatggatgaagctggaaaccatcattctcagcaaactatcacaaggacaaaaaaccaaacaccacatgttctcactcataggtgagaattgaacaatgagaacacttggacacaggaaggggaacatcacacaccgggacctgttgtggggcgggaggaggtgggagggatagcattaggagatatacctaatgtaaatgatgagttaatgggtgcagcacaccagcatggcagatgtttacatatgtaacaaacctgcacgttgtgcacctgtacccgaacttaaagtataataaaaaaaattaacaaaaagtattaaaaaagtatatcactatatattagtataccacttgtgtttttcaaccaagtatcgtggacatctttctacattagtatatatctttccatattaatacacacagatctatagcattatttagaatggcttcataatgttcctcttgctgggcattttccatctttctgttgtcacaaatggtatatcagtgaatattctggcttatacaccatcatgtaacagcattttaatttgtagggtagattcttaggagttgaattatcagggtattgtcaaattttcatccacaaagctgtattaagctatactccccaaaacggggtgagtggagatgcgagtatctcttcttgccctcctccctgtttgatattcttaatctttgcagtttttgccagtcctataagttaaaaagtagtttttagtgaggtttattcatttgtttgttcattcagcaaatttaacaaacacttcctgtgtcccaggcactaatctaggccctagggatacagcagtgaagagaagacagttatggtctctgggctgttggaacttatattctaatggaggtggggagagctcaggaaacactacaaatcaataaacactcatctcttttcatgtttattaacctttgtacttattccataaattactgggttcatatcctttacctgtttttctattgacctgttcacttttttcttattaatttgtagttcattatctattgtgacatccatgcaaatgttttctcctataaatacaccttgaataagtcatcatttgacaagttaatgactgtaccagttcttatccatgtatggaattataacagtatacctgacttctttggttggtgagaaagaattggactaagtcttaaatttccatatttcagcatcctctgaggaattcttaaaaattatttttgtatttgtaaaagtacattagaaccatgagtcttgtgtgagacttgaagctatccaggtgaaggggacttaattgaattaatttaattgataacttgttatcaatattaaggtagataaaacatatttgtaaattttgtttttcagtgagaatgtacatcatggtctattcagacatgatttaattacagctgaattcttagagaaacatgtaataggatatcttattataagatcttaccatatctaaattgactaggaataacttgtgttatgccatttattcatatggaattttagcgggatgtgtatcttttggattttaagtctttttcatattttcaagaggtcattgtatatttcacatatttatgagcaaactacagattcagagttcagaccattttattgccctagcctcctctgaggtaacttccagtgccttacagggcaaatgagggagcactgaactgctcttgatgtgatgtttaagtgtggctgaacagcactggttgtttacatgaagttacatcagttgttgtgtgttgttagcaatcgttttgttctgctcaatattccatcagtttctttttcaaagtttaattttgacgtttctaatttgaactaaatcattaaaatttcttggtgaaattgttctggtaatgacaactcttagttgggagaaaaagagaccatgtacgattgggctatgtcagctctggcagatcctgcagtgagatagcccacacagtgaacatattaatgaattgccttttgatgtcttgcttatagtaaatatcagtttctatatttgtcagttgggtttttttttttttttcacatcttgaatactttttgtgtgtgtgtgtgtgtgtgtgacggagtctcactgtgttgcccagactggagttctgtggtgtgatcttggcttgctgcaacgtctgcctcctgtattcaagcaattctcccacctcagcctccagagtggctgggattgcaggtgtacgccaccacgccctgctaatttttgtattttcagtggagaaggggtttcaccatcttggctgggttggtctcaaactcttgacctcaagtgatccactcgcctcagcctcccaaagtgctggaatgacagacatgagccaccgtgcccggcttacttttttaaaaatatgctaaaatcacatagctaaataggcactttttatattatacgttctgtcccaattttcttcctttttattatgtttcttcatgttggtggttataaagtttagaactgaatgggagtgttagtaattgtgaaagtagatattaaggtgggatataaatataaggatgacctctttgttcttcatgtcttacggctatcttgcttctcattcttctgtctcctcattggtttcttgaatctctttattagtggggaattgcacctaatcatgagcttctcaaaggcaaggactgtagctgtacctcttgctccatcacagtgcctggcacatagtggatgctcggtaactgcctgatgaatgaaccaacacatgcaggcaactggctgctcagtactgctttttattatgacagcctctctttctctctcaagactactgtgaaaggtgtattaaatgtttacaaaattgttttaatgaccccaaaattaggtagttataaataaaaatcattagttgcactatcatttatattttggggattttccttctgttttcagtgtgtactgattgcagaactgtgttttatctgtatattgatttttttattttgcagtgaacgttagcttagaccatattttacaaatcctgtacacaaaacaaggtttttaaatataccattctgagccatatagatgattttgtttaaaattatacttctacatttgaaagaagtacccttggtgatttccatgtgcactcaaatttcagaacactgccttatgatccccttgctcaaattccagtgaaaaagacactcttgtgacacactattttagcctgatactgtaaataccacatgaatgtctatgtctgtctccctggccagtctcacaaatggctgtttacagttattcccctttgaaactaggtatcagaaaaaggattaagcatgtggtatgcttttatttccatagtaagaagaaaaactgctacacattaactgttctaatattgaaattgtagtatgaattctctagtaatttactcagttatatggataacaatgctttataatcctttcagttacccaggtgtacatatgattaccagttcatactgaagagtagactcaggcattttatcattctcagtaacatgttgttctgtggatatttggtggatacaaagtaggtatatgcttaaaatttcacaggctggaattgtcctggcactgagttagagctttataggccagttgctgatttgtttttgtgttaagatgatcttcatccaggtttatgtccctgcaaagtcattaaactttgtaaattgataaataagtgtattaattttacccccagcctggctgcttgttaaaggatatggctcttgacttaagcagcaacataaaaagagttgtgttaccttcttgcagagaatggagtttttcttgagatttaatatttaccagaagtctgatcaaggcaaacaggattttggaatgattgtctgaaaattgtgcagggtgtctgttcctatagatactctatgatcttatccttgagtttaacaaagcttttgggagttagctgtatacttgggcctcctcgttttgtattctgtagaattgcttttactgaatttcactttggcattaagcttttggctcaatatgaatgatgttatacaaaacagccctatgaaacttttattttatatactgtaaaaatgttattgaggacattgagaaccatgggagaaatttctttcccatttcagtaccaggagccagaaatagttgtgttttcttccctgaacaatgatatgtatttatcttatgggcaatggctcatataatttattgtatttcttgcttcatgttggttgttataaagcttataagtgaatttttggcccactcctcacaagtgtaaatgactttgtagttccaagttgtcttctgttccaccctgacttctaattttgccttgattttaaaaaatattgaaatagtgacacagaaaagttgcgagaataacacaaagagttcccatatacctttcaccccaattctcctaacattaacatttttctatacaggtatttgctttgtcactctgcctcctccctttccttacccttcctttcttctccatcttccatcctccccctccctcccaccctgtgtgtatacacactgatagctcctgtttgcttttaatttgcctctccaaatgtatctgtacaaatgcctgggaaatgctttttggggggagaaggaggcagtatattactaaattaacaataataatagataagaatgtatgaatttcatatctatattgaaaaaagagttatggaaaaacctcttgttttaggtggaaggaaaacaaatggtgtgtgtgtctgtaagagagaggggagaaagattgcatacacatgtgtttttaggaagatgcttataatactttaaaccagagtaggtactttgaatgacagaagagggaaaatgccaagacttcttgatttaaataaaaaattagatagtttccttcttaaatagaaacaggtatactatttacctatgaagactaaagcattaagaatgtttgggaacgtatttgcgttagtaatcaagctcaatttagtaatcaaataatcagagtaggactgtgaaatagagtgagagccttaattcagcaatttaccttctgttaataagttagtcataaaataatttcatgtctgatagttttcaaactacacatttgtcacttatttttcttgtttatttattcatattaaccacccctcaataataaggttgttttgggagatgggaatagaatgacaactgtttatgtacctgttatttttcttaagacaaaaacaaaaacgtgttttattatactgtacaatgtagaagacattataactctgcatattcctatttcagatacttaagatataatcttatgttattaatgactctaaactttttgtatacagaataggaaaaataaattaataaaaatgagtttaaagaatatcacaaattataaaaatgttacttataatctgaaaataattttaaaaatttatacctcaaaatccacaacataaagctgttgcaaaagtaagtaaatcaatgaaagaattgtcctatggcctatgtaaagataaagcatagttgagtggaaagaagctaaagaattcaatctaaattatattcatttcttatttctatgcagtttgctagaggaatctgcatacaaaaggaacctccttttccttccataaacatcattttccccattactaatttgttccatgtttgtgtatatgtgtttttaaaccaaaatggaagtatttcaaatacattcttaagaagcaaaattgacccaaaatcttacagatgaaacaacaccccacaatttaaatgtatggtatattggccgtgtgcagtggctcacacctataatcctagcactttgggaggccaaggtgggtggatcagctgaggtcaggagtttgagaccagcctggccaacatggtgaaaccccatctctactacagatacaaaaattagttgggcatggtagcgcatgcctgtaatcccagctacttgggagactgagacagggaaatcgttgaacctggtggttggaggttgcagcgagccaagatcacgccactgcactccatcctgggtgaaagagcaagactccatctcaaaaaaaaaaaaaaaagtatggtatattaggtatatctattaggtatattaggtatatggtatatatggtatattaaaatatatcatgttacacttagggaactaaccttaaataatggtaattgctttaatgccatagaaaagtaattcagtgatgttgtctgacacggtttctatagatggcattcatttattccatcagcagtggaacatagcatttcagaaaatgggcttctgggcaagtagacttaaggtccttgctccacttattgtgtgttatcttgatttctgattggtaatatagagttagtaatacttaacctcttagggttatgtgatgatgacatgagatgatgactggtgtcatcatctttacctaactcatggtaaaggctcaataaatgttaactgttgcagtgctgttatttgtaatcatgccactgatagtgcttaaaaaacatatttaagcttatagtatggagataatagaaacagttgtgtttgatacagagatagcataggtaaggaagaaagaagtaggacctattattattattattattattattattattattattattgttattatttgagacagggtctcactctgtcacccaggctggagtgcagtggcactatcatatgcagccttgaactcctggactcaaactatcctcctgccttctgagtagctaggactacaggtgtgagttaccatgcctgggtaattaatacattttttatagagatggggtgttgctgtgttacctaggctgtctcgaacacctggcctcaagtgatccttctgcctcagcctcccaaagtgctagaattacaggtgtgaatcactacccccagccgaggacctattattgttattgtttaaattttatacataattgtttgacttttaagatgccttcaacaaattttcagtgaagttgagtttatgtttcctagttttctattttgggtaatatttagaaaagagcctggcgcataatatagactagtaaaatattgtttaatatatgagttaagaacgttccttttcatttatgctaatctttattatgtataatcttgtcaaatatgtgtttatgcatcagatttgtttttggccaaatatctgtaaccagaaagaaagtcgtatggttaaaaggtgtttaacattcatgtttttattctagtggtttatattttcagcctcctttttttgtatgtgtatggaacaatggacttgtggcaaatttgagttgccttttaaaaatactagtagtaataagagacaacatttcttaaagagttatcttaagtgctatcctactacatccccaccatagctctccatagtatgccctcctattatctacattgaaagatttgaaaactaaagcttaatgaaatcaagtgacttgctaagtcacagagctggtagctatcctgcaatctgaatgtaaatccagggttttgaacgtgattctaaaatgcagtatcagtttgggggcacttttgttgtggaaagagatgcattaaattaaaacccagttcataattgtatatatttaattttataatatttagagtctgaacattttgatatatttagaattatatttttaacttaaggagaatgtattccattttaagcttgcatctcattttctcaaagtatgtattatagactttttaaaaaggctattatttttcagaatttaatgttttacttgctacagagcagatgactaagatataggcagataaagagttgctgaggagttactttatgtggcaggcaaaatttgatttaaattttttatgtggaatctaaagatccctttactaaaatagaaaaacacagagggtgccctatattataaatatataaactagtagtcttgtctctaaagtaaaaccttacttttaaatgattgattcagtatattgatatgctatcttccccggaaataattgagagattcttataaggttttccacaaattaataactctagaatttttagataaaaaccatattttaaaattctataaggaacaagtttaatatattttaacaatgtgataactagtggtttattgttagaccaacgaatcagaaatcttaaagagatttttttcacatctacttttatgagaaagggacagcagttctatattaaagatttatctaaagaagcagtcttcagatatgtaataagatagttcagtttctggtcgtatacttaaatgtatgttaaagtaaaagaagcagttttaaatgagtggagaaggataattggactccgtgtcatataattcacatatactattcatctgtgactttttgagcattattttaatggatgttggtgaacacaattgatttcagatttcattattctggaatcttgccattagaatttttcatagtttggtagatttctatggaaattagtagcagcaagaaagaaaggaaggaagaaaaaaagggaaaggagaggagaagagaggagagggaggagaaaggggagcggaggggagggaagagggggaaaaggaaggtgagaagaagagaagggaggagcaggagaggagaggaggaaggaagagatgtaaaatagaagcttttgattggactctgaacaaatgcttaatcttttggattatattcatgagcatatcttacatgcatgtagctatgatattaatagttactgtcttcttttgttctaaatagacctattgaaggcatagtgaaaatttccaccctaactcctttagagttaataaaggcaaatttgaattatcctcatggttattccgtttttgcttggtagccttcaaaatggccactttacagaggagggaggagattagcagatgttaaacccttgagttgtaacctctgctttttccccagtgtagtcacataggctgctatatcagtttttaaagccttttccccaaagcataaccctcctgagaattctatggttctactaattgaaagttgaccatctttatgtcaaagcatggtgtgagcttttttgtttttgtttttcttaaaagaaatatcataataggcttagagatcgccagtactagtatattcattggtgaatctcttctgaagaaagtaatagtgctacgatgagaaaacaagctttttgaaaagactatgctaaagtaacacaattagtcctcttttagagttacggcagtgattattgtttgaggtgcctgttgaatatataatatcttccttttgctactaaaaatactgataaacagatttgaaattccaaatttcccacatggagggaagaattattcaaatatgaaaaatatttaatttatgtatttatttctctcatacatattccaggccaaggttctagctgaatattaaaccttttaaatgacataaaatagttctatgctagatgtaaaagaagttactagttgttctacaaaaaatatgttgtgagcaatttccacatttgatataattgaaacttcaatctaatcttggaccttggccatttgctactgaaagtacaagaaaaatagtagtgtggatatatttcatgaagtcctggaattaggagggctttggagatgattgaacctatttttttcaggttttaaaagaagaaattgagtccagagaggctcagtgacatgtttaaggtaaaaaaaaaaaaaaaaaaaggtatggaactgagatcacattacagacttctttaacctgtgccatggatttcgaagtcagtatcaatgtacagctaagcttctggatatgtgccacaccactaaaatattttatttaatatttatatccaagttaagtgtaggtttctctcctttgttggtgcatagtcttattttgttttggttctttgtttactttgcagatatgctagtgaatttttatacttaaaacctattagaataagaaacaaagtgtctgcatccctgcatctttgtatctattacataatttctagaaacagggaaaatagcttctaagtttatgtgtgcaattataaagtaaagtgtaattaaactgcacttgtggaatgatgagttctgagtcagtcacagctctgggaacagaggctttttaatggactatttcctaaagctaagtactaaatgtacccttcaaccaaaaatgtcactaagatagtggacctcaactggaaggatagtggaagcaaaacagaaagcatttctccacctttatacaaaattacagtgcattgggattatatcggtattatgacatactggcacctgaaaatgtatgttcattctgtttatcacttcttaagaaaaatgaactagaactggagaagctaatctagataataaaataaccactagtggataggtgagagtatcaccttcatgaaatgagataatatttttggagaatcaaagcctaatatatgtttcaaatataaagcaatcattaagtgggtaaatactttttttaaaaaatgggtctattatccaggcatggtggctcatgcctataataccagcactttgggaggccaaggcaggcagatcacttgatcccagtaatttgagatcagcctgggcaacatggcgaaaccttgcctctacagaacatacaaaaattagccaggcatggtgttgtgtacctataatcccagctactcaggaggctgaggtgggaggatcgcttgagcccagaaggcagaggctgcagtaacaaaatcatgccactgcactccagcctgggctgcatttttggtagtttactacatgagtttagaagagataaaacgaagctctatctccccccaggaggtggccaatttatggaactcagtatcccaactattaggtgaaaatgaataattttaaaaggtttagataaacttgtagatgctttatttatttgaattgtcaggaaaaaagatatggttgtatggttgagaagtttattctttactttttggagttcagggaaaactcacatcatgtggtgacacagaatatttgactaaatggaccaacatcttgactcagagtgaaaattcttaggaataacaacagtcttttaaaaagtatctttcctttcttttccaatataagggaaaaggaaactttagtcgggtaggtggtaggaaaaattaccctatgtgaaagcttggtgttcatgttgaaaactatataaatgccaactagaaaagggaaaattgaagggggcaaaaggtgaagctcagaaacctagtcgtaattttgcataaagtctagattaaacaaccaaaaaagtgtgaacatattagtgtaatgaagccaataatatgatgaattattgatgataaaatagtaaaaataaggctttggattccttagaagtctagcatttaaattgatcaccaaagttgcatatcaaaaaataaaaatgataataaaaacatgtctattttgaaaatgtctctgagtcattgcactttggtaatgatgtcttatattgtcttagaaaaattaatgcatttaaagaggtatcagactgggatatagtgtgtgtgtgtgtttgtgtgtgtgtgtgtatgtgtaacatgtatcagggaggagtctattaggagacacatcaatgttagggaagaccctggaatatagtgtattgaggcacccaatactggacaaaattgtgaatcaacatttgttcatttagatttgagaaatctaaataaaaaagaaaggaccattagatctcccattctcctcaactctagctctttctctctctcccccaactctaactctctctcacccccattcccttgcctactcaagggacttgcgtgctgttctaggccttgtcttctgagtgaagcttctgtgatctagacacatttttctacttttctttgtcctaaatacagtaatgcaattgtctaccctgttaatgccaagactgggtttagacctgaccaacctaacacctgaaatgtcactaagtgatacttcctaccacagacttcatatttttctctgaaattgaagtaactactatttttcattttgaaataattatttttaattgttaacactttttaaaagataaaacttatttcttaagtatattacaggcatttaaacattccagtgtttttcatcctagattcaagaaaaaaaaagataaagtaatagtttaataaaatcaccaggagtgggtaataccttagttttaaggtaatttgttatcaatttgtatactttgtatctcttctctgcttttgaaattctagtatccatacttgaagcttgctgtactatgtctacaatatacaccatttgtttttaaagcaaaagctttaaggcacattctagaattcttgagttatcttttagaatcagttaccttatgaataaaatatcaacctaactatagggaaatttggatttcactattgcctttttccctgaattgctgggaatataggcacttgatacttgtttatttgaattcattgtgaccttgttaccattttgaatgcttcagattctcaaattgcatgctggaagaagacccattccttgcttagttgtccttgtagggtgtcgattttaatgtctaatattttgagctgctttagaaaagtaggtttatcatataagaaatacgtactcattttataaaaagaaaactagtctttctcagtatataccttactttttcgggcactgaaagtttgtggccacttaagcaagcccatataataaattcctgtagcatagtctagtccctaacatatgggttaatttttgttctccccttaggatatacttttttcattaaccactttcatttaagtaaagggaaatcttttaactgctttagaagtagctacaatgcttaacttgtatagttgctgaatcatgctttttcctgtatttcatttctgattaactttctctgagcaacatagtcttacgtttacattagcatccattcacttgaactagtagttacagttatagtaacatataacaatatttaactgtaataggtaatgaaagctaacgtttactgaatgcctactatgtgcaaaggactaagacccagtgcaaaacttttttttaggacaaggtttgaattttaatagtgaagctgagaatgtgattgtgaattcaccagaatgttgtataattgactgttccatagtgagataacgtaattgcggtgtatggcaaacatgtggcagctctttgttgttgcctggcagataggcttacattagccttaatttccttttcttcatgtatcattatgcatgtatttttatagtcttgtttctttgtaccaatctaaatcttcctaaatgtcaatagcgttaatcgttgtaggtatagtgatatgaggtctaaatgatatgagaattcatatttttttaaaaggaaattactacttttttatatattataacagattttccatccctgccatcagaaagtattgtccatatgctcatgatgatatacaaaccaaatggttcttctgaaaatttaaaaatctaaagtgtttacagggattgctattagtgtacttttgtgttttaaagaattcatatggctattaagcaaatcctggatattggacaaacagcaataaaggtttagaaaaatgaaatttcagttaaaaaaaatgtactcccccactccccagggaagaaatcaaagattttatattagaaacatgaatttagaattcagaacaagtattgcttatgacatcaaattttattgtgatgtatcaggtggaaatttagtcaacacttttcttaaagcaaaagactcaggctatgtgtatattgaacgctagtaaattctaatttcccttctccttttccttttcccccacttcctctcccctctcccttcttcccatctctctctgtctcctttttgaccagtaacattttagagttgaaagctatgctaaaggtacccatttcttttcagaataatttaacttttcttaagattttgtgagcatccattccttatgtaaagagcatttattatgcccaatggaagtgagagggttgtgggactaccccttaatgagaccagatcattccacaattatccactttagattagtggttcaccaggacttgtttacagagataagatttctgtttgtaatttttgttttatgtacaaaatcctataataaataatttatacctttatatgtaccaagtttattttgaaaaaaactggatacatttattgaacagctattaaaatatgtacactgactttccctaaaatttcatatacatttcaaaatcagggctctattttaaatatgttttaatgatactgtgtggtgtttactgggtgaagttgatccaccaaggagctgaaattagtgctctaattttaagctttatttcttaagaaaaaatatccatgactttatcactactgtgatccccatggtattaaaaaaaaaaactggtaaaattaggtgatgagtttgtaaataataaacttcctatcaaacccattcttttttttaatttttaatttttgtgggtacacaataggcaaatttatgggcatattgtatgttttgatacaggcatacaatgcatgataatcacatcaggataaatgaggtatccatcacctcaaccatttattctttctctgttacaaagaatccaattatatttgtttagttatttcattttattaatttatttatttatttatttatttatttatttatttatttagagacagggtctcactctattacccaggctggagcgcagtggcacaatcatggctcactgcagccttgacctcttgggggatcctcccacctcagacccccttccccccacctctaccctcctcctccactggctgggactgcaggcgcgtataccactacacccagttatttttaaatttttcgtagagatgggggtctcactgtgttacccaagctggtgtcaaactcctgggctcaagcgaccctccttccttagcctcccaaagtgctgggattgtaggcatgagccattgcacccggccacttagttatttttaaatgtacaataaattattgttgactatagtcactctgttgtgctatcaaatactagatcttattcattctaattacatgtttgtactcaaacacattttctatcctaagttgtactgaaactatttccactggatgtattccatacaaactttcttttgattggttgttttcacttgctagagttctagtaaaatgctgaggataactattatatttcttttcttttctgttttcgtttttttctcttttttttcccaggctggattgcaatggcgtgatcttggctcactgcaacctctgcctcctgggttcgagtgattctcctgcgtcagctcccaagtagctgggattacaggcacccgccaccatgcctggctaatttcttttgtagttttagtagagaccaggtttcactgtgttggccaggctggtctcgaactcctgtcctcaagtgatccacccgcctcggcctccaaaagtgctgggattacaagcgtgagccactgcgcccggcagataactattatatttctaatgaagtttataaaaatattgaacacttgtaaaattgagtaacctataatccatgaccgtgaatatacaatttctaatcaacttaacttttgcttgatttaaaaactttttttagggatccagtatttgtttataatagttttatcagatctgtctagttttagactcttaaatgccctataaaaacctaaagcatactcactcagtggaatgtccataacatttctctgaatacaaacacagagaatatttgctgtgggctcagagaaacaagtttcagcatttgattcggaaaagcattttatgttttacttggtaggaatagggattatgcaggaaagagtcaatatgtattgaaatttttaaagagttaattcaatataaatataacgaagctatgatttatttgaaattcttaacctctctttcagggatttattgcatttatttataatagtttctcagtcctgtattttgggaggctataataacatataggagtacagaacttttttttttttttttttttttttacttttgagacttttaggaggaatagaggggattaatctagggaatggatctgaaacaaagctaatagacttagatttaaacaatttcagtaattaaaagcacactgaatctaatgagatctggcacttgtttattctgaaatggattacccactgcttttttttttctctccccaacttctcataggagcccagtttcctccaattgcagcacaagaccttccttttgttctaaaggctggctaccttgaaaaacgcagaaaaggtaaactgaaggttctaatgaaaaatgtaaaaataatttcatccttagatagaacatgtttgtagtatacatgtggaggcagtattcgttttaggtgattaaagagtttaaagattgtaagaaaatctggatgacattatccaaaccacaaaatatagctcttagctttaaataatttttaataagaaaacattaggttaggtttttagttgtcaaccttggttatttgtaaatgattcaggagctgtttcctgcctctcaaaggaaagctgcaggccatgactgtattctcaaaggtgggatttctcaccagtatctcaatgggctgagcagcaggttctcctatgcccaaactggcatgcaccatggttcagatcaagcctggagttttgtctgccattgtctattattcatttcagtgttcctctccattggctatgataattgggagttgaccatatggtctcactctttcaacaccaatatttaatggaaatgaaatatggaggtggttttataatatgagaaatgaaaagcagacagtcttttcattaccattctgcttatctctcttgtagtccctttaggcctttctatttatatttcattttgcttttcttagctttcttagctgaattttaaaactgaaagagataacagaaataatctaggttagctcctccccttctttttataacagatgagaaaatgagacccagatggatcaattatctcaagactgtatagtcagatacctttttgactgtccctgtcagaaaactttgttagccatgctgttgatcccataagtatggcagccccatagctactttactttattccctttagctgtgttggtttgttgttgtttggttttttgtctcttggaaaagaagatacaaattagtcacacaatgttagagctcagaggaatcttagaaatcatattaattaactttttcttttacagtaaggaaatggccttacattttcccctctttattgcagatcacagctttctgggatttgaatggcagaaacggtggtgtgctctcagtaaaacggtattctattattatggaagtgataaaggtaatgttggtgttcaattatatcaactactattgcaaaagaatttttggccatcccttccccctcttttgagtacagagtaaactgaagacaaactaataataactgagaattataacaattataatctgactaatttatgattcatttcattatttgacaaatgctccaaataccagaataccctcagagctaaaacaattgtgttgtattgaattagaaaagagagtaaaataactttaatctgtgtggcctttcaccttagggaatatttattatccagcctactgttgtagaatttctggaaaagttaagaacatagggttgtgagagtttcaatggcagaaaatagattatttttcttaaatattttaaaataaaattagataaaattaaatacgaacagcacctttctgagctccctttacagatttaaggaataacagcaaacgtgtacatagaatttactatatactgggcaccgttctaagcactttgtctaagtacgttagctatgttaacttgtttagctcacaacaactctgtaagtactattattagcaccattaatttgacttttaggaaaactgagaacagagaggttaagtgacttgttcaaggtcacagagttggaaaatggcagatctaggaatttgtttttcctttgtttttagaaacagggtcttgtctcggtgcctaggctggagagctgtgactgttcacaggtgtagtcatcacaccctgcagcctcaaactcctgggctcaagtgatcttcctgtctcagtctcccaggtagctgggattacaggtgcacaccgctgtacccagctcaaatttgggattttaacctagagaatatggttagagtccatgttctcaaccactattgtcactacattaatttagaaataataggatacattttataacttcattgttaattaataaatctctcagttgtagttcacataattttaagattgttatttgaacaaataaagccaccaaataatgaaatttaaagattgtaagctttctgagttttgttttattctggggaaaacaggctaggagttgaatattataaagtaaaggttgtatcaaaatagataatgttcatttccagaaaggacactttaagaagaaaaaggcaaaagtatcactgaatgtaagctttcctatggaattgttatcagtgttgtttggaaatttatgttttatttgacattatttatagtttttagagttttttcccccattctaaaaacatacaggtaagattgtcatatttcagataagtctgaaatacttacataatgctggaagttgttcttaccttttggctaatgagattaacaaattaattaatttagtagctagtttgcattccatcactaatttacagtatgttcagatgtagtaatggcatcagtgaagtgtaaactgtaaacagctataaacaagcatctttcttctgctaagggtcagtagtgaagtaggtcagaaaatttagagtccaagttcagttacgattatcacagatcatagaaatatagttttgtatgatattgtgaatttagatcgagatactaccttccacaaaatatcctctttttcaccagaccaggggagggaggtttcagatccttgtgactttgattcaattaggcttctcatttctaatttctttaagaatcaatgaatactaatgtcagtgtttcctccatttctagtcctgactggcatataacaatggttaggtcaaagattagcaagagtttccccaaaacccaaagcgtgttaatatttacttcaaacactaatatattcaatgaaaacattttagttagagttatttagatattagttacattcctttttttttttttctttttagagatgcgggggcctcactctgtcacccaagctggagtgcagtggtgccatcatagcttactgcaatcttgaattcctgagttcatttttattcttatttgatgagacctaatggtagtaacattgtttgtaatttgcattttaactactttgtgatccatttagccctttctgtcatttctgttactggaagggggtcttgatccagaccccaggagagggttcttggatctcatgcaagaaagaatttgaggccaatccgtagagggaagtgaaagcaagtttattaagaaagtaaagaaacaaaagaatcactactccataggcaaagcagagcataggctgctcagctgcttacacttattgttacttcttgattatatgctaaacaggcagtggattattcatgagttttcctgaactggggttggcaattctcagaactgagggtttctccccctttttaagccatatagggtaacttcctgatgttgccatggcatttgtaaactatcatggcactggtaggagtgtcttttagcatgctaatgcgttataattagcatataatgagcagtgaggaaaaccaaaggtcattttcatcaccatcttgattttggtgggttttggccagttgctttcctgcatccttttatcagcaaggtctttgtgatctgtaccttgtgccaacctcctatctcatcatgtgactaagaatgcctaacctcctgggaatgcagcccccataggtcaaagccttattttactcagcccctattcaagacggagttgctctggtttaaaagcctctgacacttccactttaaaaaaattaccattttagcattcctttttcatgttgatgtctgaagatgtggcttgtgtttccttaaatttttcccttttactttgcagcctcctgtttccagtgaaattttagatttgtttcttgtggttcttttttctattggcggtttcattcgaaatttttagccagttcctctcttttaagggactccaaaaaaagatctgtctttagacagtttttaattacttgtttggcatgatcccgatttccttcctttatatctttttcttaccaggaaaatatgtcaaataatttttttcttttgtgaaattagatatgattttttatagccttgtttactgtatgtgtgaaccatttacctaatgggaagaactcatatctagctatatgagaactataatcctccaactaagtaggatttagataaatggattatagaggcacagaaggagttgacaccacttactaggttaaactgtgctttgttactgtttgacagatacatagttcacattttctaccatattgcgtgtgccaaaaaacatattgacctatcaagataggagtggcttagaaagagtagttccaacctgttgggtaaataatgcacttaccattgtaccaataaatattgtctgtatttattatttatagccatttgggacccttaagtaacaaatacatatagtatgtattttaacaccttatgaaatcttattcatcctttcatatccttccttttcctttgattgtcgtgagtcttattcatcaaaattcttaggtcctagatgttcagatgtccttcaagtcattcattcattcattcacttactcattctttttctaaatttgataaatattttttcaggcacttgttagctagtaggcactgaggatccaaagatccttagaggtgctcacagtttgggttttgtggatatcagtgagagagggaaggatgctgtggggttggaggagggagctgggcaggtaaactgaccatttcaatgcagtacagtaagtaatttaaataaggtatctttggatcacaaaggagggaaactaattgcctagggaagttagggaagatgtcctggtggagagaacacttcattgggcctgaaagaatgagtaggagtttgttggttgaatgctatggtgtgaatgtatgtgtacctccaaaattcatatgttggaaattaactcccaaggatattgtattaagagctggggcttttgggaggtgattaaggcatgagggctttaccctcaagaatgggatatgtctctataaaaaaggctagagagagctgtggaacccctctcttgcctttccgccatgtgacggtacagcattcaactcttctgggggatgcagcaacaaggtggcatcttgaagcagagagcagccctcactaggcactgaccctgctggtgccttgatcttggacttcccagctcccagaactgtgagaaataaatttctattgtttataaatttcccagttttgggtattatagcagcataaacagactaagacagggaagaagggtaaaatgggctttccaggtaagggaatagcagagattctgagttgtgaaagactgtggatgggatcaaaaatggaatgaaggctggagcttagaatgagtgaggggagggagcacgtaaggctaaataagtggattagaccaggttggtaagaaccttctgagaataagggccttgctaaagattttattttgaatatgacctttaagcagaggattgtatgaccagatttggtttttaggaagtaattgtaataggatgatggagaatggattgggatggatagagtctgggtcaacaggaccatttagcaggacttcgaagtagtctaaacaagagaggtcaacacagggctgttgagaggcagagcgaggatttaatgcagatctctctgcctccaaagttatgctttttctacaacttgatgattattaccaacccctccaaggtgcccataagtggtggaccatttaggaacctgttctaaactattgtgtgttttttcccttttttctgtttatcttctatatgatcttgaatcaacattatgatatgaacctagtctctccccatttttaaggaggggattgtcagttcttagtacctcctctcagggcttttgctgaaacctgattaaagaatacactagcaccgtctagtaaatgggagctacaagtagccctgatctacaaagtcattcaaaggttatttcttacatcatatggttttaattttttcattgtaatatcttttcaatatataataaaagtccgtagaaaattgggcttaatatggagaatttaagataacaaaatttcagaacttggcagagaaataaaatttttcattgaaatttacctccctgctctccccttctccacaacttcaccgttgataggaaaaaaagaggacatatatgttctctttgaagtttgaaaattataaaatatattttgatgttgaaaaagcatcatatttctcttttaatattgttttgaatatgttaaagtgacagtacttatatttgtataattaaaagttctgttgttttgtaacaacaacttaatagaaagccataaaagcttaccttttttcttctgattcatttgacagaaacaaattctgtcattttataattgtaattatataattttataattatatcaagatgatatatattaaatgtgtaagtgaattctgatatttaaaaaatttaaattgcaattctgtttccatctggtatgtgaaggatatctttattccttaagaaataggaaccattaattctacttttatcagaaattattacaattttatagacttttgggtctttgatatgaaagtattaactttaaaacttatcacaataaacttttttttttttttgagacggggtctcgctctgttgcccaggccagagtgcagtggcatgatctcagcacactgcaacctccgcctcccgggttcaagcgattcttctgcctcagcctcctgagtagctgggattacaaacattaaattaaagctatgcctttattttctgcctttatggctaagagactctctaacagtatatagaagttaaaatgtacatctgatgtttagtaggatttcatcaacatgcagaaatagtcaggtacaaaccaagttttactaagggtctgatgaccacgaatgttgttggtttgatatctagtctcacttctacacaaaaccccagagatatatttcaagtggctgatttagcattggcatctgcaagctgtataaaccaaaggagaatgttcatatatctttaactgaggagctggaacatcttgctagtcagtttgataaaatttagtggcaaggtctagtattgatgggcatatttttcttttccctactaatgagtactaatacttgtggaaataacgtaagttattcactgaagggaaaaggccttcttaaatataagtagtagatattgctgaacacatttcatatttttgtttgctagccatttgtgccaagttagtgttcttggtataagcatcggaaaccaactttgtttatgcagaaagggaaattattaggaaaatatcagctctcagaattgctaagaatgctacacacaggctcagcaagcaagcaagaactaaggtaggtaagggggctggatcttgagcataatccatgaaaaatcttattgggacacactgctggcttgggccttgccaagccaggacatgtgatgttgccactgtgcactgccatcaatcagtgagtgccattgccaccagaatggattctgaaccctctcttgatccttttgttacttactggagatttaggttccagtctggagcatccactttgattaagttggaacagggaaaatccatctctctccagcttctgtgatggaaaactaagccctatccctgacaatcttggaattaaaataggaaagatgcatggatgctggggagccccaaataataaatgtccataacttgtagggatgctaaaggatttggaattatttggttgcaatatttatgctgtatttaaaatggtatgagagtggttggtgttttaagcatatttttctgagagccaatgaagaagagaaaaaacaagtatatttgccagaaaaatagaaggtctgtttagattttggtaggtggcattggagtgtagggggtaacgtcggggcagttggtgaaggtaagggcaaaataaaaaatggtgcccagttttctggtttgggagcttgaattaatggaggtgccatttattgagatgggggatacaacaagaaatatcacagttgttggcatcacaagtgttgggagtggggataagatgatctccattgtgggcactttctattcaatgagcctataggacatttgagaaatgaaacatatttagtgagcagatgaagatttggataaacagttttgaaaatgaactaaaagtagagaatcatgagtcacaagtatattgataggaatttaattcttggaattagatgagattgcccagggagagtgtaatgtaagaagagagcaagacttagaacaacgcatcatagctttttaagagataggcagaggtagaggaacccataaagaaagctgagaaagtttgacctaagttgtaggacgaaatgcaaaataacatttatcttctctaccgtgattttgtatatttcacattgtattgaggacagtggttgtagtgtgtatcaaaatcacctggggtgcttgctaaaaatttggtttcctagactcacccacagagattcctatatagcaagtgcagagtggtagccaattctgtgttaacaggcgtccaagttgattctaacataggtgattcttaaaatatactttgagaaacacctttttagaaaacagtgtgaaatggctgaaaaagcaaggctttagaaccagactttcctagggtcctggcttttactgtttactatttgtgtgaccgtgagcaaattggttaaagtttgttttcccatcagtgctgggaatataatatgtctcctctattgcttagaattattaccaggtgtatatgagatatgttctattaagttcttgacatgtagaagctcagtaaatgtgagttgtctttttgacagcttaaaaaacccccagaacacagctgtaaacctaaaagccagtgaaaaagtagaaggaaattgctcttattagccttatgcattttgttttgtaggaaatcagagccaactgctttttaccttgaacctgctgaattaggattgtgtaaaattaagttactgatataatagatttcattatctagtttttcctggcagccttcagttctgtagacattacattcaaacagcatgatagaggttaggttaaagtgtgaaacagaagctgagagaaatgtaatagaggaacaaacacctcaaaaattctgaaggcatcaatgtgttataaaaactaatactcaaaatgatactatgttaagaaaaaaatgttatgtttaaaagatttgtttgagaagttaggcaagtatatattttagaaagctttccatcacaatgattaacatttttaaaagttttggcacttaaaggaataagcttttgctatttgtgaagttcacctagataaaatattagtctttcacagtgctgggtaaatggactttatagctttatttcctatttgattggcattttactatttttgataattttgttaacaggtatccttgaaactatcccaaaaagcaattgtggaactaatctatatgtaaattcttatgacttaccacataatggtgaagtttctctctccagaagagaaactaatgtgaaaggaggagaacagtgttgtcttatagccatgtctgcccatttcacgtcttgaacttcctgtcctgtattggctaattggagatatggctacttcatggttatggttctgcaaaagctattagaaagagttgtgagtttcctctgttcaacctttctgggcccatatccctacccgacttggatgtttatataattgtttatcctcaaatacaaacaatcagttggataggtctagatattagtttctttttattatttttacttggttaaacaacagcacattttgttctgcaaagttaggtctttctttgatggaatgaagttttcttttgctatattatgtctttggttattggcatttatttattactcttcttccagaaaacccatttttcttatgttgtatttttgtcagccctccatatttatcatactcccttttgtcccttccccatccccttattcttattttctatctgctgagtgagcttttcaaggtatatctgatctgattttccacaatgttagttctactttttatcacttctaatacatcatttgttttgctgctgcattttccacttccttatacagcatatttgttccttattttgccagtttcattttaatttctacttgtctcagcctttcctctttttattttatattacattgtttcatctttcatctctttcagaatctgtttacttttataaaatatgcaaagcagttggctaaagtttaccttcatttctcctacttcgcttgtgctttctacttctcaagtgctatgttatgtttctgttttacataatatttttatggcatctgtatttgctgttcctcttttcttatcctcgaacaagtacatgtctatgaaatctgagatgcttacctataaattggatttgtggcttctctctggttcatctcagtagaggctgatactgtcctcctcttggactgtatcagaagttctgatacatagccccatagcatatttctagggggtttggctaaaatgaatctgctagtctgagttggggttgcctaattttgctgcctaattgtcttatttctagattattagataatctggcccagaaagatctgttcccctcagctcttccaaactaaatctttatagtgctgattttatatctccaggtgtagactcccactcctcatgcatttccacctgcattcaagttacattgatgagaattttagaccgaaattggaggtagaaggcataggttttaggtcagatggacctggtgagtggagcgattgaacccttgcgcagcaagggagcagctttcctctaaatctggtccctgaaatttctctttcttctggagagtttaaggaactctctcaaaattgtccaatatggctttgatattttgcctcacattacttccacttttcgtagtgaacattaagttccttttgcaatttagtagatcattgggaaggtggcgcgaaagatctgataaggtgttctagcttttatctcggcaaacctataatgctgcgtgctggttttaagtgcttggtatcaatttgtcaaatgagtgagtgaatgatttagtctttttttgagaatttacaagaaccaaccatgcttaaccatttatcattttaatacttttttcccaatagtttcctagttaggtgtcttacgaaatatatcctgggagtaccataaaatattctgtgaaaaatgattccgcggacaaataatttttggaaatgctgcatactaaatttttcttatagaagtttaattactatgtaaatgtactaagggctccaagaaggcctgaactaacaaaactgcttaactcttgtttaattcggcaaaacgtttcccaaattgatttgatcacagaaacctattaatatctttgggaaatgcttctctaatctttaaagtactgtatcgtttttgtgaaaaacatagagtttattgtagaattttttcatgaaataaactttgattgtttctttagacattcagagagatgtaaattatgactaaatgtgattagagtttcccaggaactgagattttttttctcatttgatattttgaacaagatataatctctatgacctaacatatgttagttactttaggcatttaacttgtgtatttaagaaaaggagatgtatcttttattggtacactgaactgagaaagcacaccccacaacacgaaagcatttctgtatttgccccgagctcagtaaaagagtttgtccctactcatggttttaatattgtttgttaatctaggaaataaacctatagctgtatagtttttctatcaaaatggtgtaactgggtgaagtaggaaggttgactaattttattttcagtttcagaatattaagtcctttgttatattcgcactttacttgtctttaaaataatatctgaccaaagctgtaatcatcttttgcctctttatcatgtgagattcaaatgtgctttactagtttaactgttcactgactggataagaaactttccctctatttttggtaactaatgcttctgtacttgctttaccactcttctttatccacatagtttttttttccttcacatctttttcgtcatgagtagtttagtttagttttggtttgctttgtaaggttagagataaatttgtaccaagttaggagaccttttttaaagaaaacttttgttttagaagcttctttttggtggtggtgctggggagggataggtgaaaggagataacagtagataaagcccgacaagttttcagctggacagatcttcccactggcctactaaatctgaaagagccaaaggtttgtggtgggtttgtctagcaagttctatgttctagttcctgaattttccctaccctagagtgtcatgtttccatacttccttccaaataagaccatgatctgcagacctccttgtaagtccaatcatccctaatacttccatgtttcagaattaaaaatgatttctaaaaacattacctaagcattatattactaaagcaatatgaccaaaaaatgttatttccaagaattgatgaagaaattttacataaaagataattgagcattaatacttagtaaatgaaattctaactggttttatcttcaacagacaaacaacagaaaggtgaatttgcaatagatggctacagtgtcagaatgaataacactctaagaaaggatggaaagaaagattgctgttttgaaatctctgctcctgataaacgtatatatcaggttgtagtttttatgttgccttgaaattaagttgataaaatgttttgatttcatttatagagacattaacatttgattaatactttccttgacatgttaacaataataaaaatactgatgtttaaatatattatgcattgaacattcatataagaggaaatttttaaaaatttcagattaattcacacactatcttcttgaaaaagataaagagaatatataatttatcaattacttcacatgttgcacacatgttgcatagaacataggtgatcacatgttgcatagcactaggtgatcttccaaaagaattacatagcagaaagagtaaaattattaaaacaaaaatatcagagtgataatacatattgtattgcttaggagtgtgggagaaaatgaaggtaaaagtacacatcagctctgcaattcaatagctatcagctaggcatcaatatggaatgtatgtttaataagttttaaatatctgagattgcagttgaaagccagttaattaagttgtcaggtagtgtgttggaatctgacaagaacatttttaagaaaactgtgtgcagcagtctaaagaaattcatgggtgtcttctaattgtcaagggcaaattttgttcatcagttctgtctttgacattgatgaaagagaagcagctttttttcctgcacagctgccagctgctgatcagcgtttgaaattcatcatcctctgcttcaattgcataaatttgtcaaaattaactgtacattataagaagcatccttgcaagaaaagttccactagacatgaaaagaattactaatagtcttaaagaaatggtaagaatacaacatacctttcattcctactatggtgattttcgttcttactgtttgttttatattagtttacagcagcttctcccaaagatgctgaagaatgggtacagcagctgaaatttgtattgcaaggtaagataaatcaatcgaacaagttatcacagtctttaaatactaaataacagagtagtttgggttttcatatacaaaagcttattgacttctgtgagaatgaccaacttgaatgtgactgttattaatacagaccactcacttcagattttaaacagcatcttttctataagtaccaattggcttactttaaaattcacatatttacaaaacaatttttaaacatgtttttagttaaggacataacatataacaatattgttgttgctttgtagggctgcatttatttataaagtatagttttaaaaatatcttctgcattcttttaaaatttacttcatgaaatgtgttttatagatatggaatctgatattattcctgaggattatgatgagagaggagaattatatgatgatgttgatcatcctctaccaataagcaatccactaacaagcagtcaaccaatagatgatgaaatttatgaagaacttccaggtatttactttctggtgattcatttaaagattttagggctgtgtgtgtgtgtgtgagtgtgtgtgtgtgtttgtgtgtgtgatttgtcctcgacagcttgagtagaaaatggtgacctattgagaacaaggacaaagaatatcttcaaaactctattttacaaaaagggttctgcttgagatatttcaagtgagtagatgtaacttacgaaaagtgaatgaaacattaaaatgaagcagatacaatactaatctcttgggacttgtggctcattagcattgtttatgctacataattttttaattaaaaaattgacttgccttacagttttttccaccaactcacacatcgttttttatttatacatcttggaacttccattaaccagaagttctatgcacaccccagatgttaccaacttctgcctcgtatttctccttgcttgtagtatattgcactgtctcagaggaatgttgttgaactataaacaaaggccttttgaggcttcaagtcttcctgttgatattttagcatcaatatggaataaaaaagttttcttattccaaatgctcagacctagtttagtgtttacatgcctgtctgttatgtaacataaaattaattatctattagctacttgacttgcggccatgaggatcaatctaaaataaaaagacatctgaaatttaggaaacatatgaaaacatttaggaaattgtattactaatactctaggctgaaatgagcttttttggctattaaaaaatcagtagttagagaagaaaaaggtatcataagcaatataagcaagatttaactagtacatctcatgtagagaggccattttgctctgaatataacaatttaatgatgtaatgttaaacctttaaaattgatttcaaaaatacttaaaatgttccaaattaatgtacaaatgtcattttcaagacaatacagcataataccaagagtatggactttagaagaaaaaaatttaaattctggctgtaccattgactagcttagtgactttataagttaatttcttcatttataaaatggaaataatgtcattgggaggggtaggtgaagtgatttatggaaggctttcagcatagtgcttgatcccacaattaattgtaacatcaccatcatttttgttttattattgtatctggtgaattcttgcaagtgcttatgtggtggtacagtaatggttttctaaccaagtaaaaagtaataattttaacaatattataaatttaaggtataaaaactatgtatgcatctacatattgtattttactaccccagaagattagtataaaagtataattttatggggaatagtgatctgtgtatttcagttgtttagtggagctacatgtttattaaccccttcctttctggtttaccctaaggaaatggcatctgctgtagcatcagttatcctcaagtagggaagaatattccctggctgcttgtttttggtcacaccatatcattaatacaattattttagtatttaaaaatgtttaaaagaacttgtgagaatgtatactcataaaatggaagagtggaatacatttaaacacgatattactgccattacatccttttaaaaccctgcaatgaatgtgttacattacaattgttgaaataactgttaagttctgtattttttcaacttggctgttctctccccacccctaaagaaaaaaaaaattgatcaggaataaagaccagatattcatagttattttcataacaaagacctaaggaaggtctgagtagcttgaaattttaaaaatatgaaacatcttttattttttcttactggagatattattcttcattcttccttgcccccctcctcacccaccctcacacataattgttggaagtaactggttactttttaagtagtgttacttcttgctgtggtactgggagaaatttaagctgccctggaatttcttttcccctgcttgggatccccagttgctctgcaaagtgatcgagcttgatggagcctgcacctgtgccccgggaaggaagccgttgtaggcagctgtggaatgtctagttcccttcttccccaatgtaactgagagctgcttcaacatctgcacggttcagcaagtttgtcaagtttgtgccaacggctacagaggggatttttctagtaaaggccctaaaggtgtctcagagttagaggttttgtttgattaaatgtctgaaactaggaaggtaacttttttaattaaaacaattgtctctctttcaggacaagaattaagcttattgctttcacttctgtgaaatttgaatataattttgatagaggagttagaacaatggaagagcagtaagcacatttacatactgttgatatttttccagttctgtgcaaagaactatgtatctctgatatctgactggctaaattcccagaattaaataatactacaatttcaacacaattttctgtcaattatgcattgttgaaaactaatcctcttagttgaaagatgaggtatacaaatgtatttgaagagaaatctaagcatttattatgctactttaaatcacaaagctctttttctgagaaacgaaagctcttactctaataagtgtattttttaaaaactatgaaataaacctgcagtgttttgagtttcaagagtaagaagaaaacgtggttttaaaaattgcaatgggctgggcgcagtggctcacgcctgtaatcctagcactttgggaggccgagttaggtggatcacttgaggtcaggagttcgaagcgagcctggccaacatggtgaaaccccgtctctactaaaaataaaaaaataaaaataaataaaaaattagccgggcatggtggcaggtgcctgtaatccaagctattcaggaggctgaggcaggagaatcacttgaatccgggaggcggaggctgcagtgagccaagattgaggcactacactccagcctgggcaacagagtgagactgtgtctcaaaaaaaaaaaaaaaaaaaaaaaattgcattgcataatatcccttgaaaaatgtttataattctacaggaatctaaattgtttcattgtaattgtttttcagttagaatattctaacttcattacagtaccttctgtttaatttcttgttcatttatttttaactaacttcgtaaaggaataggaataaatttgtaagacttctttgtgtttaagggatttatacatatgtacaaaagagttgcgagaatgccatttctggggagtattaaaggtatttggcttttcttcaaatatcctaatccttttacatcttttatgtcttattgcttattagcataggccagtcaggtttgtttacattgtaataatactatagcatatttgtgtttgtgcagctaatatattgatcaaaatgtgttaaactgtttaacatggtaatgagttcatttggctcagcacaggtttgtaaatttattgctcactttttcattagaaatacagaggagtgtctttgtctcattttgaatctcaaaaggggaaaataatactcgtgaaattgctgcagaaaccaaccctgtttgctcttctcttctattcactatgtcacttgattttttttctttaatggcaggaaattgtacagaaacaacaacaacaaaaagatttttctagatctaaactgaatagaatcagcctagtaatgagaatggtaaccatccattaacttattaaatctgtagctttcagagggattgcacttgaaatgtcttctggcaagtggactggaggagagagggcaacataaaacaggaagacaaatttctattccattaacctattttttttaagtgtgaattcatttttttttaaattacaatgacagattgaactattctgagtcagaaaaggatatttttatcctttggccattcaattacattttaaatgtattcagtccaactatctgcatctaaaatagaacataaagtaaaatgcagctataatttttttccatgagactattatatatacataaaaaagaacagtgtttgggtactttaatttgaagtagtttacagcaaatggacacaaatgctaatttagtcaataagtggttataggcccccaaaatacattttggctttattttcctcctgaataattatcactcatattactaagttaatatcagggttacaggggaccctgcagtctgtggtattaacattgttttaagtgatagtagatcctgacttcaccaaacaatttttctcctttcttctttggaatgcaatggaaagatgtcaattaattttcatagaaccacatatattcagtattttaatattgttagtctaggcagcctgctaacattattttttcttaaactaggtactgaatggtgaagttatcaatgtggtgatattgtgggaatagtttttcccaagtagataactagattagggttgaatttttggatggtgatatggtttggctgtgtccccacccaaatttcatcttgaattgtagtacccataaaatccccatgtgtcctgggagggaccaggtggagataattgaatgatgggggcagtgtcccctatccagttctcgtgatagtgagtgagttctcatgagatctgatggttttataaggggctcacccctttgctgggcactcattcttctcgatgctgccatgtgaagaaggacatgtttgcttccccttccgccatgattgtaagtttcctcaggcctccctaaccatgctaaactgtgagtcaattaaacctctttcctttataaatttgccagtcttgggtatgtctttattagcagagtcagaacagactaatacagatggtttcagctctaaaatctgcttagagggttatccgaagttataaaaaaaaatgaaatcattcataaaatagggtcactacacacatataatatttattatttttatctttgctgaatataaatgtgtctttgctgaatatttgttcatagtattctttatgttgtttcataatatagtatgaagctttggaatacagttctgcctgtcttgtagcttttctctatgttgccattggcattgcaaattcctttcattacaagggatggcttaacacatactaaaccgaaaatatctgtgtgcacacaaaacatatatttccactggtggtgagataaaatgactcatttttgcaaattggagctacatcagtggttcccagccagggaagatattgaccccagagtatgtttggcaatgcctggagacacttttggttatcataactgggatgtgtgtgtgtgtgtgtgtgtgtgtgtgtgtgtgtgtgtgtgttacagatatgtggtgggtaagggccaaggatgctgttaaacgacctacaatgcacagggcaacccccacaacaaagaattgtctggcccaaacgtcaatagtgctgaggttgaaaaaccctggccacagggatgtaatagacaacttttggtttatcacctttttattcttatcacttgaattaataaagattcataacctaagctccatatgagttaattcatttttatggacacaggttttcttacatacatgaaactaggattacatagaatgtttctaggttttaagagatcagctggacttgcctatcacgtttccttcaaggagtagtattgaaattctatccatcttgtagaaatgagcaagccaggaagataaaaaatgaaggaagcattttctctattttcatgagctactatcttggaaggaagaggtttctaaaaataccttgtagatgtgtgaatacttgatttatcctattctgatagggttgttcttttgaggctgaaggaaaagaccggtgggtgtgggattggactgtctgtaaagggagtcaggcatcctgggggaatgcaaggctgagcaattccagggctgtctggaatttgacgagtggctttaggagaagtggaaacccttttatgtgacttctctatctttttggacctggactttgaagaggctagtaggattgagatgatctctgcccctggagttagacgggaagtcttggaggcagccctccaaggggatccgtgaagaggagctcactttaatgtacttcacaacaagccatactgtgtgattattttatattatttgttcacttccctttcattattgctaaatcttagatttcttttttttctttttaaagatagggtcttgctctgttgcccaggctggagtgcagtggtgcattcatggctcactgcagcttcaaactcctcaagtgtttctcctgccttagcctcttaagtagctgggactacaggcatgcgctgccatgcctaattttttagtttttaattttgtagaaatggagtcttactatgctgaccaggctggttttgaactcccagcttcaagtgatccttctgcctcatcctcccaaagtgctgggattacaggcatgagccatttcactagctactaagtcttaatttttaaatccttatttacaaacaatacatgcttgctggaataagcttaaatattcctgatgtgcataaaataaaaaagtggggctgggtgcagtggcgcatgcctgtaatcccagcactttgggaggccgaggtgggcagatcacaaggtcaagagattgacatcatcctggccaacgtggtgaaaccccgtctctactaaaaatacaaaaattagctgggcgtggtggcacgtgcctgtagtcccggctactcggggtgctgaggcaggagaattgcttgaatctgggaggtggaggtgagatcgagatctcaccactgcactccagcctggtgacagagcgagacttcatcttaaaaataaaataaaataaaataaaataaattaaaataaaataaaaaagtggaagtcactccctaccctacgtaaactttgttaacagtttgatgtgaatctttttgttccttttttgcctatttttaaatatacatatacatataaaagttttaaaacaaaaaagagatcctttttatttactttcttctggccttttgtaaaattttcttcctttcattttcttcctatttcatttttaccttcctcctttctcatgcttttattttctcattcctctcccctattttcatttccatcctttctcttcttccttgctttcatttctttcatttcataagtattcttgagtacctgttatgtgccaggcactgtgcctaagtgttgggaatcccccagcatccttacacaggcctcaaaggagtgccctttttggcctaagcctagacttactaccatacctccatgtttatttatgtcttatgtatgtatgtatgtatgtatgtatatatatataatatcctcatcgcatgagttttctgtttttgcttttctgatatagaaattctgtctccaatgggcagagtcttccagcagatagtgtcaaaagtagctttgtgtctttatatcttgacacttttaaaaaaatattttttaattttttaaaaatttaattatttttatttttttattttttttgagacagggtcttgctctgtcacccattctggagtgcagcggcatgatctcaactccctgcaacctctacccccgaggttcaagtgattttcctgcctcagcctcccaagtacctggattacaggcatgcgccaccacgcccagctaattttttgtatttttttttttagtagagacagggttttgccatgttggccaggctggtcttgaacttttgacctcaggtgattcgcccaccttggcctctcaaagtgctgggattataggtatgagccacagcatctggccctttttttttttttttttttttttttttttttttgagatggggtcttgctctgtcacccaggctagaatgcaatgatgtgatcttggctcactgcaacctccacctcctgggttcaagctgtcctctcacctcagcctcctaagtagctggaactacaggtgcatgccaccacgcctggctaatttttaatttttttgtagagacggtgttttgccatgtcgtcaagatggtctccaacttctgagttcaagcgatctgcccacttcagcctcccaaactgttgggattacagacatgagccactgtgccaggccaatgcctgcttagaagccatcctccacttcccctgtttctctccatctgtctcttgtctggctctacgccttgctgcagacacccagagtaccttcctctgtatctgtgactagtagattgttgtggttgtgagaaggggctctggaaggaaacacacatcactttgaatcccagctctgcccgttatatgtgcttcagccagaaaaggagtgaacacaggaaagatggagaatacacaggaaagatggagcatggaaatgggcaaaatgtgtcagtaactttattgattattttaaaataagctttgttttaatctaaaaaagaggcaaaactaaatttaggcaataatttaaaagttagctggggcaagatggagatggggggtagtgaaagcatgccagatgttgtcctgttcagaaggacggaggagaggaatactaattttaatttttgttaggaaatgtatgttaaaattttagagttaagtactaaggaaatagaatgcaatcttgcgttgctcaaagaagcagagggtaaataaaaggtgaccacgtaaaacaatgtaaacacaaaagaaggcaacaaacaagaaatcaaagagaaaatatggtaaaattaagccataatataaaagtaagaatgataaatataacttagtctattaaaataaatgtttgcattagacatttttaaaagtctagcactattcttcttggagatacacctgaaacaaaaccacatagaaagtttcaaagtaaggaaatggaaataaatacaccatgcatttctatccaaagaaagctactatagctatgttaacatcagataatatggaatttaaggcataaagcaataataggactacagatgacactacataacaaaaatgaaagaagataaagctcaaattcatctaactatataaccctaatatctataacacgaaaacatataagactaatttgacaagttcttaatcatagtgggaaattttaagatacccctttcaaaaactgatagaccaaggaggcaaaaaataagtaaggatataaagatttaaccacaaaattaataatctatcaaaaagatataaagtaacattgcatagtagagaatatttgttcattcagtacacatagaataatcatagaaattgactacatatgtgttcacagttaaactctcaacaaattacactgaatctgtgttatacagactatggtctttaactacaattaaatttaattaagagccaactctgaaaaggtagttgaaaatacccaaacccatgtgtttggaagctgaaaaaataatagttcatgagttaaaagaggaaattacaatggaaatgacaaaatatgtagttttccatatgaaatacactgaaattagtacaaataacaacttgtagcattgtagcattgttgttaactctttttttgggggagggaacagagttttgttcttgtcacccaggctggagtgcaatggcatgatctcggctcactgcactctccacctcctgggttcaagtgattttcctgccttagccttccgaatagctgggattataggtgtgcaccaccatgcctggccaatattttagtatttttagtagagacggggtttcaccatgttagccaggctggtcttgaactcctgacgtcaggtgatccacccgcctcggctttccaaagtgctgcgattacaggcttgagccactgtgcttggccatgttattaattctttggggagaattaatccccaaagaactggagatgacagaactataaaggctataaaatcaacattatttacaatgattcaaggataaaataaggaaaagaaactttaacaagagaaaaagatcctgtaaaaaaaagatcagatttttttaaagaaccaaatagaatcactagaaattattgatggtttggatcacttagccattgaattcaaaacttttagagtcacatacatatgtttacattgctgagggaaccaatagaatacatattaaaattctgaaccagaagataagcaaatgtcaaccactttaatcaaattaaaatgctaatatttgtaaagaaaaaagaaaaattatgttaatggggctaggcttttatgttttttctgtgaatcctggatgaaaaatcctaacactgtaccagaaggtcagatattcacacgataggatttgtatctgaacataatcaagtgttttatcctttgccaccaagaaatctcaacaagtaaagacatagcttctaacagtcttcatatcagacttttaaactggagtcttcattcttcagatatgatttgtctcccatatagaatataaacagatcacagcctgcttttgtttttaattcatccattctttcagaagatagaatatgataaagtttgtagtagcttcacgaaaatgtatttgcttctttaatcccagaaaaaaaaatacacacatatgtacacatagccacacgaacacatacatctatagagacagactgcagcaagagagtatcaagcttcactatttttgcagataggtcagctgggaatatcaacttcctaagagtactcagctgcttactttaaagcagtgattaataagaatgaacaagttcaacaaaatgtcagtgataaatataagcactcttcatatctggcctcggcaagtgctacagctgagtaatgtaaaactttcaacaaaatgggaaaaaatccaatttaacttaatcaagcttaagtgaaattttaccttaattttgtttcaaataaaacattcgtttatagatgttttcctctttattagaacttcattagaatttttacgaagaaataacaactgcttatagccacttatccattagcccctttgttccttattaaagaagttaagatggggcagtttttttaatatatataataaggacattcagttgcaaggtctgagttttttggactagatcccaaatctgcctcctgcatgggcctcttttcacatcctggttcaaggaactacaacctaatcgtgcttctcttaagcacacaaattcttggaagagctccctttgttcctgttgtctcttcacctgcttactctttatcctcaggcagtttggttttctatcctcattccttaactaaaccagcttcttcagagtcaccagtactctcctaatcatcagtcttggtcctcaaattcatctctagaaatttgattttacttaccaccgcttttgtcttgaaactgtctccacctttgcccttctccagtttgttttcttgtttacatattatatttacaaataagcatcttaggtcgggcgcgatggctcatgcctgtaatcccagcactttgggaggccgaggcaggtggatcacgaggtcaggagatagagaccatcctggctaacacagtgaaaccccgtctctactaaaaatacaaaaaatgagctgggcgtggtggcgggcacctgtagtcccagctactcgggaggctgaggcaggagaatggtgtgaacccaggaggcggagcttgcagtgagccgagatcgcgccactgcactccagcctgggcgacagagcgagactccatctaaaaacaaaaaaaaaaacaaaaaagaacaaataagcatcttagcactgtattacatttccacatttcctgttgctttttactgattgtttcaaattattttccagtctatcctttcctaatactgaagctttttgtttttatcttgtcttaccttctcctcatgtcatcttattattattcacttaattaactcatccagcaaatatttattgaaagcccattgcatgtcagattctgttctaggtgctgggagtttaggcatgaaaaaggcagacctagtccctattaagatagttacagattgtagtaggtgacacaagataagaggataatgtgagagggagtaaatgatgtgtattctatggttaaagaagagatgacatttaaactgaagccttttggataaatgcaaaaagccaaacgaagcactttccaggcacagtgaacaccaaattcaaaggctctgagcatggacaatcctggggtgttcaagaaccagaaaggagggccatatgtagccaggcagagaggttaaaatgagattggagagaagggcaacagccaggttaagcagggccttcctagaacagaatcacagccccatgtgcataaatgacacttgaaaaatgtgtcctgaattactttagtgaggctgacatgtataattatataagattgcccacacaaatcagatgctgtttatgagatgaacaatttggattggaagagacctttttctctttactccttctccctggacaactttataccttccacatcactacacagaggtgcatatggtcagagcaaagtaaaacatcttcactgggtagctagctcatcaaaagaatgtagaagatatgatgataattatactaataatggttaacacttagcatatgccaggtactttcctaagtattatttaataagcataagtggttgatggtataggtattattactatctctgttttatagacaaggaaactaaggcacagaaagattcagtaacttgtttagaggcacaagctaggagatagcagagttgggatttgaacctaggcattctgactctggaggttaagcttttagccaataactgtactgtctctcaacaaaaatatgttaagaattgccttgtccttagttatcagataagcatttactgcacacatataaaaaagacaccagaagagagaacgtaccaaccaaatctcatcttcataaatgttctctcctctgagctctggctttatttcagataatttttggccatcatatcaaacttgtatttaagatcaaattacagattgaatattcctaatttgaaatctgaaatgttccaaaatctgaaactttttgacactcaaaggaaatgctcattggagtatttcagatttcagattttcagattagggatgctcaaccagtataatgcaagtgttccaaaattcaaaaaaatctgaaatttgaaacgcttctagtcccaagcatttcagatgaggaatattcaacctatactgctctacctcctttcttttctatttctactaacggtatcaattgttactcaagtttaaaaaaagaaccctcaaacccatcattgacttctttcttggtctccccacctctcctaatttggtcagttgccagttactcctgattctgccactaaaacatcatccatccctggctctctgctcactcaggctttaataatttctcacctggatcattacaaaagctcctaagtggtctccccacttcctgtgtgtgtatctctttctctaaccagcctgatatagcctattctacgtggtgccaacagattgatttcctaaaatataacatggtcaaattaatcccttgctcattaacctttatgagttcccaacccctagtaaaccaagttcaaactaactggccaggccctgagccatggtcccacacaaatccacctttccaatcccatttctgctgctcagacttatgctccagacagactgaactcttcactaacccttagcccttccctggactgccttcatcaactgtgtagctctagatgccttaaacaaaatcaatatattgagttaattaattcagtgacaaaaatccagccaaatagcacacagatcaaactttagttgatgtggcttttcatttttttgtccacaaagtcgctgatgaactctaccatattttctaacatatctcactatctgcaaggtatagggtgggtactcagatgatcaataaatagcccctgttctcaaatataccataatttaataagaggaacagatatatgaaatctaactatagaaaaaaaacaattaaaagacatatgctctcaccaattccaaagcctggtatgtattactatatatcttggccattatttcctctatccacacctttgtggaacctttatagtcactgcttcagaaacaatgaaaatacccttgttgattctatatatttattacaccattatatagcattggtataaatatagtattttcgttaaacctgctcaggtggaaccttcgtggtcattccactagaaacaaaatacccttgaaattctctatatttattgggcataatacagtatttttataagtatagggtgagttaataaacacagtatagtatcatggtataatagtaaatatagtattataatatcattatcctccagcattctggaaattaacacatattcagaacatctcatctgatgctgagacaacgtatataaaagaattcaaaacctcctttataaaccggttaataatttttcatttagtggggaaaatgttttcaagaaaaaaagacttcagaagtttcttaagtcctatctttctgctgctccaaagtgttgaatggctcaccacagaccataggataaaatgcgtatttgttaccttggcattcaaaggtcttccacagtcttgctgaaatctcacagtctagcctaatcactgctataatgcaacacttctccaattttaacaagctgacttgctctttattttccccacgcatatcccatacatttccaacctcacatttgtgttcttacacttctgtctttatagaatgctgtcccgtttgttcagtttctaaccatatcctccctgctctctaggcccagatcaaatcccatctccccaaaagagccatcccagcatgaagtgacctctgcttctctgagcttctctaaacttttctaacaccattcatttgaatattaattacaacttcgtgacattttaaatgttgatatgtgctattctgtaaatcttaacacttttcatgtgattatttggcaaacaagcaaatggatggttccttatagctttattatatttgcaaactcctctagtgcaaggatcaaaccttatatttcctggcacccccagagtacttgaccaagtgccttcctcataagaattcaataaataatacctgaatagtgcaaagtctttagttaaaggggtctattaggtaaattaagagaaactttctctttatgatgattattttcctgacatgaattactgcagaatcctaaaagaatgattaccaaacagtatactatcagtggtatattgaagcatggctgatcccccataacttcattaaaatctaacattactattccaatgggcagagtctcaaataaacttaggaaatgtaatacattgagtgatgaaaagctcttatatcatcaatcctttgggccattaaagataaatcatctactatgagcaacagaaccaacttgagttaccagttccctatggcaggctagtcatctcgagcaagacatttcccaggaaatgacattctcctttgcttccactcattcattaacacaggtaaagtagatctaaagagcacaggatcatagttaggatttttaaaacctgccttctctaaggacttaatgtgactagtaagcaaatggtacattttatatttaaaagtaaactcagatatggaaatctgcacaagcaacttaaaggatggtgaaacaaggtttaagaatcaatgattagataagtccttggggaaaatgtttaaacattatctttcaggcaattactttgattcagtgggcagagaggaatcattggagggcctcaaaaagaggaaggctgaggttaagattcaggctgctcactcctagtactagctctgacatactttaagccctttgtttcccttttccactccacaccctttgcttctattaagctagttccttttctcagaccactgcttatgagtcctgctcccaatttcacattgcctattacactctctcatataccagatagcctcatttcacttctgttagcagcctgtgttttctttcagaaactaccttacttctcagttcttcctggaaacctagcctgataaggtgaaggtcatctgtacccataataaaatatcccatctccctatgttttatacttataagtataaaagacagtaacccaacacatgtagatatacatgtctagacactttgtgaatttgagcctaggtttttattttatactttctaagagctcagcattaatttaaaagtattctgcagagatcatctaatattctaataaatcaactgaaaaagaatactaaagaaaatgaaacatgaaatgagaaaagcaaaaagaaaacacccaatttttatgtaagcaattcaattattcatgcaacaaatatttattaggcagctattacatgtcaggcactgtgctagacactggagatacagtgttgaccaatatgactcagaatttattaattagaaataaatataacaaatgataagaaatggttatgaaaagaggccgaagagagactgatgaagaacaaagatccaagccaagtctatggcagtaaatgagatacctaaaagggcttgtctgttcagtgctactcatacccagtaagaaatatgtggttctgaacaccacctatagaacatactgaagatgaaagtaaaaggattaaggttggggagtttactaaatggagatccttttgaaaaatgtttaggtggggtaactattggtatatacggaagagaccagattatagcacattcaatgttatagggaaacgggagttcatattcatgaagagatttaagaaagagttaataagaaaaagactttgaaaaacaccccccaaatcccttcaacatttaaacccattttttttgcccctacaataataaaaaaagactttccaaaggaagtggtggaagaaaccccattgctcaagacattaaaaaccagatggtccaaagccccagcaaacattcacgtgggatcaatccttcacccagtgaaagcaaagagatgggaccagtgtaataatgtgttttgaatctctagcttagaaatgctatgaaaataacaattcacattgccttggacttttccttaatgtcttagctcttctctgtgctccttcagctttcagggttgacttctgttagagctggccacacaggaatttgcctgtttacttggaagtctcttctgctaggtccatgtattgtgagcttatcaggttttctccttacctctatgagagtgctgtatgccctgggttctggaagtgtttttcttaagtgcttctcctaaggatggttttatgtttgcttctgctagaaccccaggagttttgaaatttttatgttaaatttcttggcttgggaataccatgcttgaggatggtataaacttggatctcacattggacaggcttgggggtttgatttctcacaggaagccccatgacctccagccctggaaaaacagaaagcttccttgtttcttccctgggctgttgggggtctcatttgtatctctgtgcttctcacaggcccaaagccttgtctcctgtgtccatgaagatgttaaaactccagcctcaaccccaccatgcaaatgatcagtatgttgctttgagcaagtggggaaggacaggtctgtttcagcttggttgaccatattgctagaggttgaattcctaagccataagttatgaattaacactgcagtgaagacttaattataagtgcttgatttagaaactttatttcaagtcaaacaaaattttgtgtatgtgctataggcaaggttctgtgctaggtgtctaatatcctgtctcctatgtactaaggggctttataattataatattaattacttctttttttttttctgaaatggtatctcactctgtcacccaggctggagtgcagtggtgtgatcttggctcactgcagcgtcgacttcctgggctcaagcagtcctcccacctaagcctaccgaatagctgggactacaggtgtgcaccaccatgcccagctaatttttgtatttttagtagagacaagatttcactatgttgcccaggctggtctcaaactcctgggctcaagcaatccacctgccttggcctctcaaagtgctaagattacaggtgtgacccactgtgcctggctttaattacttcttgacaagaagaaatttttgttaaatttatgaaggaagagattttaaatggccgctgaatttatgaagcaaattatcccaattagctgcttaatgctatttaggataaaaattacatttgtatatacaaagaattactcaaaaattaaatcaaatagagatccatccagacccaaatgtacactttggttttataagctaagactaatacatatttgcatttgaagtcatgttaaattaggttaatgtggttactttagaatatatctttaaaatggggctggcatttcaatcagctgaagtcctaatttaaataacctattttattctgtgtgctgatcaatcattttctcccctagaaagtcaaaccagtttttgcacttttcatttgtagaacttacatgacataaacattatgtgacagaagttgcttgttattaagagagagaatatcatctcaaagaaacttgtcatctggaaacaggaaaaatcacatgaagtaattttatttgtatcatggctttttcactgttcgctacatttgtgacagctgattttatattaaatattaacaatattctgtttatacttgaatctgctgcagtaggatatagattttactcagaatattcctggttggaaagaagactgttcagttaaatgagacacgtgagggctagttataaaaaaaacatagatattatataactaagaaaataaagctaccactttgatgtcaaaatttggtgccaaaagtttgaagttttactttacccttgactcttataaaattttgttttgggaggtcaaaattaggaaaatattggcaatttcattttattcaaactaataaaaacacttgttagctatgggtacatgtgttagagagtcatggatattaatataaatagtatgattataatgaatgagttatggagacagttaatctatttgttagaaagagttattgttggactttggtaaccaaatagggttatatttctcacttttaataacacttatacaataaaaaacattgatatattttgagtttctagcagcagaatgtcttatttgttaattttaaaataattttggcaacatctactttaaaaaaagcctaactgaattgtgttgaatcttttgtgaagtgtgtatgtatgtccctatgatttgttttgttttgattttaacttttcaatatatgaaaatacccatgagacaggctcctgctaaatttttggccactttgtcatcagagctatgagtgtacgttgtcagttgtttaaacattgttgaatccactgtgggttggcaagaagcatctgggagccagacttttcctgtggacacatgccaagtagtgtattgtatttcctcactaaattgaactatactgagataatttttctagttgagtttttttaatccagaaattattttccaaagctaagtaaagggtcatatgataaagttgtttataataaaaccgcctgaattctttaatcactgcttgataactacttttatttagctagaataggtgtaaataagtcatgcagttaaactacattcagatagttaacattatgctcttaagtagactgttcaggaaagtgcatatgtcattttgtgtattctctttaaatcaatgatttactctaagcaaggacaataaacattgaatgatcccttaattaagtactatggttgggcttgccattaaatttacatgtttgattgcattatttaattagatggaaataaaatcccaaattgcattttaatatacataattatggcataacatttattttaactaaaagtgctaggaaaagtttataaaatctcatatttaactttaaaaaaaatcagttgttatttggggatgagaaaacaagaaagtttcgtcatactggaaaataggctagaggctagttttggagctctggcactgcctagaccctaggcccctaaggtggcagggatttgtcctcccagagtggataaatttacttcatctgctactctgggacactgtgggtgagaccttaaaaaagtaagatctggtttgcctgccatgtacattaaaaatattctggctcttttacataagagcagacattttgttgatgttggctttatttctggaatccaagtaagagaaactttgtaaatgagagttcaacctatccctttagggggccaaaactgagcaagtgtgttggtttttgagctcaaatttttattcttacgtactttgaaggacagcaaatgctattttgcaagaatgagcatcaagacctccatcagatgagttttacatgcctaacctccccttcttccccctgcaggttctaccttgcttcttttggcagcccctttctacagaaatatactagttctagcacatcttttctcttcagccattataacctattttatcataaattagtctgtatgtcaagaagatatctcttacattagaattgaaaacttcttaaaaacaattctgaaagtctgtgcacagccactcataggtacgtggaaattcatattttgagagtgccattctttcgtattacgaaaagtgctttaatttgctgtatttttcatgtcttactgcagtcatatctggtaagaaactatagctatcttattcaggattaatcaatcttcttaggctcctggctaggattgaagctgctctcagccctgcttgcttcagggcttagcctaactctgttttttcatcacatttagtctctgggagggaggtgatgggagatgatttttccatttgcaagctgcctttcaactggaagaaaaatggaaggggcaaatgccaagtttttcactttctgtggccattacaaacatgacttgtctcctgttttttcagcagtgtacactatttttcaaaggagcatttttttaaacgattgtcagttagccaaattattttatcattgaagagtgttaaaaataagaatatatgtcaatatgacatcatgatattaactttctcataagttgcatgttgtgacaataggttaaaatgctgtttaattaattaacaaacaggagcaagtaatatatgcaaggttttacacccaaagggaagaaaaactgtagtgcttcagaacctgggctctggaggcagactgcctgggtgtaaatcctgacactaattattattatagctgtgttatgctgaacaagttacttaagtgtttctatgccttcgtttcattatctgtaaaatgttaatgatgggttttgaatgagatttatgtatatagtacctagtggtgtttagtacacagtaaacagattattataatcactgttacaaatctgctatgcagatttgtgttgaccactttaccttatttcatcctcataataattatctaaagcagattttatagttctgttgtccagatgaaaaaactgaggttcagagagtttaattaacttgtctaagtttgtatagctagtgaaagagggtaatataaacttctggactacaaattatattgcatttatatagttatgttgtatctttcaaatgcatatatgggattaactcctgttttgctaattccattatataattaattttactttggtattatttagtgacatatatctgtattttgaagcttaaaatgtacttaccttcaaataatgatagaacactgaaaccttagagaccttatgcaaaagaaagccttaggacaaccatgtccaatcctttgaatgcagggagttttttgcttatttgtggtggtggatatcatgaaaattatgcatggaatttttttttttaaagctcatcaggtattgttagtgttagtttatcttatgtgtggcccaagacaattcttcttcttctggggtggcccagagaagccaaaaggttggacacctgtgccttcgaagatacggctctgagccatggttctcaaaagtactgtcctgggaccagcagcatgggctggaaacttgttagaaatgcaccttctccagctcagccaaaatatactgaatcagaaactctgtgcatggggcacagcaatctgggttttaaaaagcccaccaggtgattctgatgctgctgaagtttgataaccactgctcaagataaataccacatcgtggtggtatgccgagatgttgatgtgtctcataatctctattcgcaaattagaagttacctcatattgcagaggggaaatgtggtgatagtagaaaaatacaagtgaggctattatttgataattgccctataaatattaaatattcaacactatgtgcttgatccctttcattccttggattgaggccttctaagcaggtagaagctattactgtagggcacagcaaactaagcacaagggagtaagactgagtgtgactctctccccaccctcagtttcttactgactgggacacacagaaccagggatcaggatggttagtttttctagtatgcagcaactaggaatcttcaaacaagaagaactgacaaactgtcactaagaatatagagaaggggagagagagcaataaacaatcattatcatcatatctttttctttcttgagatacggttcaaacatggctgggcgcagtggctcatgcctgtaaccccaagcactttgggaagccgaggcaggtggattgcttgagcccaggagttcaagaccagcctgggcaacatggcaaaaccctgtctctacaaaaaatacaaaaatcagccggatgtagtagtgtgcgcctgcagtctcagctacttgggaggatcacatgagcctgggaggtagaggtttcagtgtgctgagatcatgccactgcactccaacttgggtgacagtgtgagaccctgcctcaaaaaaacaaaaaacaaaaaatatagttcaaacatggaagtggcatattttaaaatgagtgagacagaaggatgtaggaaataaataaggaaactgatacggtgtccacttttaattgtggaaaaaattggacaaaagcagatatcatcttagaatccatgatagccaccgaagaaaaggctgcccattacccacacacatttgctaagactgtaggaaggcagatttcagaaaattcagggaaagaataagcaaaaatattgtggtattttgtggtattaatgacaaacaagtatttttaaatgccatttgaattttaattgtaaatgatcttaatgagggaaaaaaagagaagttaaaataatatccttgtgctagaatctattcaatgatgcaagttttatttatttatttgtttatttatttatttatttatttatttatttttgagacgaagtcttgttctgtcgcccaggccagagtgcagtggggcaatctcagctcactgcaacctccacctcccgggttcaagcagtcctcctgcctcagcctcctgggtttacaggtgcccaccaccacacctggctaatttttgtatttttagtagagatggggtttcaccatattggtcaggctggtttcaaactcctgactgcaggtgatctacctgccttggcctcccaaagtgctgggattacaggtgtgagccactgcgcccagcctgaatgcgaattttaaagggggtatccatcaacaattgaaatagctgaataaccaaagaaaatatgaaaatagcttacatttataaattatgataagcacaaccaaaaatgtatgacagttgtgtgtttttgttttcaaaacttattagagacagtggttcagagaaaacagctcagtttctatttgctccttttctgttaagaatcttcctccaagtaataagattggtaagagggaacagaagcccaggattgacaaagattcaaataaaatacctagctagccaaaacaaactccttctttgttccaggcttgtttaggtaatataaataagtcactggggagtccacacctggagtaaaagtggacagtagaggaatgtttgcagtaccttatgagtggaataatagaggcctggaccaagtctgtgagaacacaaaggggagagaggccagctgcttcccagagtggggattgagctttgctttaaagataagtaggacttgggtttgtcttctggcccaggtaaaactgtcatacattacaagagaaattgtaaatgaagtcattgagctgctgtcactcattttgagggaaacatgaaggatgagaaagactttagaggtctggagtctagcaattgtattataaacttcaaaaacagtagaaagtgtctcaagttgggttccctgaaacagactctaagacagttttatgtagaaggtttatggatgagtgatcttaggacatacgccggatgaaagtgaagaaggccagactaggctaggcggactcttcaggattgtgccaaattgaggcataggggcttgtctttgtattcctgcattagctattcattggctccaagccattctctgggaggccctataaccttgagtgaagcaattccctgcagttgagggcaatttctagtgagagacgcagttatgaaccaactgcagcttgagtcccagcagttggggatggctgtgttggttctgaaaagcgtatctggtatcccttttcagatgaattctgaaaattctagatagttaatgggctataaagaggactccagaaactgctaacatagagtatcaaagagagtcttttatgttaactagaagatgaaacactaattactggaacccagtatgagttccaggaattggtggacatataactggacttcagtaagacatgtggtcaggattctcatgaaatctttatagatatagagaccaccagataactgactctacagctgtgtccaaagagtgctaattaattgattttatgaataccttagggctttattttcaatattatcatatccaacctattcatcattgttttggatacaggcttgctctcaatagaacaaaatcatgggtcaaatccaacaagatgaaatatgatagaatattccacttgctccaaaaatctagttgcacaagtacaagaaaggaaagacttggcttcacagaaaatgggaaaaacacatacggactttggtcaatagctcaatatgagtcaacagtttaatgtgattcaatcctgagattgtgtgctttgggaacataaaataattatcaaatagtgttctaggttagcaggatatcattttttttcatgtggtggatgaacaatgtttagatatttaactaaaactaccctagaaagtacagggtagccattcttaaacttattgatctcaggatccctttacaatcttaaaaattatcaaggacccttaaaagcttttgtttatgttttgaatttttttctagaaagtaaagtatttcatctcaatgtagatttttttggtttgttttaaattttattagattaaaaaatactatctaatgataaataggttggtaaatagttaaatctcaatatttaccctattggaaattaaaacagatctttaaagaatgttgatttattaatgaatttaaaagtcatgatgataaacctgttacatctgtacataacctatttttaggaaaaataactatatttccccctaaaattagaagaatatggcattgtttacatttttacagctttcttgaatgtctgtcttggtagaagacaatagagtttcatatctgcttctacattcagtttattgtgatatattgtttaagtacagttaacttataaagaaaatccacctcatacagatatgtaggaaggaaaagggaggtactttacttgcaggtaattgtaggtattcttttttgatattgtacccagacgcgacaagtagtagttaaaagctggtacaatgtggaatctgaaaccataccaatgaacttttcatactcttttacattaaaattcataggcctgtcttgcactttgttgaatggatcttttacccatgcttgattttgtaacatgctttggtcagttggaaaatactagttcattacattatgcagaacctacaaatattgacacaactatgacacaacctaagaaaaacccacattttgtttatatcaccatccatctcattggaaaagtctttaaatagtggggagctgtcaagctaacagtggcagatacaagtttctaaaatcctaatttttgcttgaaagctcaaattttatcattggcaataaataccgtcagttgtttcccttgaaatgacaagcttatttcatttacttttgagaaaatgtctgccagattcccaagtctaaataaccagtttgtcagtcattcaagtaaaaatggtgttccatgaataaaaaaatggctaattcagctcaacactcagattcttacgcatctggtggtgtagcagaaatgctttatacattcttctgattttgtcacatagaatattaaagttacgtactcaaggttgatattaggtgaaaataattattactgcttcatcaaggacattctttagtgcaactgacttctttcatttttttacttttatgccagtgcagggcagtctaagttgatttatgctaaggtgtcagcagttttacccatcattgctctgcaacatcagtgcaaatgttaacatagtgaaaaagacacataatgtcttagtattattatgaaaatagctttgaccccacagaccctccaccctgcaaacagatcttggaaagcactgctggtataagggatgtggagccagtaagtctaatggtgatggttctttctatgaaactgtgctttttctttcttgggctcttgaaaatgaggttaagatgcactgcatatgatgagaaagggtatatttgcataggcaagcagaggaaacagagcaaaagcctataacaaatgagctctgcatccatatatcagctgtttttccagaggttatagtaggcagttgtagaccctgataagacagccacattacaatcaaataatcataacatcagcctatttgtcactagatagtattttttaatctaataaaatttaaagcaagccaaaaaaatctaaattgagttgatgtattttactttctaaaaaaggattcaaaacagtttacaatgaaatgcatatatacttttgggataagaaatgtatggggacaatgaatacatatgcatttggggtattttatttaaaataagaattaagaaaaaccagtagctgaataaaggtagcctagaagaaggtgttaatagtggttatgcttggatcatggatgatttatttatttattttgcttatctctattttctgactttcagcaatgagtagatactgcttttgtaacaagaataataagaaaaaggttactttaaatgaaaaaaaaaatgagctgtaattgtatcagaaatccagagccagatagaggttactgtaagtgaaaaataaatgaattcagactttcctggactaaaagaattttagaattacacaatttgttataaactttaataaaaagccaagaatttgggttgtaaaggagaatttttatcatacagtgaataattcaatgggacaagaaggagctccatttcataacttcctaatacctagtactctttaggagtaggatcattttctaattcacagtcgcttctgaccaaccgaatctgacctatgaaaactttgtttttaacctatatacattcccttttgccataattgcctaattgcctgtaggtgatcgagtgtatacaagactgctcctgaaacaaaggagtgcttctcgagcagcagataacttttcagaaatgtctgcggtgcacagaaggcagtttcagggagaagggtacagtgtgcaagctgtgtgccctcggtccagtcattcagcacccacagtttacctcatcttctgtgaaatgaggaaactgaacaagattctatctaaggtttctttcccttctaagattttttttcctgactctatcaaatgagatctttgcttgagttcaagttttttcctcaacatcccaatcatgatattaacaaatatgtctatgtgaaaaattattttcacattttctgatttgtgtgtgtatgggtatttttttgtttttgtttttgttagagacagcgtcttgctctgtcacccaggccaggatgcagtggcatgatctttgctcactataaactcaaactgttaagcgatcctcctgccttggcctcccaaagcagatttgtgtttaaattattaattttaatgtcatagtacagaaatttactacaatccaatggtatttccttttgcttttgaagggtagtgataaccttttcatattaaaccttagaataatagaatgtcaaaggtgaaaattagattttgtggttgaacaactattgcttattttcttgcctttatatcacattaacctttctggttgcttaattaataaattgttgcaaaactcccagttcctaaggtaataaacttgatacagcatactaatttttcattttttcccctgagaaatctggttatctcattgtcttccccaaatccttcttcaaagtgctatgggatagacttactcttcctactttgaaatacagagatgacactaagaattagaagcagtgtccagtttatgtgagtaacagagctgtaacaataggccccactttgccaaatttccataagagtaaacatgactctaactatgctatttcagtcatctttatccttccattcattctgaagtttgtataatgctaaaaggcacatgcttatatctttttaaaaatatgtattttattgctgtaaaataatagtctattgaatagacagaacagtcctttagaagtataataaaatatagtaatataaaaatccttcatattaccagtagttctagatttataggcccctggggagctcactttcccttgctgtcataattgtgaatcttttgcccataccccttagattcgactctaacttttccaacccttcttccagcctttgtgacttgccacaggtcatgggagagaagagcgggtggggttccatttgtatgtatcctcccagtacttctatcttttacattttaccactaggactagccggtggtgtcctctgttcccccatgtcacctcttccatctcccactcgggcatcttgtgtgcaatgcccaaatagtgtgtaactttaggaacagaggagtgtgttaaaagctagaggtgaggaaggggaactgggagaggagaaagaagaccatatattttgggcagccctggttgcaattgtttctaaatcagcactaaaaagtttgcttaagatgttcttcagatacgatgctatgatagtgtagaacctactattctatgtgaaaatgttttcaaagtccacaaacagacagtattttaagtaaaattttagaaagcaatccacctgtaaattgaagattttaatgaaaataaaggaggagacactgtggcttagagttaaggcatatgcctaaagttaaaatcccagcttatgtactaactggatgtatgaaccttgacaagttattcaagctccataaattcatttttcatattcataaaatggtgatgataaaagtacttataattacctcatagaattgttggaggatttagttacataatggatataaatgcatataatgtgaacatttaagcaataaatattcacatttcctgagaaaaatatataatattaaataatgcctggacaggtggagatctaaatccaaactttatttcagagcttaacttttgattctgtgttttatgttttaaagtacattataatttagtaaagctgttttctgagggtatttagtgagaaaggtgatcattatgtaagtgaaagattttttatatcatcttcctcttctccctggaagagatgataaaatcagtcctcggccttgatgtgaacatcgcataccttgagttggtgttaacaaattttcttcaaccttttttcaagcagtgtcagctaaatggtgccatttgcttatcactcttctttttggttatttatcctaaagataagaacattagtaagccgtaaatgcccattttgtaaaaactgcatagctagacagatttgcaatccctattagggtaataatccatctgttatggaactggatcaattttgtaaattaaatagattaaaaagggggaaaaagggccatgacttttcccacagtaagccttttctcaaatgctaaaaagatttgggaagactcaaactatttgccattcttcctctctttgcttaactcagagagaaggccaaatatctattaaaaagaggggtgggtgcagttgtttttttttttaattcttcagggtctgattgctcctggaagtttcatatttttgacagagtttattgttaaaaccttttgatgactaccagaacatttctgctgttctcactgatcagtttagtaaatgtgtgactatgtttgaattttcttctgcacttagctcactttactgttactttcatcctgtctgttcaaaaaaaaaaaaaaaaatctcctgatgattcttctaacaatgtgtgattggaataataacttcacatgttgaagagttttgtgctgcagctgagaggcatgtaaatacaagctgcttatttgcaagaagcttccaggtttgcaatatgattgctatggaaaccacataatgaaaaccttataaccatctgtgtggtttgatggattttactgcatagctgagctgtttttgtttactgttattaaaatgttgaatggaatatattaactcacaaacattgactacttgaggtattaattagtattgtacaatgacattgtgcctcaacaccaaaataatacatatttaataataaacctaaataaaaaaatatgtgaatgtatatatttctaatatattgtgaaggtgattattgcctagaattttggtcacttgttcttacatatttttaagagctttattctattaataaatgaatatgttaagatttatttgtatgatttttttaatccatttgtttattctgtatttatcgaacatctcctttgtgccaagttctattcaaggttcagtctgaggtttttttccctgcctaagattcaaaaacatacaccatatttgattttgttatcttttatatggaagctatttgtattgttagccaagataaaatgagttgtttaaatattgttaagaaaaattgatatattaaatgcataaagctttggtttaaaaatatcgctaccaggtttaaaatggaaaaaggaagtgtccttaatgagcatctcatcctctaaaatctgcttattaaatggcatcttacatggatttcaatttggatattttatagtaaacattaattcttaagtaaatacttttaatatcattattctgataatttaagagtgcatatttctaagaacaaagctctctgacaccaatatacaatccagagcacatgttactggcacttaagttttaataaaataaaaaattcatagtaacaaatacttctaaattcattgttaactttgtcaaagagcagagttttttcattaagtcttgtaatgaatttttatatgttcatgctgatttgggtggtgaaatctaaatcccacagtctctttttttttttttttttttttgagatggagcttcactcttgtcgcccagactggagtgcagtggcgcgatctcagctcattgcaacctccgcctcccaggttcaagcgattctccttcctcagtctcctgagtagctgagattacaagcgcctgccaccatgccatgctaatttttgtatttttagtagagacgtggttttgccatgttggccaggcttgtctcgaactcctgatctcaggtgatccacccgcctgggcctctcaaagtgctgggattacaggcgtgaccgaccatgcccagcccccacagtctcttcttaaaagccactaataatacttattgtattgatgcggttatagcttttgactgaggacgagtgcctttatccattttttaatttatttcttactattgaatttgtgactaaattaaaaggggagtgggtgctatggaaagaaagtgtgaaaagtaaggaaagctttctccttcaccttttaccaaattatctgtcaataaaatgagtaggttggaataatgactgtaaacgttccttctacctttaaaaatttatatggaaacaccctattaacccatttattaaagctagcctttaaggtttggcataagtgagataactattgttaaaaagaaaagagacaggatactttttaaaagagtggtatacttttattaggtcttctatatatttgactgaaccatattaaattgtcagtgttatgtttaacaatatgaataaaatgccagatattttcaggtgtcccttatattggagttgtcattattttgtttgaattgagttacagaaattcagaacagttctatttgtcgtgtaagtacagctaccctctcaagcttggttgaaatgctgattttgattcatccccatttaacattttcaggagactcctaaatttccacctgtagtcctgactgctctaccatactttgcagttgcccagacatgttctctgggttgcctcaccaatacattaaattcctcctgttgaaaacacaactctttgtgttccccagtaagatagattattttggctatcctccttttagtaataatatgtccatttctcagttaactaagctcaaaaccttagccatcctttgttgctcttttcccccccctcattcctccacattcaggcacaaagcttatccattctagttcctttacctcttataaccatctcctttccatttcctttgccccttcagttcaggacttccttcccctttatccacagtagtctctctcccgccccttttttaggctgtctgagacaatgggatcagatgtccattcctgaagcatagcttcagtcctgccctttctctgctcaaaaaaccttcgaaggctcttattgcccaccaaataaaagcctgcagtccataacaagatgttcatggcccctcaacagctggtccaaactatgagcgtaactcctacccagctcttcccctatgtgtaccagattctttagtcaaaatgaatatgaacatgcctttttcttttaaagatcatacctatccctccggaaatatccttcttatcctctctccttatttaaactctctccatcccttggagcctccgtggtactccctagttggggggtttctctgctgcacttcttcagtgctttgtgcatcacttgtcaggtttaggccccttcagcctgttttcctttagagcttgtcttctgtcccatctgtgctgtcagcttcctgtgagcagaggcttcctgttacttttacctccttggtagatctcttctgtctcacagttagttaatatccaatgaagattgattgactgattgattgaatagttacaatgactacatttatatattttgcatatttttctttaaagttttaggagttttcttgaaattatgattctctttgaatccagtttttctttggcatgccatttgtttatatgtcctgccttaagtatttctaggtttgtatgcaaatccttaggtgaggaaaaatcatgtaataaatatttttcttggtgtaaatgaattagtttattaagtctatttaaagctcttctcatttaattttatcttatttctttgcataatttggggaaggaatggtataggtgagtgtggaacaaatgtaaatggagcactgattatatgtaggataaagaacattgactttataatcacaaacttaagttcgaatgacacactttggaagttacttcacctttttgagtctctaaagataaacttgtctgtagaatgaggattaaaaattatttgtctatgagattttaacatccagcattgtatatgacacataataggtccttggtataattttgggggaattacctcaaaggatgaagatcattatagtatcttcctgtgaagattgagaaaacgtatgaaattatgtgatactcaaaaaaatgatttataggttaactgcatttttaatcacacatttctccttgctatatgatgttttagggaccatgattttatatatgatactcctgccacacagtacaatgtggtgtatcagtataacgctgggtgttactttactggatttaagggttttcctgaaattaagattgttccagatgagtttctaaaagtatttaaaacaaaacatgcagtgcattagtacatatcttaaattttgccaagccagttggaaaggttgctatttggaagtagctagtattttattggaaagttggaaagtttgctatgtggaaagttggaaaggttgctatttggcagtagctagtattttatttattcagtgttagattgtcgaaaaaggactgtgaatcttgagttattttattctttgaaaaataatgtttatgtgttataaacttttagttttgcttttaaaattgagtgagtactgtagtgttatccctgagaaaacccttcaatgtgccattgataatgtttatttacagaagaagaagaggacagtgctccagtgaaagtggaagaacaaaggaagatgagtcaggatagtgtccatcacacctcaggtaatgacttgtgtagcttcttggcaaaccttattttgcttttgttcactttcattttatccatgttcttactgttctaaagatgtttacacagctccccaaagttggcatttttggcttggatatcttatggctgataagctgcttagtcccatttaggatgcatgaaaaccacttgagaaggatttataaagtaagccaatttatacaaggtattccttcctgaattactttgtaatgactcaattagctttcatttctgcacaaaggagatttagttgcataaattagcttatcatcattgaggaagtgtcactgctaaaggacagtttatagatacaacatgcagttgctgtcaaacctataagaatgtaatatagacatctgtgtatactttgtgcttgagcagaacagacttctgccattcagagactaacaggggacaacaagttgcccaggggactggcaatgtagacatctctgaaaaggtcaacttgacacaggctctgacagtcgacccacagctctgtcttctttgataaaaatcagataaacttaagactgctaattgatctgcagcctgtttaaatgttggccatgcatatcttcattgcatatgattaacacagaaagcaaatgaattgggtaagaaatgccagagtccagtgacagcagcttaaaaattggaaaaggacactagtggcctaaaaggctaggaaggatgttccccttatccatttccacttggcacatatccccaagtactaattatgaatgagactggaaaaataattgcacacactctgtacaaaatcacatgatacggacaacttttcttgcttgttgttatttccaaatagcaggagataaaccatatctgtagtgcaagcatgaggttagttttgataaaccagcaattattttacacggaaagaagagaaagactgccttcttatcaggactttacacctcttcatagccacatgtcagctggggcaaggtctgccatatcatctctgtgtcttgcaaaaagctagagttagggtcaccttcccctctctgatatgtccatacatcactctttcaagctgtcaaggccgggtggacaagaagtgtgtgttcaggaagtagctttccagagtccttcctactgtgacatgtggaaaggaaacagaggcctgattctagacctggacaggaaagcagaagtaggttgctacaaaaggttttggttagtgttttttcagaaaggaagcgagaacaaaatctttacatgttagcactctagtcctataaaatgaagctataaaacactgaggcttagtgaaaccttgaggactatgttcaatagtagtttaagtatatatgttttcggtttatgtatcatgaaacttctgccaaaaatatgtagttttctttttaagaaaatttcagtgcaggtatagaaagtggatacatacagatggttcttccacagatacaaatattttggcttaaagcaattgtatttttcaaaagcccttttaaagtaaacatctcccaaatttttgcctttgagggtaggaaaaaaaatcagttttcctcaaaggaatgcatcaaatagatctagcctttcatgcaatggctataaaacactacaataattcttatctttagtgacatgaaattcttttcaagcaacagttttaatgcttttgcatagaagtgacctttgctcttccctaggctgtcaaagatgtaacactagaagtttgtttgccatgcagggcagtgagttgacaagggtattactatcttgctgagcatcacatgacatgaacttctaaccttactcaagaatgttatatatatttcacattgactgattttactaaaccccccaccacagacttttctaatgtaaagtatgtaagcaaaaacaaaattaatcttgtgtttcttacaagttccttcatgttcaaacttatatatcttgcagatatgtggatgagtatatatataaaataaagattccatttgattttttttgaacattatagaatatatttacctttctaaaatagtttttaaaccttttaacaccaaaggagagattctccactatcttattctcatatgtttcacccgtggtcatcatgtttttcatctttgcaaagtatctcctctgtctacatgtttcataacaattctgttagctttgcccaatgatctcttcttgtatgtttttaaaagcaggagtaaaaacattgttttaatctttcacaggctggctaattaatttttttctttcttacctttttttaatcattcatgcttctcaggacaagaaacataatgtagtttttttttgtaatttttaaaatatagatcatgatgtggatagaataggaaaattaatccatgtagtaaagccaactaaacatacttaatttgtgctttaaaatgtatgtttatgatatttgcctcatcccatctttaaaaatacatatctcaactggattatttttcagtgtttaggggtgaacagtgttaacttttgcaaacctgcgcttttgaggctgtcggtgcttaattttttgtgtatgtttagctacactttaaattttaaaaagtaagctagaggagattgctgccctttaaggaacaagactcttcctgatttttgtgtccagatttcatatcaagaattcaaacattacttccctgagactaaggctaataaacatatactgccagggttttttttccccctacttacgattttttctgctttatagctagtattgcatgctgaaatagatagactagtaaatcatacatgtatgtagctgtgtgacataaacaaattattctttaacagagctctcatacgggacacaaaaatgaggttggtctttgggtaacatcatcatcaagattatagaaagcacagttgaaaatgcatctttttcccatattgccaaatcactagctctgttgcctctttacagcagtgagatttaatgaaatgctcatgatgcacatctagggagagatgcatcttgcacacggtgggggtctctcttcccctcatgtgctcctgtaactcccattagtgttaatgggagtttcagcaagcgtatcgaggggaagagagaccccaaagtgataaggattatgtgttagaaatcaccatatacttttcttttccttctttctctcccctcccctttgagaatctattgaataaaaactattgtaagagaatctgaaaaaaaggaagagcagcctggacagctggggaacgcaatgggacaacatagctaagccaaaacctctactctagtttttagtccaagttttgtttcttccacttttttggagcaagcctaaggctgagcagcatggggaacgcagactaaagaaaccagccatttagatccttttacctcctggccagttactgtgggggagggcctcgcatgttactgtgggggaaggccttgcatgtgaaatgatgtcatcctctctttgctctaattccctgacttttaaactgacactgacagactgcaaggggcacaacatttgacccatttaccaattgatttaatctgactagaatgtttcaacttctaaatctctatttgtctaaataagtggtttttaaaggaaatcagtcactttattattaagtgatttttttcttttaaaattgacaatgtttgaagtgatctggccagctgcagtgccctctagtgtccatttttataatttacttaatatatgctttggggaaaaaaatgtaatgaagagtggccacaagcattgttagttcttggttggattcccaaccttgtgtacatccctgcaggtacgtgatgagtgctcagatgctagtgtggagaagtcaataaggtatctgtctctcccactgcctcctcctttctcttcctccttctctctccactcccattgtcccttgtttttttaattcttagaaaacaagagacaaaatttaatagagggattttactaggttgtatattttctagtccatctttattttcttataagcaaaaagtagcattctatttgctaaatattcagactccatattattcagattctcttttttttggctttaaaatatttcttatattaaagagaattttaaaattttctagtaaacctaacactttgtataaatcacaaaaaatgtgtaataagatgaacaccctaatgacatgctaatctgactagttgtgttggaatcaccaaaaagcctgctgtttgagagccatgtaacaatactgagatgacaaccctggtccagcctgtgtctccacagttatcccctcagaattcaaagatgacattccagtgatggaagttgttagcacgtatatattctgcctggctagtgaacacacggacatcttattgatattacttgcattctttttgtgttaactcatcaaaactcaattatcatgaaattgaaaacaggaaacagttcttagtgtaacaaaagcgtctagtgtgtttagctgtgttccgtgtttcaggagatctgcactgtataagtgacaaagcatttattacccatttattgtggtcttacagagtggaaagtgctaaataatcaatcagttaatggtctgtatggcagtttgagcacatcacatccattgtgcttatgctgttagaaggatgagctgatactccagtgtatgttgcatgtttatttagagcctaatgtcctaaaccggggctgacaaaaatcggttgaaaaatgcagcttcaacactggcaatttcaaagttgctaaaaattttcaaagataactttggctttgggtacaaatgtccctaaagaaa[450 bp omitted]ctcaggacataatttttttagactattttagtgatctagggcatcatttaatttctactggttaattttgaaatgaggggttattacatgaaggccctaattcatgctttctctttcttcttcctaggggataagagcactgattatgctaatttttaccagggattgtgggattgtactggagctttttctgatgagttgtcatttaagcgtggtgatgtgatttacattcttagcaaggtaagaagataccccaaaatgacgtttgtaaagagggaatacaaagctcgatttttaatgcatttggatttacagagctagggaagaatgccaattggaattcttctaggtccttgttaacaattgggagttcacaataattaattattttgtcaagtgaaatgtaatcaaattttaaacacaatcagataacaggattcaacttaacagtgtgtttacctatcacttcagcccttggctgacatccacctactgccttctccagaaacaatatacttatgtgaaagttaacattgtaaggtattagattatttattatgcttttctttcctcttcctttttattcttctgtgtgcttattctgattttgtctgccattcactactggaaacactatgtttatagaacaagtttttcatctttatgtaaatatgttgggtgttccggcaatttaaaagcaatgcttttctattcagacaggcttaggtaattttttaagttgtttagcatactatatttgtaaacaaaatggcaaagtataattctataaacccatcttcatatatatatatgtatatgtgtgtgtgtatatacataaattcttgtgtctgcttcttaaaatactggattattcagaatctttttgtccttagatctaaaagtcaagtttcttattgtgattatacttttggtaatgtatgtgagctcccttaattttcatattttaatttcccctatcgtaatatggggatttaaaaatttccctctgtctacttacaagactactttagaaacaaatgatgtaggaaaacagttgaaatataagtagaaaaatgttaaatcataagtctaggaggttgatgtggtttctttcttgattagagaaatattttggacttttcagagagatagtatgacttgttagaggcagaagacaatttggaaagaaggccacatactgaattttaacagtagatggctggtgcataaaatcataacacagagaatcatcgaacattagagtgatgagtctcaatgatgataatctaattcttggttttatagataaaggaacttgggtcaagaaaatgccagagtcatgatttgagctgtgtcttgactcccagaccagtgcttttccctttgttttctttcctgtgctccttctttccttccttccttccttccttccttccttccatccatccatcataaagcacctgcagtgtgccaggacccactctgacaactgtgataaaataaataaagccaactgtgataattgctagttagggtgcccaaagctaaggctggtcacttatttctctcagtcttctgctcattagcatgggtttttgttactgttgttcccagaaagatgttttaagttcttggacgctatagatagtcacatcacaactcttgattaagcctgttattaagcattaaattgtcctgagttaagataacagctttttggttaactacttaataaagaaatcaaactgattagtttcagctcctgtcaagaaactttcttggaatcattcctaaatttatatagctcacagtctttttaaaaccaatttagctgcaattgtgtataaaactaaaacgttgattagatttcacttgcaagttcagattataggagtgagtggcatatagctattatactccttttgtaaatatgaaatttataaagcccatgtggatctatttgtaaaaccctctttatgaatcaggttgtctttgttgctgaaagcctgggtagagcaccggcttccagaactggctgtgaaacaagccaccataggcatctcttgtttctactgttgcctcaggaaataattttcagttaacatgaaattaaaagtataatcataggtgtgtatcatacttttaggattccgaaggaggcagttcctgttttgtggagactaattttatttgtgaagcctgattagagaacaaaggttaaaggtgttccagcccatgggaagcacatacttccatctaacatttttaaatgctattatttgggagagagctgatcgaaagtacttcctctgccagtgttttgcaaggcttgaagtttcaccatcatgatcatatttattaagggccttctagagatgtgtaatttacctggggttcattttggagtttgaaaaaagagccaagaaagaagaccctgttcgccagcatgttattacctttggctgaataaggttcagtgttcatcgttactcagctgtggacctagtggaatcaacctggtaaatcttggtgaggataaaaaggagaagacatttagctttccttgatgagatttggacatattctgggctattgatgggtgtcttggctgcgagtagacaggttgctttgggttgagtatatgtttgtctttgaagacttacttccttaccttccttcagacaaattcagctaggaatctcttgagactttctagtagtctttattgacttggccttccagttttattgaaactttggcaaactcagactgtaagttaataccataaattcatttaatatgtgaataactgcaattttgaatgcttgatattattacaaattaagtacaattagtatagaaaccactagcatttttaggtgcctcgcagtgtgtttaattgagtttctcagagttatattaagattttgtggtgatgggatgaaattttacctttctgtttttttttacgccatctagtggctcagaatgagtggtgcaggtaattgcagctgttgtacacaatcaaaatggtgtcataaattcaactttaaatccagctatgggttattactttcctattccatgtcaataaaatattagcattaatcatgaaaaactttgttcatcattctgaattaaatatagaaattgtatatataaggaagaatacattttaaggattctaaaatagtatttgtagagatacaggaaatgtgtactttgtaaagaaattaatgccatgacttgtctgttaataataaataagaccatttaaaagattttaaagatatgcagctttcttttagtaatggactcatttataatttgaaataccaaattatcactgtttgatttaccttctaaaagtgtgtcagttctgaaaatattctttaaaaaggcaacataaaatagtttaagaaaagatgcatactttcaatataaataaacatttaggcaaaacaagaaataaaatcccatgcattataatgaagagtgttttaattttgttttttgtttgtttgtttgttttgagatggagtctcactctgttgcccaggctggagtgcaatggcacgatctcggctcaccgcaaccgctgcctcccaggtttaagcgattctcctgcctcagcctcccaagtagctgagagtgtgccaccacacccagctaatttttgcatttttagtagagatggggtttcactgttctctggtcaggctggtctcgaactcctgacctcaggtgatctgcccgcctcggcctcccaaagtgctgggattagaggcatgagccactgcacccggcaagtgttttaattttgtaaatgtaatggcagaaaaacatttaactagcttggggattaggttgttttcatttaaaaatcactacagaaatatagttttatttaaaaattcaatatattattttctgttttgcaagaaagccttgatggaatgttagctgtgctcagtcaacctgggggtgatttatttattttaggcctcttttgaaagttatacaaatctaagcctttatttttttttttcttctggtgcaaatcaaatgttgcaataaagaaagaagagtaggcagatactgtgcccttcctccttccctttttaacattttccaattagcagctatcatgtgacccctggctgagatagcccctccttcaaagtgtccagcatttccttaggtttcacctttgaacctcactaataataaatctaaacaccgcctgccttaaaaggcaagccagtactttttgctttatacttctattcacatagggttgctgctgtttttttatgtgttaaaattaaaagcttcagtagttcagtggagatttggaaatctcttttttctcttaaaaaatggatcaaatttataatgactgatgaaagcagaatttgtgattttaatgacagttgtattgttagtgaattaacaattggtttcagattcatttgatgggggaaaatcatatttgagatagaaaacctgtatttccttaagaaattgggttgtttaaaataatgctaaatatttttgttagttttcatttcatttttattaccactaaataaaacaggaacataatattatagctaacagtattttcctagaaccatgtttttgaaattttatcattttaatagcaggatccagattatatagcaataggtatattctgaggtcccaaatgcctttttggttatgttattctatcttgctcttctggatttctatcctctattagtttatctttcaatctgtactcatcattaatttgcaaaccacattgctatacttacttttaaagcaataaactatttttagagatttaataacagacaagctatacttcagaaaagaggcacagtactttgatattaaaagaaaaatgagagttaagaattctggaatattttatctagtctagggcatatgcgactagctttgcagcctttgagaaactttttattaagtcaaacacaggaaatgtaggttaagactgtggtcaccaatataaaataaaagggtactttttggtgtatattggttggagtttcaagcagtacctccctttatatctgtttggttgactttttccagtgattggtgaattgtgactgtcattgaccatttgcttctcattgtaagaatgtaaaggttaagttactatggctttttttggcttcaaacctatgttaataaatgaaatgaaagtcttgttgagctttattggcagagggaaataagttactttttagctgtcttagtttttcatttgtaaccgtatgacccagtatgccacaaatagcgtggccaactgctgcagagtaactaggatatctgaatgtgggacatgcattgttgacactaagctagctccaaaatgttatattttatagccttttgataagaagaagtgtttgtatttgtgcttgcatttgtttgctccgatgacatttagtttgtatgctgtcagtatggatgtatggtctagagtacactggaagcattaaccaggccaacctcctatttagtacccatctcctcctaggagtgaaaagcagtttatggacacaacaccatgtcagaaaatgttctagttctactcataggactcctcttgttatctgtttgtgaacaatatgcttaagtacttccctactttctcttacataaattggaggaaacattccagaaaaatgttggcagatgaaagcaaaaggtgcttataggaggcaggctggcagctgcagcccttgcaatggcctgacaggtagaggaaaagccagaaggcagtgtcagagaggcaaggtgagcagaggtggcagtggagggggctgctttggaaaggagcccacctgtaaggcctatgtgatttacttcagcatgaataactaagagtttggcagcagcaaaacaaaaccttaaagaaaagcactacgttgatattttttttaattctcagttgaacaattcatgatttcagccttgaaaatgaggaactccctcagtgtgtatagcatactttcactcttttgagatgtcttcttcctcatccctttagaacatggagctagatattccagggaaatcattaggcatagagactagagatagactactgattaagaaaagttttagagtcgatatttagtaaattatagataagtgacagatgttcattgagtattcagctatcaaggaacaaccagcatgccaggtattgtggctcactcctgtaatcccagcactttgggaggccgaggcaggaggatcacttgaagtcaggagttcgagaccaacctggccaacatggtgaaaccccgtctctactaaaaatagaaaaattacctgggcgtggtggtgcgcacctgtagtcccagctacttgggaagctgaggcaggagaatcacttgaacccgggaagtagaggttgcagtgagctgagattgtaccactgcactccagcctggtgacagagcatgactccatctcaaaaaaaaaaaaaaaaagaacaaccagttaaaattgtaataaaatgttatattcctcaaatacttgttctctttgggagaagataagattctctttggaagagcagggtggagacctgctcataataatcagattgccttatagtgcgtcccaaagtactctgtttttttgttgttgccataatactttgctataccaattagtgggcagggagtgggggagggaatgaaaaagtgtttattgagcatttacaatgtcctgttctaggtacttaatatgctttcacacatataattaatataataaccctgtgaagtagatgatgttataattttacagattaggaaactgatgtgcagtaaggttattatggaaattatctgaggatacgcagctattaagtgccttctccaggtatcaatacaggtctgaccctaaagccttttctctttctactttgctacggttaagtgggacttgattaggactttaacttttcttctatatcagaggttaattgtaattatcacatcccagttctaaacaacagcgaaccatgttattgacagtatcttttacataattaaatcttgtatagatggtcaaaattatttcattttctaatcaacaaatatttggtgaacactcatgcaaagtactattttgagcaggatccagaaaagccacaaactgttattcaaggagactgcaattaagtcgaagagaagaccaatgcataaaatagataatagcaataaaacacaatgtagggtatcagtgttgtagtcctggagaatcccagaagaaagggaagtcagtaaatactggagtaagtaagtaatgaaagattcataggaaatggaacttgaactggaactttatgtataaatggagtttattcatttaacaaatatgaatgcttattttctgtgtctattacatataaaacctagaagaacggctgtgctatggaaaggggtggatggctatattgatgaaaggggagcatagagccaatagacatcagtcattcaggatcacttctttttttttttttttttttttattgagacagagtcttgctctgtcacccaggctggggtgcagtgatgcaatttcagctcactgcaacctctgcctcccgggttcaagcatttctcctgcctcagcctcccaagtagctgggattacaggctcctgccaccatgcccggctaattttttgtatttttagtagacatagggtttcaccatgttggccaggctggtcttgaactcctgacttcaggtgatcctcccgcctcggcctcccaaagtgctgggattacaggcatgagccatcacttctctttccttaccttggagaatggtaggcagccagagaaaccctgtgagaaaccaaatcaacctgatgtttccaagctagtttttctacagcagcttacaccacttttcccttatcttcgcctgtaccttgtgtgttaaccacactctcaactacttactcttcactgaacacagcacattcttttatctctgcaggccttcacgcctgccatgtattgctcctttcattattccttctggagtctcagcccagctgtcactttctatgtaaagtctctcagatcctgctgtaggattagttgcttctctttttacaaactttttccctctcttacctaacattcaatataatgattacctgtttctctggctttctgtctaaactttgaacttcttgaggtagacactgtgtcttaaatatttttgtatcccaatatgttaacagtatggcagatagatgtttactatgcttttaccaaaatacagttaacaacaggaaataatcctgacttcttaaaagaacttagaatgataggatcatagagtgagggggaccttagtgctagcccttcactttataggtaaagaaatcgaggctcaacataataagggaaaaagaaataaaagcccaaaggaaaaatggaccactcctacagagacctccaaagacaatggtgtttctgaggttgtacttccaccttggccctgaacttcttggcagccaaaccaaaaaagggagagatgggagctagtaatttcttttaatcataaaggaaggatcttggcttttcccagcactggctacttaaatattcttacatgaatttctagactctgccctgaatatctggcctcaacaactttacataaataagtgcataagtggcaggtattggcctcaacaaaaacttttcatagtaaatataataaaagattttataaagggaattctgtgagggtccaaatgtataataattagacttattgatatatattaagtacctaagtgcactattgtagagtctcaatgaagaatataaatataaacaaaaaagataaggagctgaaaaaaccaggagattttccattctacctgtcatactattttttgcctttgcaaaattctgtcttaacttctttcagtgcttacaagtaagttaaactgaattcattttttccaagaactggaattagttggtccctgttccaatgtggacaaataccttctttctgcacatgggatttaagctttttagacaaggcacatcccatgtagtacatttgaaaacatggtggcaacagcctgccacaggtgggaacagcatgctccttcagatcgcccactcagctacatgtgaatgcttcagaacaaatgcttgtttcgtcactactacaattctttaactatgcctaatatacacaaaagaaaatacattactattggaaattacatttcttaagaaaatatttaggatagtcaactggtgcatcatccaaaatgaagacttagtctatttaatcatctagtacctacttatggaacatcttttatatctcctgcagtgggaggcatacagattaagtgtaagtccttcctctgatcttaatgagtttgtactttattttagttgaaggaataaaactaatgtacgtaaaatctactgaggaataaatgcttagcttgaaatgagagatataaatatggattagctaattcagagaaaaaatcatgacagctgagtcaggtcttagtcattggacaggatttggctgagggagaggagatgtctctgggaaggaagcactacatacagaggtagaatgagtgtagtgcggcaggttgtattgtgccagctagaacagtgacaggaaaaggttgccagcagggtgggaacaagctaaagtctacagttaatgcagtggagagttagtgtaagtttttgagcagcagggtaaactgatgaaaagagttcccgggaagaacagagaggcaccattgataatgcagtaatccagggcaaggtgatgaaggcctgaattagtggtgccagtgagaataaagtggaatgggtgaacctgagaacagttaatagagtcatgtaggtaaaataccatacactgaataccaaagtcactctctactgagcatgacatgatcttctttgcctaacattatctgcgaatcaccagtctgaatgtcaggttttactctatggtattgtaactgtcaactttgtagaaattggaattaactatagcatgactcagggatataaactaaaatttcttatgagaattcttactgtcagcttccttgtttttgtctctcttgctttaaaaatggagtatacaatgcaaggaggaaaaacagtaattctttgaattagaggaactcaaagtcacacctgcaaagtaaattgcaaagtaatgagattgatctccgtacaccactagagaacttagtgtcttcaatcaggttcctgaatggtggtgctcaaacatcatggaggtccttagagattgtgtcagtttcctcatttaacaggttaggaatctaagattcaagtagttaatgtatagatagtaatagtaaaacgccgaggttgtacagttcctgttgtgcatttataaagataaccttttgaaacaatgaatgtatgagaaatgagaggattcttacaaagtttctaatcggagttaataaaaaagagactaaagaggtagccttgatgaaagtatttatacactttaaataggtatctagttttcatagtattacagtgtttatgaataaagatatcacaatgaagaatacttggaaaacaacagtcaagtccattggttcttaaacttgctgtattttatgttttgtgaataaaattactttcattttcacaaaaggctggtgtgttttgaagcacagatatatgtttggaaaaggacacaaattttttttaacattgcaaacacctgttgctttcaaacacatcggtaactaatttctgaaagggttagtacattattaaatcttttaatgtttcaggtttctgttaagtcagcattcttttaccatatcattcgcagaaagcggattaacatactcgataaatgacagtcatggtgctgaaaaagatttaagtaaatgttggggccttatttaagtgtaaaataatattccagcagagaaagaagatttagttaatgagtaaatattactattatgttggataaagtctctgtttcactttatcataactagtcctttttcctgccttcttacccagtcactcttactgctcaataaatattaattggggactaaaatttcaactacaaaataaaacaaataaaatgactataatggtatgaaaattgaaaacatgggagttagatcacaagcattcactaccgccttactattattttctcggattactgggcaagtttggcttttttttgcttctttgattgccacactacattttgccttgaagccatccattttgcagatattgaatttcttttgagtactatttttatacaataagcatcactacacctctggatcttgatagcattactgcaggaggagaaagcagctttgtgttagtaattacctaacattgtcagaagctgactgcaggcctctttctagtgataacagaataaccgcataatgtagctttatagcacatgattaatagaaaataattacacgtcctacaaagggatgcaatatttcttataaattgactagaatggtttcctgtagattaaaggactcttcattattttatcagtcctcctgaagtacagtcacttgcctatgttagcatttcagctgatgttaagagctgaataggtgaaggataccagatggcagacctccttgtacctgaaaccttgtgttccataaagattacatgatgcttcctaacatttcaaagatttagacaacagcctggtatggattgtctattttttgtttgctaagaagataaagtttgagagttttcctttttgttttttaaatgatccacttgtgactttatagaacaatactataattagtttgtggactgcaaaacaacattgtatcagttgcattattttccactgtaagtaatatatcattcataatcacatttgtttgggggtggaaaagaggaaaggcatagacaggcagattttctttttcagaaggaaaccttgtacaatattgaatgttcaggccaaagtttagaatactgtactccaagaagcattttcattccaatttataggctgcaaatggtttaattgggattcatgttgctcaggaggctcatacagagaatagtaatgataaaagtaaaaagctcctgtatttgcagtcttgtcaacactctaatggctgcagtgtaaatccataaatttgcctcctgtatttttacctcactatatttgatcataatgcattaatttcaaacaggaatataatttgcaattctttacaaatataaggtaatattctggtttttagttttaccttttctgatttaaatctgatattttagagtatttttatcaagtgtatgtttcctatgtttttcaattattttaaattaagtgaagcatttaagattattttagtctaaaccttttttctccctagagtataacttttaagggatttgtttatagttgattaagctcctccctgctgtttaccactatgctttctagttaataaatcttcctgttctaccatagcacagaattctctcaactgtgaagtctgcccttgttgatgtgatttcttgggaactaatttcttaaatttgggtgtgagtaactttttgaaaatgataacatgcctttagttgatagcatagactatgaccaaagtagaatattataaagtaataactttctgtcttgtaatttgaatctaagcattgacccccagattgagggccattctctggaagcaagtttatgccaataatatgtcttctcactgaatgttttctatgtctgtcactggggagcagggggctagttccttttctcattccaaataatcagtttcaaaaatcttatattggcattgaataagagctttaacactcagacctaccctgttaattatccactttgaaatcttacagtagtctgtggaacgttaagtacgtgtgtttttttaagcattaggctttaattgtattcattgccttaaaaatagaaaagggtagttttattaggtacctattaagatataatcgttgctaatcatgactttcagtaagttagtattttcttctgataaatatgtcctacatagattatagccatcattgggttctgggcatcagagtatcctcgttccttatacagcttcgtccactaagttcacactatcaatgaactttaaaagtttaaaacttaaaatcttgagtttactgcctcacaagccagagctgtgccctcaatagaataacaatagcaggagtggtcttttctcccctctccccctccactttgttcttccaataaacctaatcctgatactgcccactgtttgaaaaagtgcctatggattttatcctataatctctctattgatagactacatatcaatacatacacgctaatgtaatgctacatttgtattaaagaattgcataattttcctttctgatggtcaatagcatactaatcaatacaaatattaagtctgtactagtattaacattccctccccacatataactcaatatacatatgcacatttatctatgactcagatgctggaaaatcataacctattaaattacttttgggattgattttgaaaatttatcttatatgaaaaattaaatttgagcactacaatgcttgtgaagagtattgcttttggaagatattattcttgaaacttgaaattcattttactttgtttgtatctcactacacataaataaatttgagataaaaatacattagtcaatctggcagacatatgagaccggttatggagtattcacaatgcctaaagcagtggtgtatctgtcaaaggaggaaaaagtgggagaaaaggaggtataggtttgtttatctcaagttgcaaagtaaatgcaaaagtgactcatcgaccactctgttttagaggtagattaatattttgcctttataccttgagatacttttatttcctattgatcttccactataagggtgactctaacagcacctttaaattccttctacctattctttatctaaggtagtttatggtcaataataaaggaataataaatgccttagggaaactattttaaaggaacctatttgtgaattattttttaagcagttttttggtattattagtgtttccgtattctctaatttatctgttaaagtgtgtatattagattttcttaagaaggggcacacatctatcaacattctaaatcattttaggtcatataagtttaagaaataagtagtttattgtaaaaaaaattattttatccttgctagatgataagcttcttgaaggcaaatataatagcttaaggatcctggctttaaccttctatagcctcttacacatgaaaggtatccccaggctctgtggagagagagagtgtccccgagagaaggcttcctgaggtagtttcattttctaggttttcatcatgagtgattgtttctgtgttctgtgcccaataataaacaggctttgtgttataccttaatttaaatcgttgcctaacagcattttaaagtgtccagaaacaaaaagatgaaaatgtttacatttgcagctcaagctcttttaactttataaatagaaataacatttctaagaagttgcatacaaacgacattgtacttacaccagtctaaaggttaatattgcatattgttttcaattaggaatacaatagatatggctggtgggtaggagaaatgaagggagccattggcttggtgcctaaagcctacataatggagatgtatgatatttgagagtcctgggtaagtacattttaatccaatattctgtaatagctcatatgttctcttggtctcttcgttatgagtctttgcctttttaaaagtctttagagttttctgataacacaaagattgtgccccgaaatcttttttgttttgtttgatctggtttaatttttaaaataagaatttttaaaataaaaactttatggaatttactttggaaatgaatagattatttagagaaagttcttttgatagtaaccagctgttttcccaaacttcctccttttcagtaaaataccactttttatggcctttctgaagagttgaattgacaaaatgttgagtaaaaatacatttttccttggctaaaagtgtaatttttttaagcaggaaaaatcaagtttcagctgaatcaaaaattaaaatgcagctttccctttctcctgcagaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgca

SEQ ID NO: 38159 - DNA, 50534 bp, Homo sapiens; identical to SEQ ID NO: 36044

SEQ ID NO: 38160 - DNA, 114923 bp, Homo sapiens; identical to SEQ ID NO: 37326

SEQ ID NO: 38161 - DNA, 353946 bp, Homo sapiens; identical to SEQ ID NO: 36466

SEQ ID NO: 38162 - DNA, 13378 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggtgaggagactgacccccttcctggccccaaggcctccttcctgcctggtccccaaggcctccttcctgcctggtccccatcggcccagcgcccacccagccttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgaggtatgcttctcacacctgggtggtcatcgtaatcaccagggagtcttttttgtataaacagtttgggggttttaaaaagccacagtgagctctcctgtcgctcttcagcccattgggtcaaaacacaaaagttgaacaagtacttgaaagaagtagttggaggccaggcgccgtggctcacacctgtaatcctagcactttgggaggccgaggtgggaggattgtttgagctcaggggtttgagatcagcctaagcaacatagccagacccccatctcataaaaaatagaaaagaagacgaagtagtatttacaaatggagcagaaccagagtccttcctgaggtttcacttggaggctggatggagttggcggaggtatgagcctcccagcaactccgtagtttatgtttatagccagcgagcgctcagagcttccgtgaaccacctcaagtggaaagggttcaatccctattctcaagctttcctggcaagaggagtttcttttcttttttcttttttttttttttttgagacggagtttcactcttgttgcccaggctggagtgtaatggcgcgatctccgctcaccacaacgtccgcctcccgggttcaagtgattctcctgcctcagcctcccaggtagctgggattacaggcatgcaccaccacgcccggctaattttgtgtttttagtagagacggagtttctccatgttggtcaggctggtctcaaactcccaacctcaggtgatcctcctgcctcggcctcccaaagtgctgggattacaggcatgagccaccatgcccagccgccaagaggcgtttctaatctctttgggtaatcagacccttttagccaaaggttcgggggcttaaaagagcctgacaactattgagatctggcagctgcctggaatgcagctggagcacagagggtgggaggtgggaaggtgctggggaagctaggagagtcagctggggtcagctcctgcagggcctagtaggcctgggtgagaagcttgtgttttattctaagtacagtggaaaccaatggaatgatttttatgtaaagtgtgacgttttaaaaattaccatcaagctgtctaggctgaagaccttaagaaagaggggtgaagatcatctctgaggaggcataaactactgaggcctctcagtttcagtctgatgctgtttggggaagttacttgtggccttttctcttgaatgtgtctgggtagtggagatgctgtctgcagtggcatctgtttacctctctcctattagcttcgtcagaccatggctaagttccttcaggagcacctggcccccaaggcccaggagatcgatcgcagcaatgagttcaagaacctgcgagtgagttgggaggtccgggcagtcgggggcagtcagggagtggggctgagctgcactgctgcctggaagagctcacacagttctggtaaatgaagcctctctaagaatgcagcccctctctctgaagtgtttgggtctcattgttccagccacatgtgactggctgccttcccctcaacacttattccactctgctccattctgttggcaggaattttggaagcagctggggaacctgggcgtattgggcatcacagcccctggtgagtatagtgtctttccctaaaaagaacttttcttatgtgccctttaagacagttcccaaaagaagcaggaagggaagggaaagattgtgcttaaagaaacccagaactgcatcttttggacctgtgaaagcacccattgattgtcagcccagagaacaggacactcttctattttattagacagtgatgtagagaaggcagagggattaattaggtcattgtggctcacttggatcaggatcagtccaactcttgaactctgcatacttaataggctcacccaggtgatttgggaagtttagaaaactctggatcaagtggttgtcttcatagtacctcagtcttactgcctcccctaatccctataagctttgtcctaccagtggcctctcggcaggaacactctgggcaggtgtgtccctgcagggactgcctgtgtcctcttctgcttaaaccttggagctcatttgggagcagatagcggggggagtagggtaggggctgggcaggggagagagatgtctatctgggcttccaggtgaggtggccagatgatgtgtttaataggctgtccggagggagaaggcagggagctagcaggctctggtttggatgatattaacgtctgaaagaggcccagactggcttgcagtgcccggtaaagagatgagcctaggccaggcgtggttgctcacacctgtaatcccagcactttgggaggccgaggcaggtggatcacctgcggtcgtgagttcgagaccagcctgaccaacatggagaaactctgtctctactaaaaatacaaaattagctggtcatggtggtacatccctgtaatcccagctactcgggaggctgaggcaggagaattgcttgaacctgggaggcggaggttgcagtgagctgagattgtgccactgcactccagcctgggcaacggagcgaaactccgtttcaaaaaaaaaagcccagcctgcttgggcctgtattcactctgggcatgagagtatgagtggaacccaatatacttctccttacatcctagaaagttatatcacctttcataaaatgaaaccacttgaagattaattgaaaccatcttaatgtaaaagcattaggggaaaggctgctgggtactcctaagcaagactctcctactgtgttttgggggtttatgtaccccactccctgcagacaatatgcttctgaatcagattgtattttacggaagaaagaggcagttagaaatcagatgaaaatggccaggtgtggtagtgggctcctataatccgagtgactcgggaggccaaggcaggaggatcgcttgagcccaggagttcaaggctgcaatgagccatggttacaccattgcaccccagcctggataagagagtgagagcccgcctcttgaaaaaaaaaaagaaaagaaatcagatgaaaactctttcaagggaacctgaaaaagaaagctggttacaagttctggtttctgcatgatgtcatggtggctgtttctaatgtcacctgccttcaggctttccttcctgcagttgtaggggcaggtcaaggtttccttagagcctagaacgagcctgacttattggtcagagtgaacatgtgtataggaccttgctaggcttgacccaatcagcagggctgggggtggtatcaggtgtctcagccacttggagtttggatctgctgccaaggaaaaaccgtatattttatgaggagttctgaaattctctgccagcatctcatctgccctctgctgtacagctcacctcaagattttccctgaggctgtggctctcctgtcctgtcaccagtcctgcttctttctttttttttttttttttttgagacagaatctcactctgtcgcccaggctggagtgcagtggcgcgatctcggctctctgcaagctccacctgccaggttcacaccattctcctgcttcagcctcccgagtagctgggactacaggcgcccgccaccatgcccggctaattttttgtatttttagtagagacggggtttcaccgtgttagccaggatggtcttgatctcctgacctcgtgatctgcccacctcagcctcccaaagtgctgggattacaggcgtgagccccatgcctggcctccagtcctgcttctttgggttcagccctatgctataaaatctcaccttcctcaggccttttgcagacacatcagatcctctggctttgtatctgttcttggtgctttggacaccacctccaccccaatgcctttgtttttctccaggccctctttcttcatttattcatctgcctctgcatttctgtaactttctgagtagtgggtgctcaggttgttcacgtatcttcatcaagaagtctgtctgggataaagcagaagttgcaatgattgccttctgaatcacccctcagctgaggagcaccagcaggcaaaaccagtccactgagcttgtaagcaggtctgtggcatcagcttattcttgttgctagagagaatttggagtaggtgctacaaggtgcttcccttctgccgtcaaatgtaagattcttaatgaatgtcccgatttaatctgggctgcgttttccactcccttgtaccacaccactcacagttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaaggtgaggaaatggaaatgtaatacacgctaatctcacagtgcaaccaccaactaaaagataccctctccccttgggggccagtcagacctgctttctgtagcatgctgccatgaaccaaatgtggttaggaaggggccatggattgctttaaaatacttgagccaaaaataataaaaataggaccagaactcttgcattgaacaacagacagacaacatttgaagagaactctaagaaatggaagagtaggactagcttcctttgcaaagggaatggaaaaaggagaggcattttcagccttgtagccattgggcttagaagagacttctaggactttaccgacaccctggtctgagagcgaagtttgaaggggtttaatgtggacaggaagaggcagtaccagtgagctgctctagggtactctgaggttgtaacaaggcctgttgggggttttccttgcagctgatcagtggtgagtacatcggagccctggccatgagtgagcccaatgcaggctctgatgttgtctctatgaagctcaaagcggaaaagaaaggtgaggccactctcaacttgggagccaaaatgggcagaggtacagacattatcaggataatggagcaacaattgtgggtggcccctgctgggtttccagaactttctcaaaggtggacagcttcttgctcagcagaaggtctatggcctggctgagacaggccaagatggcttgagcaaatagccaacatcctgcccttaggaaatcactacatcctgaatggcaacaagttctggatcactaatggccctgatgctgacgtcctgattgtctatgccaagacagatctggctgctgtgccagcttctcggggcatcacagccttcattgtggagaaggtgagtataggtgggtgcagggccaggaggcttctgcctcctgacagtggtaccagagatagcccgttcactgatctcaaatggaatcagtgttgtgtgctctgcaaggcccccagaggtgggggtgaggcagagagcagactgcaaggagggtgaccaaaagtccaggaagtccagggcagatgggtcacttctgaagacggtggagccgtcctcagcgccaggccacacaaagaggtctagaaaggggaggactaaaaggaggtcaggacatgacggtcagggtaccattggtggatctgatgaatgtggccatgggagactgaggtgtgggtgggatgcaagtggagactgcccctgcaacagccttgacaacagaagcaagaaggaagcagagcaggagttccaatgaaaagttaggagtttgggtttgtttttagaaatgagagaactgagcagattttttggtcagaaggaaaaaaaagggaagaaaaaagaaaatagagggagaaattgaaaagtgtgggaatgagtgggcagaacacaatggtgagctggggcagaagagagaaggatgggttacaggtgatggtgcaggaaccacttgcctaacgatcatgaggaggaagccaggggccctgtgaaggctggggccacgagtgggggagttggcaagagtttcatgagcgagtattgtaaaggtttgcggtaccctccatagagagggggaaagtagctgtctagggttggagcagtagggacctggctgagattggaaatctcaaggttgcgtgatgccaccctcattacaggctgaaggcagcatgtgccagcactttgctggtcacttgccaaaacatgctgcaacccagtagtccaggtcaaagtacagagggctcagttcagccctagtgggatccctttgggtacagacaggagaacaacagaggataagggaattgaccgggctggtgacagtgtcttggaagtaatgtcccctgggggagggaaataaggccaggggggtcgggagggctcagggaactgagcatatcattgagaaagaagtgtccccatgagaactggggagaacacaagctagtggcagaggaggctgggatcaatctggggcgttagcaccggaaggtcccggggggagcatgggactaggatgctgccatgctgtgcaggtacagggactcaataggaaggtgagtgccttcttcccagaggcctttcctttaccaggcccccttggggctaatctgtaaccaggaccaccttttgtttcctgtaaagggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttagagaggcttggcattgttagcgcttcagtgacatgtggctaggctgtgagctggggctgctggacagcgctccttcctggccagggccctgcagcggcatgcctaactggcatcacacactccgcatagggtctgtactcagtagccggaggagaagggtcagacctaccctttcccattgatgtccttcagtcttcctgtactttcgcccatccactgcatgtgagtaactcattaactcacgtttttgtaaaatattttaaaaatgagttattcatttttagcattaatgatgctaagaaaaaaaaacaaaacatctgaatccactgatggaatcccgactcagtagagagaaggcagttctgcttgagtatgagtattttctcccctgaggtgtaactgaaatctgacatggtggagcactgtgggagagccagcacagccatcatgtactaaccagaccaggggcatggatttgttgtttggggtttttttttgttttttttgtttgtttgtttgtttgtttgttttgagaaggagtcttggctctgtcacccaggctagagtgcagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctgagtagctgggatgacaggcacacaccgcccagctaattttgtatttttagtagagacagatggggtttcaccatgttggccaggctgctctcgaactcctgacctcaggtgatccacctgtctcagcctcccaaagtgccaggattataggcctgagccaccttgcctggccaggggcatggatttgatcaacagttaggtttgctgtctgcctcagccatataccacgcctatcactgacagcccaaaaaagtgtactttaattacagggagcatccagggagggggagctgtgcagctccttctttgttgacaggaaaaaattcagctagcattaaaggcaggtcagtagtgtcaacctgttttcctgcccacacctcccaaggccatccagtctcctggctttactgggtggagaggtgctcagcagcttctgtcactagctctgaatggcctgtctcctggacaaagaagctttcacggactactctgcagggaggtgacattggaccagagctgactccacctgggggaaagagtaattctctggtttctttataggtgcctgtgtagaaagagtcagggagggattgggtgacttctagaccaattaacttttcttctttcccatccaagggagtccagagagggaagggaaagatctaacaactctagcctttgtggttggcctcgtggatggggtgggagtcctggcagctccacttctgactggaaggggttcacttgatccttttctttcacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccaggtgagccgagtgcttttgctgacatgtactcttcaactgggctaaagttttctttgaaaagagaggaagtgaggtgggcaccgtggatggttactgtctcctctagcaaattgagcttgactgcttggaatgcagtcttcctcagcatgcagcctgactctggaagtcatcaggaagttcaccacattgccacctcgattcctgtgtgaggtggatgaactagacattgtaaggttggagagcaaagcgtgcaagttgtgggggcagaagggaaagaggttgctatttgtagttagaccttctggtccgaagaagctgctggaaggtaataagcattggagtaaatggtgccttgggagccatgcctttcggaggcagtgatggccacttcggggtgtcatgcgggctgtggaacagccactctgtggccctaactcccacacctgcccccatctccatcatcctgagtaaatcccatctcctctccatgcccctgcttcctcatccttggctgtcttgttgccattgctgacctgcttttggtaactgagagagtgttccagcatgttgacctgtgacatccctttgtgcccagttgatgcaggggaagatggctgacatgtacacccgcctcatggcgtgtcggcagtatgtctacaatgtcgccaaggcctgcgatgagggccattgcactgctaaggtgagggccagcctcagtcggggagaggcgggggcagtggaccagctgctgagacttgctgtctgcgtgcctcgcagggccctgctgaccccagcttcctcccgtaggactgtgcaggtgtgattctttactcagctgagtgtgccacacaggtagccctggacggcattcagtgttttggtgagtgatccccacttcccagtcccggggctccctcactcctggggcctgtggctgcttcagaaagcagtttcagggcgggcgtggtggctcacacctataatcccagcactttgggaggccgaggtaggcagatcacctgaggtcaggagttcaagaccagcctggccaacatggtgaaaccgcatgccgggcatgatggtgcatgcctgtaatcccagctacttgggaggctgaggcaggagaatcgcttgaacccgggaggcagaggttgcagtgaacaaagattgcaccattgcactccagcctaggtgacagagcgagaggctgtctcaaaaaaaagcaatttcctctccacttctccactcctcactatgtgcttatgctaggcccagctgagctgggaccttcgggctctttctgtcccagttacaaggaggaaatggaaagcaaatgagaaaactgctagatgccaggagttgctgctgccttcggcaacacccccctctcatcctccccgcctcatagatgctaggaaatgggaaagggagatgtggctgggcacagtggctcacacctgtaattccaacactttaggagactgaggccagtgaatcacctgagatcaggagtttgagaccagcctggccaacatggtgaaaccctgtttctactaaaaatacaaaaaaaaattagccaagtgtggtggcaggagcctgtaatcccagctatttggaaggctgaggctggagaatctcttgaacccaggaggcggaggttgcagtgaccggagatcgcgccattgcactccagcctgagtgacaagagtgaaactccgtctcggaaaaaaaaaaaaaaaaaaaggccgggcacggtggctcacacctgtaatcccagcactttgggaggccgaggcaggtggatcacctgaggtcaggagttcgagaccagcctgaccaacgtggtgaaaccccatctctactaaaaatacaaaaattagctgggtgcagtggtgcgcgcctgtaatcccagctactcaggaggctgaggcaggagaatcacttgaaccttggatgcggaggttgcagagagccaatatcatgccactgcactccagcctaggccacagagcatgactccaaaaaaaaaaaaaaaaaagctaaatggaaatttctagaaatagttcataagtttcaaatccacaccatcctgaatagcttgaagtgttgtgccatgctgctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatggggttcggtactatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtg

SEQ ID NO: 38163 - DNA, 93609 bp, Homo sapiens; identical to SEQ ID NO: 37980

SEQ ID NO: 38164 - DNA, 11491 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtgagtcctccgcctggagtgggtcggggggcggactgggagggaggtgcaggaaagtcggaaggcattagggtaatggggccggacggagaccctgggagagcccagccagagcgcggcccgccctggtccgctgtcctgggcctagggcccggtgacttggcgatggggtgaaaagagaaggaggggggatgccggcgccccctgcctcctgcctggtcatcctctgcgcggtccctgcggacactttcaggctcaggtaccaggtaccgaggggcctgtccagcgccacttcaagatcgtgatgagagggtcgctgctccccaggactggcatcttcgctgctctggggcctagctaaccgttcgacccggtgccagggcgctgagcgggcatggcttgtagggtttagtgaagaggattctctctagcctctattccaggcctggggccgccaggcactcctcaccctggtgctgttgccaccagtgcctggccgagcgggaggggcccgagatgagccaggagaagggagaattggccaggaaagaggctgggacaccaactcctccttggaactttcacttcccgctgctgtcttgggccgggaccgagagggcaggcgcgggtggagtgtccggaggagagagggccattgtgtgttgggggggtggggggtgctcgaggaggaagcagaggctgtaggcagcgggtgtgcctgactgggcatgagggtgtttagggaggtgggggtgtttgcactgctcacccagaaatgggcgttcctggcatctccgatgtgagcgaaggggagggtgagcgggcacccggccacaaggcttagctcagtctcgagagggggcgttcctgaagtggggggagagtgattgggagggagtgggaaccggggagggtcctgtgagaacctgggattggccggaaggggacaaggagggccacaggctgcgcaagccgaaagtctttcttggggacttgtgaatgggttggtgggtggaaagccataaattagagagacaccctctccttccagtattcttctttaagtctcagcatgcaatgtggaagcccctcaggtacctaagggtcttgatgggctgggagctggtggatctgagggcacctgtcacccccagccctgctgtcgattccctcagtactgtcttggggtgtcctgggacctgcaggtggcactgaggagcagcaggcagagtcagagaaggccccgagggagcccttggagccccaggtccttcaggacgatctcccaattagcctcaaaaaggtgcttcaggtgagctctcactcccctctaataaataaacgaatccacacacgccccggtatagccaggtgtctcaaagccaaagcttggctgaggagctggtgggtagagctcactgtagtgggtctatcccaggcccagctgcctctcccaccacaccccagcacctggcttcacttatctccctctccctctgcacacacgtgtatctgtctgcctcagccccacccaacccatccatctccactggggaaattgtgaagccaaacttgctttcttcatctcatgttgtcggttttctcagtggggggatttggaaagagtcaggaccttaccaaacccccccccccccaccccattctaaagctgagtcagaggaagggctggggcttgtgctgggtcctacacggtgcttcctctctgggcaggaagccgagaaggggtggctcagataccttccttgacctccgcacacaaccccccagaacaatgctccaggccaggcagggtttcctggcccctcccctgggatccccccaccagtgatctaattgctggtgctcttctgtgggcctgaggttttctggttagagaggctgggagttgtggacaggtctagggaggtgacctgccctctggtgcccacagaccagtctgcctgagcccctgaggatcaagttggagctggacggtgacagtcatatcctggagctgctacagaataggtaatagtgatggtggcaataacagtgaccacatggccaacaacttgtatagcatttattatgtgccaggtactaagtgcttgtgctcatttaatcctcataacagccctataagggatatactatcatgtattattgtcctcactttatacatgaggaagtcaaggcacagagagattaaataacttgccccaggtcacacagctagtatgtggtgaaaaccagattggaattcaaataaactaacagagtcagtggcccaaccagtatactttgctgccccggggtcaggagtggaaaagttggctgcgggggttgcctggtccccagccccacaaccaccttcaagcctctgcttgtcaatgcacgacctgggaagtggctttagcactgccttctttttcttcactccacagggagttggtcccaggccgcccaaccctggtgtggtaccagcccgatggcactcgggtggtcagtgagggacacactttggtgagtcaggccctcttgtgccatttttggcttaggggaaagagggagggggtggctggaaggtgagaggacactgcatatttttaccgtcaagctaggctcctcagttccagtcctggtgtgctctctgagacagcactaatgttgttcccatgctgcaggagaactgctgctaccagggaagagtgcggggatatgcaggctcctgggtgtccatctgcacctgctctgggctcaggtatactgggcggatttaatgacagtagagaaagtaaggagacccaggcatggagctgaaatgttctctgactttcttttttcttagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccgggtgaggatgaatggcaggggggtgggctttggttgtcttgagggctgatccccagacacttagagctatgtgtgcacagtaacaacagctcctgcgaatggagcactttccacatgctgggcactttgtgaacattagctcgtgtactcctcccatacctaggaggtaggtgctatcaatagctctattttaaaatgacgaaaccttacaaaaagtatctgggcatggtggcgtgcacccgtagttccagccactcaggaggccgaagtggaagaatcgcttgagcccaggaggcagaggtttcagtgggccgagatcgagccactacacaccagcctgggtgaaagagtgagacctcgtctcaaaaaataaaataaaaataaaataaaataaaatctagctgagacagattaggtggtttgcccgaggccctacaactaataaatggcctatccatttattagttgtatttggctcttcatctgtcttatgatcccatttgcagagagctctcacttggttatagataatacatagttaccaatgatgaagcaatataaacccaatttcctaatttgtaaaatgaagataataaaactacttgctgcatagagttgctgggaagattaaataagtccatatagatgtaaagtgcttaaaactatgccagacctatggtaagtgacaagagttgttattgggatttttaaaaattattattattattattattatttgagacagagtctcgctctgtctcccaggctggagtgcagtggcatgatctcggctcactgcaagctccgcctcccaggttcacgccattctcttgcctcagcctcccgagtagctgggactacaggcgcccgccactacacccggctaatgttttgtattttttagtacagacagggtttcaccgtgttatccaggatggtctcgatctcctgacctcatgatccacccgccttgtcctcccaaagtgctgagattacaggcgtgagccaccgcacccagctaaattactgttttttaaaaatttgaaaaaaaccactgagtttggagccagaaaagcaggggtctactccaaccttcattatctacttcctggtcctccttggcaagttcctgggccctctggccttcagtggctcatctgtaaaatgggctcttcaccctcctatttgacccacagagtaggagtggctgcctcttggtcagcccggcacagctgctggctgcgagcggcaggtttgcctgataattcttcttgtccatagtagaggcgggatgtggtaacagagaccaagactgtggagttggtgattgtggctgatcactcggaggtgagcctgctggcccctgcacatcctcctccccctgcactgccctgccgcctttcatgtcacctctcttggcctacaggcccagaaataccgggacttccagcacctgctaaaccgcacactggaagtggccctcttgctggacacagtgagtgctggacagggcaacccccaccccaggcccctgaccatggcaacccctcttctgagccccagctgtctttcagttcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgacgtaagggccccagactcagccagagaggccagtcctgtcctggccaaattcacaccccttcagcaccctacctcagcccctgaagctctgaccaccgtggcttctggccctgaactttagcctctctgtcccacagtggtacttcattctctgggcctacggtgggcatggccattcagaactccatctgttctcctgacttctcaggaggtgtgaacatggtgagttatttccaggtctcctcctcattcccaattcagttcctcccaagtgtggtggcatttatgcactgaaacccccctataaagttgcccaaccccaaagctacaggtatagagggtggaggtacgtgatgtggcctttgctatcagggagccctcgcttatggccagctagtcacagtgtacacagtcatcccctgtgcagtcttcccatttcttagaggagggtaggaggcagctaaggcccaaagaacagaggtgatctccctccagtgagggagggggacagagctgagctagaacccaagtttctgccatccaggcctgggttctcctactttagaagcaattcaggagggaagcagtgcctgctgagtgcccacgaggtcagacgtggagggaacaggagcagagagggtggtctgggcattgtggtggaggcaggctgggactggacctacagtacccctccccaatgacaggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagagtaagtagctgcaggatggagagagggtgtggggcagggggcagggagaggcccccagccccaaccttccttgccaccctccccagcttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgtgagcccctttcccaaagcctcgccccactcacttctgtaccctcaccctggctcattagccctatcccagcctcctgagctcttgggttctgaagggactttccacccctctcctacttgccctgtctgtggggacagcacatgggttgttgggctctagccctcgcttgctgtgtagcttctggtcttggcctgtgggaggaggagagattggagggaggctcacaggccccacctgctctgatgcccggcccccgtgctcctgcccacaggactgcgtcgatccctgctgtgattctttgacctgccagctgaggccaggtgcacagtgtgcatctgacggaccctgttgtcaaaattgccaggtgggtagagactagactggccacccggagctcacctgccggggccaaggtggaaagggtcattctgacccccggctggatttgctcagtgcccacactgatgctcatccaccctccacagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctaggtaagtgaggaaacctggctcctcctttgggtttctgagagccttggccctgctcctactaactctgtgtgcccttccccctccccacagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgagcagcctgggtgggcaagaccaggtgtgagaagggacatttggaccacaatgaacagagcccagacttcaccattcaccaatgtcaaaggcagggactccaagggaagtcagtttcttacttcagatggagcaaagtcctatcaactcactatgccttggtttccccatctgtaaacgcagggtatggcctcaaccttattggcctcccagtcccattaaagctttgtgggaatctgatccaggctcttctctccctgggtcaggtgtgtatagaccatcgatgccagcgtgtggatctcctgggggcacaggaatgtcgaagcaaatgccatggacatggggtgagctgggatgggggaagtggaaggggagcagagagcctctagagaggaaaaggatactgggctttggaaatagacatatctgggttttaatccttgctctactacttcccagttgtgtgacctcgggcaggttactaactttgctgagctcagtttccccacctatcaaatggctataataatagtatccccatccagggtacatgagatgagtatgaaagcatctagcacaggctgggcacaatggctcatgcctataatcacagtttttttgtttgtttgtttgttttgttttgagacagagtctcgctctgttgcctaggctggagtgcgctggcgtgatctcggctcactgcaacctctgcctcccaggctcaaacattactcatgtctcagcctccctactcgctgggattacagtcacccgccaccatgcccagctaatttttgtattttcagtagagatgggtttcaccatgttggccaggctagtcttgaacttctgacctcaagtgatcctcccgcctcagcctcccaaagtgctgggattataggggtgagccactgcacccagccaaatcacagtactttgggaggccaaggcaggaggattacttgaggccaggagttcaaaaccagcctggtcaacatagtgagacccccatctctttcaaggaaaaatttaaaaattattcaggcctgctggtgcacacctatgctcccagctacttgggaggctgaggcaggaggactgcttgagcccaggagtttggggctgcagtgagccataattgcaccactgcactccagcctgggcaacagagtgagactccatcttacttgctgtctaaaataaaataaaataaaacaaaacaaaacaaacacaaagaaagaaagcatgtaccacagtgcccagcacacagaaggagctcagtaagtgttagtttgatctaatttgctctggtatggataaagaccctccctccgggctgtctctacacacatacccagcacaacccccagttgtagaaatctgagatcttgaaaagctagagacaaggaaatagttccagagtgcagagctcctcattgctcgccttgtacctcctaggtctgtgacagcaacaggcactgctactgtgaggagggctgggcaccccctgactgcaccactcagctcaaaggtagcatgggggtgggggacaggggcagctgggagggcaaagcgtctcatgctttatcttgccccctcggccctctctttctgacccccctttgctgctggttccctgagtctgtgccccttgaacccttcactctccctgatcacttgacttcactccctgccccctgcgccttcatggatctagagttcttagccccgtcctcccttaaacctgacttccgcccacagcaaccagctccctgaccacagggctgctcctcagcctcctggtcttattggtcctggtgatgcttggtgccagctactggtaccgtgcccgcctgcaccagcgactctgccagctcaagggacccacctgccagtacaggtatgagcatcacctccctgctaccacttccttcaactggggacagtgctgaaggctgcctcacctctgcagcccctgccacctggttctgagccccaggccccttggaccttaaagttgctgactgccataccccacacctcccttccctatatgtgcccacagctttttacctcacagctgtgcccctgtggggtggctggattgctagggccatttctccccaggagcccctgtgctggataagtagggtcttccctcaagctaataaatactgccccccaccccggccctaccacaattttacctaaaccacacataagtgcctgcaaagggttaaccccactcagggatggcatatggtagaaaacagggtctgaggctgggccctctcccttcttgcctttcctcatgcatagggcagcccaatctggtccctctgaacggccaggacctccgcagagggccctgctggcacgaggcactaaggtgagtcctggatgccagaggaaggggactccaccttggccgggcatccagcttgggccctggggggtgcgcattaaaggctccagactcagagaaaggctagcactgcccaagagtcagtcgaaggagtcagggccagccctgccctcccctcccctggctacaggcagggaagctgagtccagaagagtggggagggcagccagctggagcaggagctgctgggctccgtccgctggccaagaggtggctttgagaggtggatctatccatgcccccagcagtgaccccaggagggcacaagggcagtggtgctcagaatggccttccgtaggcccaggtcaccatgttagaagggctggtgagcatccccaccctgagccctctgcttggatgatgggagtgtgtgcacacctcctccccactcgctccccacctgcatgcacctgcataactgcatgcacagcacccactgccctgggcccctgctggccccccctgggcactgacccttccctgcccactctgtctctctgcttcctcttccccctctgtgcctatctgcccctcctgccctctcagcaggctagtgctctcagcttcccggcccccccttccaggccgctgccgcctgaccctgtgtccaagagactccaggtaaatctgggccagggcccgccctgagccaaggcaggtgggaggcttggtacccaactgcagttctcatccctgctccctgccagtggtgctcttcattaggtgatcggggtgcccctcagccttcagacactctgagccccagaagcagcaaagggtgagcctcctgccttggtttctaccaccatctggtggtcaatggcgggactgcagtcggccagggactgcggttgacctacaccttcctcccctgagacatcagctggcatgcctccaagccctctgcgcatgccctcattctctcctgccccctggctgactttgcatgttgacttgaacccctctggggaatctctgtgcatgtccacagcccctggttatgctctcacagccactgcccctctctctgttcaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacaggtttgtttgcagacaagggtgaccgctggtgctgcccccaagctggtgttccccagcaccagtgcgttgggggtgggcaacatgacacccccccacctaagccggcctcctgccttctctccctcagtctcaggggccagccaagcccccacccccaaggaagccactgcctgccgacccccagggccggtgcccatcgggtgacctgcccggcccaggggctggaatcccgcccctagtggtaccctccaggtaggaggagccctgggcatgggtgggcggggcgagtgacctgggggaaaggggcctctgactcttttttcttggcttcccgcaatccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttc

SEQ ID NO: 38165 - DNA, 14585 bp, Homo sapiens
agacacaatggtaagaatggtgtctgtcctgctgtctctgctgctgcttctgggtcctgctgtcctccaggagacccgagatggtgagtggggaaagcaagggatgggtgctggagaggactggaaggaggtgaggaacaggacatgtggctgggagaagggctggatgcagctgggattccctggcatatggcaggaacaggtgtccaaggctgtcaactccctcagctcacacacttccaggagcattcagggagcctctgccctcacccaaaataagaccttcaggaatctgaatctaaaaccccttagtttacagtgaaaacaaagactccaaagaccaagcgacctgcttggggtggagagccaggacggagcaggaaccacaggcctggagctgcttctgctcctgttccttccctccttccgatggctgggtacacctgcctgacgctgaggaaaagagagaacagcccccaaggggaaagtgggaaggcaggttggctggagggatggtgctagaaggaaacccgtgccctcaccccacactcagacaccactgcagtgggtctggaaagcgagtggccggaagagaagacagtgggagcttggggagatcaagattcatttataggagaggggaaggaggctgtttgtggcatgagaatgtgcaggataaagacatggaagtgaatggcttctcagttgtgtgagtttaaaattcatgccgggcgcggtggctcacgcctgtaatcccagcactttgggaggccgaggtgggtggatcacgaggtcaggagatcgagaccatcctggctaacacggtgaaaccccgtctctactaaatatacaaaaaattagccgggcgtaatggcgggggcctgtagtctcagctactcgggatgctgaggcaggagaatggtgtgaacccgagagatggagcttgcagtgagcagagatcgcgccactgcactccagcctgggcaacagagcgagactctgtctcaaaaaaataaataaataaataaaataaaataaaattcatgacatttacaaattgtcaaaataggtgtttcacgttagttttataataatcacatttataatattaatcccattctgcacccaaatatgaattattcggggttctccagagaaacaaaactaatatacattgtataaacactcacgtatgtatatatgaatatacattgtatattcatatgtacactaaatatatgtgtatatgtataatatacatatatacgtgtatgtatatacaaaacagagaaagggaggagttttatttaatatttcttgtggctcacacaattctgagggctaaaagtcctaaaccagcaaagcaagccagcaggctagagaccaagcaaagagttggtgttgcggtcctgagtccaagggtagtctagaggcagaattctttcttctctgggggacctcagccttttctcttgatgccttccactgattggatgaggcccatccacactgtagagggtaatctgttttactcaaggtctgatttaaaggctaatcacattcagaaactcatgagcaagaatgacttcagtacttaaattagaaatctgccatatgacttccaacattactaacactcatgtaaattatattctaaattaactatggaactaattgtggaaatgtcccactctctcagcttccatcttgtaccaaactgcaagatacaatgccaggaattctgagaggtatcctagccttaccctatgctgatccattctgggtcacttcttgagttttctagtaaattcaccttcctacactttctaactatatgtatttgtccggttagactagaaatgtttatttctcatgtcaagttcaatgcagattgggcaaggttcctctcctccacagggtgactcagggatccaggctgtttgcatcttgggactcttctgtttcatcctgtggcctccacagtcaacgaaagggataagagaccgtaggggcaagccagatggtagagccttggaccagaagaaagacatcagtcacttccactcacattcttgtttgacaaaactcagtcacatggttccaatctatctataaggaggctgagaaatgttaacttcttctgtgccaagcagattaaactctgtagtgaagaaacagaatggtctctgaaatatcatccccagcatgaaagtagagcctgtttccttgagtgaggctccaatggtgtgaagctgatggcagaggagagagctggggaggaagaggccagtggccaggcctcccctcctggccctctgcagccccacaatgggacacccttgcatggaccccagccctcagagtcttttcttttgcaggtcattactctctgacctatctctacactgggctgtccaggtctggcaaaggcacccacaggctgcagggcactgtcttcctcaatggccatgccttcttccactacaacagtgaagacaggaaggctgagcccctgggaccatggagacatgcggaaggagtagaggactgggagaagcagagccaagttcagaaggccagggaggacatctttatggagaccctgaacaacatcatggagtattacaacgacggtaacggtcagtgaacaacagaccgcgggggtggaaggtctaacccaagaggcagccccccaggtgtgagtggcaaggggtcagcaggatggaaatagtcccaatcccaggggaggaacaggagacacagcagaaacacagacatgtccgcatcccaccccccccacagcacagtgttgtccccttccccatcgattgccccatcctcatcccaggtctcaggtcacacaggaagtgatggcagagtcacttcctatctaggcacctctgacctctcacctccactccccacccatcagaggctgatctccccatgagaaggcatcagactcacccctgtccagggaggttgcctggagaatgagccactctcaaagtcactcagacctgggctcacctggtggctctgccagtcctacctgttgacagtgaaatgttcccaaaatatctggtcgaaatctgcaaacattggagcactgagacctatctccaaacaagtctgtaatatttaactatgtctgttctatgaaggatgtcacagtctgtcctgatctcccttgcagctccatcacctagcacagggtacagccaatattggctcaattgaaatttgtggaatcaacagagaaaagcacccagcacacaccgtagcccatgctgggggctcaggaagtgctgcattcaaaaccacaggctgttagagatccctgcagccctaaagttcctcctcaccataagatgcagacccaggaagggccacctgcactgtggtcggaggagctggtggcagagcccgtgcagagacggtccccctgcccccggcccagcgttctttctcccaaaccacactgccagccccaaggcagccaaccccaggcctggtgaactgctggtgttaaattatcatggagtgggtatcaaaagatgggcttctaagtacaaaaatgcccaaggtgctacatgggatctgaaggtttcccaaaggaggcaagagataagcagacgtttgaaggatgagggatgggaggtcttggtaaggaaaatgacccaggctgtgtgttagccataggagaggagggggcacaggtgatcagaaaagacactgggggaagcattgatggacaggaatagaaatggcaaagtggataattacgaggaaggaggatgaagagatgaacacagggtattagaaaataagagtagctgacatttactgagcacttactttgtgccaggcccatttatgagcatatataatgctcagaataaccccctgaaaccgtgcttttggcactgctgtttcaggggtgaggaaataaaggcacaaggaggtgactggctccagttcacacaacacaccaggttggggcgggaagagacctgggacttgagcccagacagcttgagagctgtgagagtctatgccaacagcaccaacctgtgctaggtaaacacctgtttttataatcagaatgaagaggctgtgtcctctgccctatgaggtccatttctgagagttgttgctaatgggcaagaaggttgggactttagagatttgggataaagatatcaaacaccagaaaggaagaaagaagtgatcaggccaggcgcagtggctcgcatctgtaatcccagcactttgggacaccaaggcagtcagatcacctgaggtcaggagttcaagaccagcctggccaacatggcgaaaccccatctatactaaatatacaaaaattagcctcgtgtggtgttgcgcacctggaattccagctactcagcagactgaggcaggagaattgcttgaacccgggagatggaggttgcagtgagccaagatcatgacactgcactccagcctgggcagcagagtaagactctgtctcaaaaaaaagaaacaaagaaatagtcagacagattaggttgatttaggtgatgatatgaactccacctagaactgagagaaaaggagagccttcctttcctcatatggaatcacaaataatttctatcaaattcggaaatgtactttggtgtggttgtgacaggttcctaaatactccccgtaagttcaaacaaataaaaagagatgctacagaagagacagaaatctgcccacggcctgtagctctcttaacttccctggctgggaggaatgcatatttcatctcaaattggcccgaaatgccaatccatatagcctttgccactctgtgtcaactgtacgtccagataaaatcatatgccatgattacggaactgcatgcttagattgcaaaagcctttcctcctattgagttgtgaagagtgcaggactaagagttattcagttggcactaggctgactggcttcctgtggggtcaggggaggtttcagggtctcatgccttgcaggaaaggtttggttgtgagatccagaataacagaagcactggagcattctggaagaatgcctatgatggaaaggactacattgaattcaacaaagaaatcccagcctgagtccccttggtcccggaagcccagaacaccaagcagaagtaggaggcagaaccagtctacgtgcagcgggccaaggcttacctggaggaggagtgccctgcaactctgcggaaatacctgaaatacagcgaaaatatcctggaccggcaaggtactcactgcttcctgctatccagtgctaagctgggaaaaaccaaggtgatctcaggctgggagctcagagagcatcttaggccaatctcctctatccatgtaagtcacgtagaaccccagttttcaacttccaggattcattcctttcctaggaggacatcaaaatttcaggcagaatgggccaggaaagccactgattcactggtaggcttccctaaatatcacccattgagagatgaggagctggaggtgacagaggtgagggtaacactgtgtgtaagaggcagagctgcagccaggcatgctggctcacgcctgtaatcccaacactttgggagtgagtccaaggtgggtggatcacttgaggttaggagttcgagaccagcctggccaacatgatgaaacctcgtctctaccaaaaatacagaaattagcctggcgtggtggcaggcgcctgtaatcccagctactcgggaggctgaggcatgaaaattgcttgaacccaggaggactagattgcaatgagccaagatcgcgccactgcactttagcctgggcaatagtgtgagactcagtctcaaaaaaaaaaaaaagaaaaaaaaaaaggaagagctaggacttgaattccagatttcagattccaaatgccatcgttgtttctctctacaatgatgcctcccatctgggtggtggagagaagggaggtgtgtaaaatgtcagccccagaaagacaacagcgagccagtgtgaatggaatcgatggctgcaagctgagacttggattgcagacatagtgagactcaggattgtgcagtgctgcagggaagcggttgctggatagaggcatgggctgaaccaagcagctggactgagattgggggacagaactccaaagcccactcagatgtgggaaaacatgggaaagtgcacagagcattcacaacttatcagagtcaatacatgggtggggtggagaatgggcgagaggggagccaggacattccatgatccaacagagaaggatcagggaaagcctcagccttccctgatcttctggaaagtgtcccagggcagggggcagtggggcgggcagatacagagcttagagctctgctgattgctgacatccaggggtaggggtgagaagagacctgggccgggagaagtcgacctcaaacctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacggtggaaacggcacttacctgacctggttgttggtgcatgtgcccccgcaggacacagccccctactcctgccacgtgcagcacagcagcctggcccagcccctcgtggtgcccggggaggccaggtaggaagcaagggctggaggcaatgtgggatctcagccccagtagctgcccttcctgcctgatgtgggagctgaaccaccgaaatcacggtcaatggatcctcaaggcccaaggagcagtgtggggggacagacaggaggtggatttggagaccgaagactgggatgcctgtcctgagctgactcggacccaaaaaccatctcaccttgaaccaccccccgccattgtctaatctgtggaaactaataaataatcatctctctttgtcaagcacgacagagaacagtattaactgtaaaatgctatagaaatgtgatgtgattttctcattggtcctgctcccaagcactgaattcatctgaaactcttggtttcccttggaggccatggttcctgggcaccctgacttgggcaatcccaagcatggcccggacccgctgtcccttagggattgttcaggtgtcccctgctgacatccacaggcgtggccatggccactctggctgtgaggtgctagaaccctgcaagctctttcacacagccaagcctcttctgtgcctcagtttccccacacttcttggcttcctgggagacccagccctccactccagctgctccacatctccacaccatgttcgccttggcccaccagccaaagcttatttgagagctctcagctctccagggtacagctcaatgaagcgggaattggccctgaggttctcagactccctctgagtccctgagagtgagtttcctcaaatgagtcgccaactgccatgcacaggtatcaaccccaaacacacagcagagctctcaccttgaccttctcatgaagcctcacctgcctgtgtctgtgcttttccttcctgtgggaaaagaactttcctttttttcttcctttttcttttttttttttttttttttttttttgagatggagtcttgctctgttgcccagcctggattgcagtgttgcaatcttggcttactgcaaactccgcctcccgggttccaacgattctcctgcctcagcctcccaagtagctgggattacaggcatcagccactacgcccggctaatttttctatttttagtagagacagggtttcaccatgttggcaaggctcgtctcgaactcctgacctcaggtgatctgcctgcctcggcctcccaaaatgctggcattacaggcgtgagccactgtgtctagcgacaagaactttctttacatcctatactcagcctcccactctggattattccaaaatccatcctccaagctgggttccatagaagaatcattcccagtctttggaattctgagttaatcatcttatctttcatgaaagcctaaatttgaaggctacaattttttgttttaactcttcgactccaatttgaaaatcaaagctgagaaattacttttttttttaaagtctacatgaaatccacctttctcccttccagggcaaaaacatcctatatgaacagtagccaagttcaggaaagaaaatgcaaatagtcgccaggcgcggtggctcacgcctataatctcagcactttgggaggcccaggcgggcggatcacgaggtcaaggatcaagaccagcctggccaacatagtgaaaccccgtcttcactgaaaacacaaaaaattagccgggtgtggtggtgtgtgcctataatttcagctacttgggaggctgaggcaggagaatagctgggtttggtgatgtgtgcctgtaatcccagctacgggggaggctgaggcaggaggatcacgtgaacccaggaggcaggggttgcagtgagctgagatctcgccactgcactccagcctgggcgacagtgcaagactctgtctcaaaaaaagaaaatgcaaataatcaagaggaaaaaatatagcatgtgaaatgtgaatatgaggacacttggagcaaataaaaggtgaaagttaaacatttaagatcaacgaagaaaccaaaatccacatgatcagaccagggctaaggaaaattggaataggagatgtgacctcatctataacaggagacatggatgatgataaaggaggagagagaagccacaggattcaagtcctgggcaggtgtggggcaggaggagagggacacagggctactgagatactcagggaaaacttcctggagcaattcggatttcagagagatgtggaggcctaagacagcttgccaagtcgaggtcaaaagatttccatgcagaatgggattttacattccctgttcttttgagtctccagtgcctaccagagaatcaaatatacaataggtccgggcacagtggctcatgcctgtaatctcagctctttgggatgccaaagtgggaggattgcttgagccaggagttccagatcagtctgggcaacatagcaagaccctgtctctacatttaaaaaaataaaaaattatctgggcatggtggcacacacttgtagtcccagctacttgggaggctgaggcaggaagatcacttgagcatgggaggtcaaggctgctgtgagctatgattgtactattgcactccagcctgagcaacagagcaagaccgtgtctcaaaaataaataaataaatacacatattaatacaataggtaattaatacataatttctggatgaatcaataaatacgtaagcaaaggcaatagaaagcactaaatatttctgacgaccacgaagaaccttttggctgggacagtgaattctactgggaaagaagtttgaaaaagcaaagctcagagaaattgaagaggaccttaacatatgtataccttgctatatctgattgatgtcttttgcctgattcagtgtgcatcattcctccagcctacctgggaactatccccaggagagtccaccagagagagacaagatagtctaaggcaggggtccccaactcccggtacccgttcatagccagttaggagccgaaccacgcagcagaaggtgagctgcagggtcgaagcttcatctgtatttacagctgctcccccaccccccgaccattgctccaattaccgcctgagctcacctcctgtcagatcggcagcagcattagactctcacagaagcacgaaccctattgtgaactgtgcaagaaaggtatgtaggctgcccgctccttatgagatctaacgcctgatgatctgtcactgtctcccatcaaccccagatgggaccatctagttgcaagaaaacaagctcagggctcccactgattctacaccgtggcgagttgtagaattatttcattatatattacgatgtaataataatagaaataaagtgcacaataaacgggatgcactggaatcatcccaaaaccattcccctccccagtccgtggaaaaactgtcttctacggagccggtccctagtgccaaagagattggggaccgccggcttaaacaaagaggtctttttctcaagcaggttccaatcagcgctaggccggattcgctatggcttttgcctgccccctagtggtcaaggaaatagttgcagccaagtgttaggatccagtccttgagaatttggctcaaagcctggatgcaaaggccatgagataacggtcatccggtcttcctcgcacaactcacacaattctcgccgtcttttttttttttaagagggaatttcactcttgttgcccaggctggagtgcagtggcgcgatctcggctcactgcaacttccaactcctgggttcaagcgattctcctgcttcagcctcccatgtagctgagattacaggcgcccgccaccacacccagctaattttttgtatttttagtagagacggggtttcatcatgttggccaggctggtctccaactcctgacctcagatgatccactcgcctcgacctcccaaagtgctgggattacaggcatgaaccacggcgcccagccaattcctgccttttattatggaggaaaacctccgcgggattacagcacacccagtggacgtctgttacctcatcgaacttgggtccaaccaccgggtgctgcaaacactgacatgtggattccagtgagagaaactgaggcatttattgcagggtgccaagcaaggagaatcagccagctcaagtgtaagacctaaattccccaatggcttgtaggtaagggtttttagaggcagagaagcagaagttacaggcaaagtcataaatcaatacatggcccggcacagtggctcacgcctgtaattccaacactttgggaggccaaggcaggtggatcacctgaggtcaggagttcaagaccagcctggccaacatggtgaaaccccatctctactaaaaatacacaaaattagccagctgtggtggtgcacgcctataatcccagctactcagaaggctgaggcaggaaaatctcttgaagccgggaggcagaggttgcagtgagcagagatcgcgacactacactacaccctaggcgacagagcaagactctgtctcaaaaaataaaaaataaatcactcataacctggtgcaatggttcacacctgtaatcccagcactttgggaggccgaggcaggaggattgcttgaagtcaggagtttgagaccagactgggaaacatagcaagaccccatatctataaaaacattaaaacttagctgggcgtggtgtcatgcacctgtagtcccagctactcaggaagccgaggcaggacgattgcttgagcccaacagttggaagctgcagtgagctatgatcacaccattgtactccagcctgggcaacagaggtctttaaaaacaaaaaatcaataacgtgtaataatctttttttaaaactccctaacaggatgtgtggcaggttcctgaggtggtggctgctggcggaggagagctggcactccacccccgtggggcgcctcctgtttcccgtgctcctgggattccgccttgtgctgctggctgccagtgggcctggagtctatggcgatgagcagagtgaattcgtgtgtcacacccagcagccgggctgcaaggctgcctgcttcgatgccttccacccgctctccccgctgcgtttctgggtcttccaggtcatcttggtggctgtacctagcgtcctctacatgggtttcactctgtatcacgtgatctggcactgggaagaatcatgaaaggggacggaggaagaggacaccctgatccagggaggggagagcagcagagataccccaggggctggaagcctcaggctgctctgagcttatgtggctcagctgggagctcagctggtcctggaggggacagcgccggggttgcagtaccacctgtatgggttccagatgcccagctcctttgcatgtggccaagagccttgcccgtatagattaacttgcaccttttcccacccctcggagaagatcatctttctaaaagccatgtttggggtcagtgggttccgtctcttgttcactcttttggagattgtgcttctgggtctgggaagactgtgtaagcccctgcggaacttcctgggtggggcctcttcctccagccacgccctggccctgagcagcaaaaggaacctccagcagacactgtgagccatccatcggcctggtcagccttgttccatttcagagaccatgttccccacagccccagtgactaggggtgacatctcctgacctcccccacctgtggatatggccaagtcgaggtaccggttaaccaaagatgctgaaggagtgaagaaccagccatcccctaatacgcaggatggttatattgattatgtcaaactgaaaactttggagaaactcctctctcagaaagcgataactgggccagacacggtggctcatgcctgtaatcccagcattttgggaggcctaggcaggtggatcacttgaggtcaggagttcaagaccagccaggccaacatggtgaaacccgtgtctactaaaactacaaaaattctgggcatggtggtgggcgtctgtaatcccagctacttgagaggctgaggcaggagaattgcttgaacctgggaggtggaggttgcaaagagccgagatcatgccactgcactccagcctgggtgactccgtctcaaaaaaaaaaaaaaaaaaaaaaagtgctggtgttccttaggactgtgttgcgggccctctctctccccattccacaccctcactctccctggataactttccctttgtctatagctccagccaccacgtccttgcggatgacttcccagtgcagatccccagtctgggctacctctcgagttcaggcttgaaatcctgtcgttcggccaggcacggtggctcacgctgtaatatcagccctctgggggtcgaggcgggcagatcacctgaggtcaagtgtctgagaccagtctggccaacatggtgaaaccccgtctctactaaaaatacaaaaaattacaggcatgcatggtggtgcgtgcctataatcccaactacttgggaggctgagacaggagaatcgcttgaaccctggaggcagaggttgcagtgagccgagatcgcaccactgcactccagcttgggcgacagagactctggtcagatgcctcctaggctcaggcacctgctctgggagcagtgggctcctctgcatccttgagcacctaatctttatgtgcaggatcataaaacacaccgtgcggatcagtgtcagatttccttcttaagctaatagaacagaatgcagctttcaggattcaggaaagatttttctgcacaggcaagtcagttgcagtcgcgtgttattgccaccagaggacacaatgatcctgctaacatgatgaaagactctcccagcggatttaataacaatcttagcaattttttatttattttttttttcttgctccgtcgccaggctggagtgcagtggtgccatctcggctcactgtaacctccgcctcccgcctcctgggttcaagcgattctcctgcctcagtctgccgagtagctgggattacaggcgcgcaccaacatgcccggctaatttttgtatttttagtagagacggggtttcaccatatagaccaggctggtgggtgatccgcccatcttggcctcccaacgtgctaggattacaggggtgagccaccgcgcctggccttaatctactttttatatctgtggttttgcctttcctggtcattccatctatgttgaatactacaatacgtggccttctgtgcaagggcaattggttccatgcttagtcccaccagatgatagatgttaaccaatatttactgataagttggggcctctccgacaaggagaccaatgaggctgtctccttcaaaagcatctcagctctgtcttggagctttgagttgagagtttttttttcaagccagattttacgtcgttcccagacacattcacaagccttgctggaccaaagaaaaaaaacgagttagcctgggcacagcggctcacacctgtaataccaacactttgggaggccaagatgggtggatggcttgatgccaggagttcgagaccagcctggtcaacatagcgagaccccccatctctaaaaaataaaataaagtacatataccagcaatgatgtataaccgaaaaataaataaataaacaagttaatattgaaatgtcatgtttgcccccaacccaaataagcactataacctcttgttattcacttctcatgcaaccagtcttctgttctctgtgagtctttaggaaatgaggagcatgatcttctagcagtaaaacacctgtagagaattgcc

SEQ ID NO: 38166 - DNA, 194239 bp, Homo sapiens; identical to SEQ ID NO: 36902

SEQ ID NO: 38167 - DNA, 17052 bp, Homo sapiens; identical to SEQ ID NO: 36263

SEQ ID NO: 38168 - DNA, 12761 bp, Homo sapiens
gggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtggggtgagtgcctaccctcggggctcctgcagatggggtgggggtggggcaggagacaggtctgggcacagaggcctggctgttgggggggcaggatggcaggatgggcatggggagatcctcccatcctggggctcagagtgtggacctgggccctggggcaacatttctctgtcctatgccaccactctggaggggcagagtaaggtcagcagaggctagggtggctgtgactcagagccatggcttaggagtcacagcaggctaggctgccaacagcctcccatggcctctctgcaccccgcctcagggtcagggtcagggtcatgctgggagctccctctcctaggaccctccccccaaaagtgggctctatggccctctcccctggtttcctgtggcctggggcaagccaggagggccagcatggggcagctgccaggggcgcagccgacaggcaggtgttcggcgccagcctctccagctgccccaacaggtgcccaggcactgggagggcggtgactcacgcgggccctgtgggagaaccagctttgcagacaggcgccaccagtgccccctcctctgcgatccaggagggacaactttgggttcttctgggtgtgtctccttcttttgtaggttctgcacccacccccacccccagccccaaagtctcggttcctatgagccgtgtgggtcagccaccattcccgccaccccgggtccctgcgtcctttagttctcctggcccagggcctccaaccttccagctgtcccacaaaaccccttcttgcaagggctttccagggcctggggccagggctggaaggaggatgcttccgcttctgccagctgccttgtctgcccacctcctccccaagcccaggactcgggctcactggtcactggtttctttcattcccagcaccctgcccctctggccctcatatgtctggccctcagtgactggtgtttggtttttggcctgtgtgtaacaaactgtgtgtgacacttgtttcctgtttctccgccttcccctgcttcctcttgtgtccatctctttctgacccaggcctggttcctttccctcctcctcccatttcacagatgggaaggtggaggccaagaagggccaggccattcagcctctggaaaaaccttctcccaacctcccacagcccctaatgactctcctggcctccctttagtagaggatgaagttgggttggcagggtaaactgagaccgggtggggtaggggtctggcgctcccgggaggagcactccttttgtggcccgagctgcatctcgcggcccctcccctgccaggcctggggcgggggagggggccagggttcctgctgccttaaaagggctcaatgtcttggctctctcctccctcccccgtcctcagccctggctggttcgtccctgctggcccactctcccggaaccccccggaacccctctctttcctccagaacccactgtctcctctccttccctcccctcccatacccatccctctctccatcctgcctccacttcttccacccccgggagtccaggcctccctgtccccacagtccctgagccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtaagccgaaccgggcgggagcctgacttgactcgtggtgggcggggcataggggttggggcggggccttagaaattgatgaatgaccgagccttagaacctagggctgggctggaggcggggcttgggaccaatgggcgtggtgtggcaggtggggcggggccacggctgggtgcagaagcgggtggagttgggtctgggcgagcccttttgttttcccgccgtctccactctgtctcactatctcgacctcaggtagcggtagtgaagatgaagcagacgggccaggtgtatgccatgaagatcatgaacaagtgggacatgctgaagaggggcgaggtgaggggctgggcggacgtggggggctttgaggatccgcgccccgtctccggctgcagctcctccgggtgccctgcaggtgtcgtgcttccgtgaggagagggacgtgttggtgaatggggaccggcggtggatcacgcagctgcacttcgccttccaggatgagaactacctggtgagctccgggccggggtgactaggaagagggacaagagcccgtgctgtcactggacgaggaggtggggagaggaagctctaggattgggggtgctgcccggaaacgtctgtgggaaagtctgtgtgcggtaagagggtgtgtcaggtggatgaggggccttccctatctgagacggggatggtgtccttcactgcccgtttctggggtgatctgggggactcttataaagatgtctctgttgcggggggtctcttacctggaatgggataggtcttcaggaattctaacggggccactgcctagggaaggagtgtctgggacctattctctgggtgttgggtggcctctgggttctctttcccagaacatctcagggggagtgaatctgcccagtgacatcccaggaaagtttttttgtttgtgtttttttttgaggggcgggggcgggggccgcaggtggtctctgatttggcccggcagatctctatggttatctctgggctggggctgcaggtctctgcccaaggatggggtgtctctgggaggggttgtcccagccatccgtgatggatcagggcctcaggggactaccaaccacccatgacgaaccccttctcagtacctggtcatggagtattacgtgggcggggacctgctgacactgctgagcaagtttggggagcggattccggccgagatggcgcgcttctacctggcggagattgtcatggccatagactcggtgcaccggcttggctacgtgcacaggtgggtgcagcatggccgaggggatagcaagcttgttccctggccgggttcttggaaggtcagagcccagagaggccagggcctggagagggaccttcttggttggggcccaccggggggtgcctgggagtaggggtcagaactgtagaagccctacaggggcggaacccgaggaagtggggtcccaggtggcactgcccggaggggcggagcctggtgggaccacagaagggaggttcatttatcccacccttctcttttcctccgtgcagggacatcaaacccgacaacatcctgctggaccgctgtggccacatccgcctggccgacttcggctcttgcctcaagctgcgggcagatggaacggtgagccagtgccctggccacagagcaactggggctgctgatgagggatggaaggcacagagtgtgggagcgggactggatttggaggggaaaagaggtggtgtgacccaggcttaagtgtgcatctgtgtggcggagtattagaccaggcagagggaggggctaagcatttggggagtggttggaaggagggcccagagctggtgggcccagaggggtgggcccaagcctcgctctgctccttttggtccaggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggtgagcacggccgcagggagacctggcctctcccggtaggcgctcccaggctatcgcctcctctccctctgagcaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggtaggtacctgtggcccctgctcggctgcgggaacctccccatgctccctccataaagttggagtaaggacagtgcctaccttctggggtcctgaatcactcattccccagagcacctgctctgtgcccatctactactgaggacccagcagtgacctagacttacagtccagtgggggaacacagagcagtcttcagacagtaaggccccagagtgatcagggctgagacaatggagtgcagggggtgggggactcctgactcagcaaggaaggtcctggagggctttctggagtggggagctatctgagctgagacttggagggatgagaagcaggagaggactcctcctcccttaggccgtctctcttcaccgtgtaacaagctgtcatggcatgcttgctcggctctgggtgcccttttgctgaacaatactggggatccagcacggaccagatgagctctggtccctgccctcatccagttgcagtctagagaattagagaattatggagagtgtggcaggtgccctgaagggaagcaacaggatacaagaaaaaatgatggggccaggcacggtggctcacgcctgtaaccccagcaatttggcaggccgaagtgggtggattgcttgagcccaggagttcgagaccagcctgggcaatgtggtgagacccccgtctctacaaaaatgttttaaaaattggttgggcgtggtggcgcatgcctgtatactcagctactagggtggccgacgtgggcttgagcccaggaggtcaaggctgcagtgagctgtgattgtgccactgcactccagcctgggcaacggagagagactctgtctcaaaaataagataaactgaaattaaaaaataggctgggctggccgggcgtggtggctcacgcctgtaatctcagcactttgggaggccgaggcgggtggatcacgaggtcaggagatcgagaccatcttggctaacacggtgaaaccccatctctcctaaaaatacaaaaaattagccaggcgtggtggcgggcgcctgtagtcccagctactcaggaggctgaggcaggagaatggcgtgaacccgggaggcagagtttgcagtgagccgagatcgtgccactgcactccagcctgggcgacagagcgagactctgtctcagaaaaaaaaaaaaaaaaaaaaaaaaataggctggaccgcggccgggcgctgtggctcatgcctgtaatcccagcactttgggagtccaaggccggtgggtcatgagatcaggagttttgagactaggctggccaacacggtgaaaccccgtctctactaaaaatacaagaaaattagctgggtgtggtctcgggtgcctgtaattccagttactggggaagctgaggcaggagaattgcttgaacctgggaggcagagtttgcagtgagccaagatcatgccactacactccagtctgggtgacagagtgagactctgtctcaaaaaaaaaaaaaaaaaaaagggttgggcaaggtggttcacgcctgtaatcccagaactttgggaggctgaggcaggcagatcactggaagtcaggagttcaagaccagcctggccaacatggtgaaaccctgtgtctactaaaaatacaaaatttagccaggcttggtggcgtatgcctgtaatgccagctactcaggaggctgaggcaggagaatcgcttgattgaacctgggaggcagagtttgcagtgggctggggttgtgccactgcactctaggctgggagacagcaagactccatctaaaaaaaaaaaacagaactgggctgggcacagtggcttatatttgtaatcccagcactttgggaggctgaggttggaggactgcttgagcccagagtttgggactacaacagctgaggtaggcggatcacttgaggtcagaagatggagaccagcctggccagcgtggcgaaaccccgtctctaccaaaaatataaaaaattagccaggcgtggtagagggcgcctgtaatctcagctactcaggacgctgaggcaggagaatcgcctgaacctgggaggcggaggttgcagtgagctgagattgcaccactgcactccagcctgggtaacagagcgagactccgtatcaaagaaaaagaaaaaagaaaaaatgctggaggggccactttagataagccctgagttggggctggtttggggggaacatgtaagccaagatcaaaaagcagtgaggggcccgccctgacgactgctgctcacatctgtgtgtcttgcgcaggagacactgtcggacattcgggaaggtgcgccgctaggggtccacctgccttttgtgggctactcctactcctgcatggccctcaggtaagcactgccctggacggcctccaggggccacgaggctgcttgagcttcctgggtcctgctccttggcagccaatggagttgcaggatcagtcttggaaccttactgttttgggcccaaagactcctaagaggccagagttggaggaccttaaattttcagatctatgtacttcaaaatgttagattgaattttaaaacctcagagtcacagactgggcttcccagaatcttgtaaccattaacttttacgtctgtagtacacagagccacaggacttcagaacttggaaaatatgaagtttagacttttacaatcagttgtaaaagaatgcaaattctttgaatcagccatataacaataaggccatttaaaagtattaatttaggcgggccgcggtggctcacgcctgtaatcctagcactttgggaggccaaggcaggtggatcatgaggtcaggagatcgagaccatcctggctaacacggtgaaaccccgtctctactaaaaatacaaaaaaattagccgggcatggtggcgggcgcttgcggtcccagctacttgggaggcgaggcaggagaatggcatgaacccgggaggcggagcttgcagtgagccgagatcatgccactgcactccagcctgggcgacagagcaagactccgtctcaaaaaaaaaaaaaaaaaagtatttatttaggccgggtgtggtggctcacgcctgtaattccagtgctttgggaggatgaggtgggtggatcacctgaggtcaggagttcgagaccagcctgaccaacgtggagaaacctcatctctactaaaaaacaaaattagccaggcgtggtggcatatacctgtaatcccagctactcaggaggctgaggcaggagaatcagaacccaggagggggaggttgtggtgagctgagatcgtgccattgcattccagcctgggcaacaagagtgaaacttcatctcaaaaaaaaaaaaaaaaaagtactaatttacaggctgggcatggtggctcacgcttggaatcccagcactttgggaggctgaagtggacggattgcttcagcccaggagttcaagaccagcctgagcaacataatgagaccctgtctctacaaaaaattgaaaaaatcgtgccaggcatggtggtctgtgcctgcagtcctagctactcaggagtctgaagtaggagaatcacttgagcctggagtttgaggcttcagtgagccatgatagattccagcctaggcaacaaagtgagacctggtctcaacaaaagtattaattacacaaataatgcattgcttatcacaagtaaattagaaaatacagataaggaaaaggaagttgatatctcgtgagctcaccagatggcagtggtccctggctcacacgtgtactgacacatgtttaaatagtggagaacaggtgtttttttggtttgtttttttccccttcctcatgctactttgtctaagagaacagttggttttctagtcagcttttattactggacaacattacacatactataccttatcattaatgaactccagcttgattctgaaccgctgcggggcctgaacggtgggtcaggattgaacccatcctctattagaacccaggcgcatgtccaggatagctaggtcctgagccgtgttcccacaggagggactgctgggttggaggggacagccacttcataccccagggaggagctgtccccttcccacagctgagtggggtgtgctgacctcaagttgccatcttggggtcccatgcccagtcttaggaccacatctgtggaggtggccagagccaagcagtctccccatcaggtcggcctccctgtcctgaggccctgagaagaggggtctgcagcggtcacatgtcaagggaggagatgagctgaccctagaacatgggggtctggaccccaagtccctgcagaaggtttagaaagagcagctcccaggggcccaaggccaggagaggggcagggcttttcctaagcagaggaggggctattggcctacctgggactctgttctcttcgctctgctgctccccttcctcaaatcaggaggtcttggaagcagctgcccctacccacaggccagaagttctggttctccaccagagaatcagcattctgtctccctccccactccctcctcctctccccagggacagtgaggtcccaggccccacacccatggaactggaggccgagcagctgcttgagccacacgtgcaagcgcccagcctggagccctcggtgtccccacaggatgaaacagtaagttggtggaggggagggggtccgtcagggacaattgggagagaaaaggtgagggcttcccgggtggcgtgcactgtagagccctctagggacttcctgaacagaagcagacagaaaccacggagagacgaggttacttcagacatgggacggtctctgtagttacagtggggcattaagtaagggtgtgtgtgttgctggggatctgagaagtcgatctttgagctgagcgctggtgaaggagaaacaagccatggaaggaaaggtgccaagtggtcaggcgagagcctccagggcaaaggccttgggcaggtgggaatcctgatttgttcctgaaaggtagtttggctgaatcattcctgagaaggctggagaggccagcaggaaacaaaacccagcaaggccttttgtcgtgagggcattagggagctggagggattttgagcagcagagggacataggttgtgttagtgtttgagcaccagccctctggtccctgtgtagatttagaggaccagactcagggatggggctgagggaggtagggaagggagggggcttggatcattgcaggagctatggggattccagaaatgttgaggggacggaggagtaggggataaacaaggattcctagcctggaaccagtgcccaagtcctgagtcttccaggagccacaggcagccttaagcctggtccccatacacaggctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccaggtcgggatcggggccggggccggggccgggatgcgggccggtggcaacccttggcatcccctctcgtccggcccggacggactcaccgtccttacctccccacagtcaactacgcgaggcagaggctcggaaccgggacctagaggcacacgtccggcagttgcaggagcggatggagttgctgcaggcagagggagccacaggtgagtccctcatgtgtccccttccccggaggaccgggaggaggtgggccgtctgctccgcggggcgtgtatagacacctggaggagggaagggacccacgctggggcacgccgcgccaccgccctccttcgcccctccacgcgccctatgcctctttcttctccttccagctgtcacgggggtccccagtccccgggccacggatccaccttcccatgtaagacccctctctttcccctgcctcagacctgctgcccattctgcagatcccctccctggctcctggtctccccgtccagatatagggctcaccctacgtctttgcgactttagagggcagaagccctttattcagccccagatctccctccgttcaggcctcaccagattccctccgggatctccctagataacctccccaacctcgattcccctcgctgtctctcgccccaccgctgagggctgggctgggctccgatcgggtcacctgtcccttctctctccagctagatggccccccggccgtggctgtgggccagtgcccgctggtggggccaggccccatgcaccgccgccacctgctgctccctgccagggtacgtccggctgcccacgcccccctccgccgtcgcgccccgcgctccacccgccccttgccacccgcttagctgcgcatttgcggggctgggcccacggcaggagggcggatcttcgggcagccaatcaacacaggccgctaggaagcagccaatgacgagttcggacgggattcgaggcgtgcgagtggactaacaacagctgtaggctgttggggcgggggcggggcgcagggaagagtgcgggcccacctatgggcgtaggcggggcgagtcccaggagccaatcagaggcccatgccgggtgttgacctcgccctctccccgcaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaa

SEQ ID NO: 38169 - DNA, 97693 bp, Homo sapiens
cgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatggggtgagtgagcccgcgccgcgcgctctccgcgcgcccctccggagggactgcggggccgcggctggcgtaaccgggctcggagcctcccggcgggccggcccccgcctccccaagccggagcgagcgcacactctgcgcccgggagtctggggccacctgacccgcgccctccgccggggcacgcggacacccagcaggggcaccctggcctgggcgcggagcccgtggcccttcccctcccatacagcccgggcacgggggcacctgacggggaccggtgccctggccggcctcctgcctcggccattccgcggtctcttcgcccctgggcgcagtcaactccagggcctgtgtgagtctaagcagtttgtcgttctccacgtttggatttattacaagcaaaatggaaatcgaagttttcctggaaataatcaaataataataaacctccagcgtaggaatagtggactttggatctgctttgagatgctgaagatgatggaagtctataaggaacctaggtgaggcttcagtctttgaaacaactgagtagatgctcaggagggaagttgaaatactctgtcgaagtgactaatgcttctgagtatataaagtaatttaagctttcccctcggcgtctctctgagcagtaggctctgtgagtctgggagccactgtgctaatagcacaataactccttacatctgctcactctatttgggcacacgttgacggtttgccatacgtattcaggggacacttatgtccactttacagatgaggaaactgaggcacaaagtggttcggtgacttcccccaggctgtgtagttgatgagcatttgtgtagcaggggtggccttgccactgcctgacgtgggcatggaggcgggtaagtgaaccagaattcctaaatctctctgttccctgctgctgaacccagcattcttccaacagcccttcgcaggactcaaatgcttctgctccaagggtctagagatcttgctttcctgtttgggatgggtggggcctgggaaggcaagagtgcagtggaaggagcaagattgtcctggtgccctggctcagcccccctgggtcagtggctttcttgcaccgtactccaggttaagtttctggagtcattttgcctggtgagtcttagccatgggagctgcagagtgtgtgaggggatcagaggcaggccaagaggaattttgaggaatggaagtgtgagggctgtgggccaacatgaactggacatgacagaggtgggtgacagagaggaggaggcgagatgagcagcgagggctgaagaagtgtgcttacatttaggagatttcacatgaacagcaactgtgggtgattttacccagaggcacccaagttggcaggccgtatttctgtaacatttccagtgagtcctcagtggactgtgaaaaggctgatctttgagcagtgagagcctttgaggttctcagatttcatactttaaaaaaatgtacagggaaaaaggagttggcaaatgtaaggtctcagaatggaagataaaagggatccggtaattttaactctctttctggccctccctccccctggccaacacaaaaccaatccaccgtacttgtgtgatcaaaaacaagtactgaaactctgtggttgagatcaaatagttctgtggaaatgaaaatgtttactcactcataaaaccttaaagaaaatgtcaaaaaataatttttgtttgtggagaagcagggaggagacgcttggggattttgtttaaacacagaatatgtctttcatgtaattttaacatcattcgataaatgtatatattactcacttctcgtagataaaggctggtttgtaactcctacctacctctgccatttttaatagatccatgtcttctattatttatgtgaaaatacaagccatggtcgtaaattgagatgcagctaagggctggggaagcaattcagacaggagggtggagggagccgttttaactgaaaatagaaccaatgtcatcctttctgagagttgtgtaggatggagggggaagaactttttgaaagggcagctagtagaaaaccttgctgcgatcctacagcttcgtcatggctctgctgtgtagacaggactaggatttaagggaaaaaaaaacaaactatctgagtttacctccccccaacttgagatgcttctcctccctcaaatgttcactaccattttccacttctcttctgcgaagtgttctgtgttaagtgtggcctctccagtgagtttgtgttcttactccctaaggcaactatttcatacctattcccctttccagacctctccccttcctaggcacaccccgtggcttccctttcaattgacaagataggcacctttgaccaagggaatgtcttcattttgccaccacctagtctagtatgcagctgctgctaccttctcctacctgcctgctgtgctggatgacctgtccctcatctcttcctactaggggccccttcttctggggtagcctccattccatcccttcctcctcccatcttttcagagattgtctctccttcctaaccacctttctctccggggtcttctccatcagtataggagcatacatctgaccaacagaactttctgcactgctggaaatgttctgtatctgcgtggcagccaccagcacatgtggttattggacacttgaaatgtggttgttgagactgaggacctgaatttttaacttaatctaaatttaaatagccacatgtagctagtggccaccatattggatagcatagctttagttgctctcatcttaaaaaggagatctccctccctcctacatccctctcctgtttcacttctttgctcttcttcacctgaaaacacctcagaagatacatccaaacccactggctccattcactttctcctgccatttgttcactctccatactctacagtcttgcttctgcctcacctctgcaccaaaactgccagggtcttgggtgaccagggggttgccagatctcagcctcacctcacttcacctctctcagcagcattcctaacaaatgaccactccctctcctcaaaacaacacccctctcagctcctctggccccactgtttcctgcttttcttcttactcctaatcatggggttgcccagggactggtcctggttccttttctctgtccacactgtcttcctaggtaatactgtcccacctgcaactcctccccaccctcccatggcttcaaatgccatcgatatgcccatgatgcccacactttaatttctagctcagatctttcttggagcttctgactctcgtcaatacatggagctcttgatatgccttccagctctcacctgccttccgtcttccccatccaagtcagtggccctaccatgcactcatttgccaagagtcatgtttgagtcctcttcccaacctctcacatgcaggctatcagtttgtcctgtgcattctacttccgggatatatctggagtgcattcacctcaccccatagccatagttcccactctagccaccatcacctctttcctaacaggccccccagtatccactctgggttgtctgcagtccatttttcacacagaagcctaagtgaccagcttttaaaatcataaatcagatcatgtcattcccctttttaaatacctcccactgaccaggcgctgggcgcagctccccctgccatgctgctgtgcccctcactgtgttctgctaacatagatctcctttccttttcttgccttacctgagatccttgcacttgctgtttcccctgcctggaattctcttaccttcctctttcctttcagactttggcctcagggtcaccccttcagggtctttcctgccatcctgtctagagcacccacctccagaactatctaacccagccccttttcttttttcttttgttgagacagagtctccctctgtcacccaggcaggagtgcagtggcacggtctctgctcactgcaacctctgcctcccaggttcaagcgattctcatgcctcagcttcctgagtagctggtattataggcatgtgccatcacacccagctaattcttttttttttttttttttttgagatggagtctctgtctgtcgcccaggctggagtgcagtggcgcgatcttggctcactgcaagctccgcctcccgggttcacgccattctcctgcctcagcctcccgaatagctgggactacaggcgcccgccaccacgcccagctaattttttgtatttttagtagagacggggtttcatcgtgttagccaggatgatctcaatctcctgacctcatgattcgcctgccccggcctcccaaagtgctgggattacaggcatcagccaccatgcccggccacacccagctaattcttttgtatttttagtagagatggggttttaccatgttggcctggctggtcttgaacccttggcctcaaatgatctgcccacctcagcctcccaaagtgctgggccccagccctacctttgtttcctataattgctcaccacagcatgccagtaagcatgcaggtgttatttacttatttataatccgtcttcccccagtagcatcccaaaaggataggaccttatctttttcaccagtgtattccaacacctagcacagtgcctggcaccaaataggcctccagtaaataatttttaattgagttaatgcttgaatgttgtgggcagccttgcttggatgctggcctggaagctgtgataatttttgggttaacttttatatagcttgcttaattgggagttgcaagggccaagagagaaagagatcacatttggatgcagctttcttttaacattaaagcaagccatttagctttcattgtgatgtgggttaattttcgggccgtctgctgtcatttgagtactggagttgtaaattacctttttactctcctgcaaaagactaacagaaaagccagcttgtctactgttgtgacttttagctgattttgtcagtgtttacaaataagatctactgtattactgtttggcttcattttacactcacttattttgttcagccaagattaccttgccatgtacaggtgccacaatcttggttatctaacacctcaggctgccttttggtactctataccgatttactttcttttgatgttcattcattccttctttaattttccattccctctgaatcacaccagactctgtagttccaacaaattatagggctgttctttggggtttgagttgactgcaatagatacagtctttcagatatgttgaggtgagtttgtcttctcttggtcctgtgggtttgttaaacttcactttctaatattccttcagtctgtacattggtaaggcagttggcaagtgctgtagggatccagagatgagcagacccactagttagttcctgcccttggggagcttatattttgaaaagggagataaactacatacacaagtaccagctttatatgtgaaatgctgtgagagtaaacacaatgttatagtcctttgggtatcacaggtggtggtggaggggtgcccatctatttggggaattgaggaaagatgccgtggtacattgtggggaggacagatgctgtggtacactgatggttacacagccatccctcttagtatccgaactggaagaatacacagaatttggaatggagtaggcactaaataagtagatattgaatgagtgtgtaaataggtgtgaatgaatattctcttttggttgactttctttgtttttgtttttttaataaaatacacagtttattacatagcaataggataaggaaggggactagaggatgttgcagtaggatagagattttagatggggatccagttagaagacttcactgagaaggaggcattaaagagctgaaagaaggaggagagtgagccatggaggtgtctgagggaagtgttcctggcagtgtgaatagtgcgaacagcaggtgtaaaggccctgaggcaggggcatgcctggcttgttcaagaaatagtaaggaagctagtatggctggagcagagtgagccagagagagcacgaaggtgaagaggtcagggaggtagcaatggccagaccagtctttgggttgacttttactttgggaagatgccatcattctcgttggaaactgccctgaagtttctggtccaagtgttgttaggaaagaataaaggcatgtttgctgctcgcacagttcgctggaaatatcagggccaagtaattctgctgaagcgggacgctgagcagagcacatggtttatttttgtcgaatagactcagtgatttgtgtaaattattaggtttcttttctggaatggctcctgaggaacttagagttaaatgtgtggtgacccttagcagatttatcagacttcatccattacctttatttctagctcagtgtgatggccctacccttgttttgtctttaccctttatcatctaccactttttttttttaatgtttttgagacagagtctcactctgttgcccatgctggagtgcagtggtgcgatttcggctcactgcaacctccgcctcttgggttcaagcgattctcctaccttagcctcccgagtagctgggactacaggcgcctgccaccacacccggctaattttttgtatttttagtagagatgggatttcaccttgttagccaggatggtctcgatctcctgacctcgtgatttgcccgccttggcctcccaaaatgttgggattacaggcgtcagccaccgcgcccggccatctaccactttttttctttttcttttttttttaacaaaaggaaaatagctttgcttttttctaattataaaaaaactacatgtttatactgaaaaataacagcataaagaaggaagtgaaaattacttgtcatcccacgtcttagggataacctccatcagcatttcaatgtctgcctttgtacttttttccatgtatatatgtctgtgtgtgtctagatgtatgtctacatagagcaagtctatttttaacaaaatgcaatcattttatacatctgtcttgtaacataatttttccaacttaaaatatcttgagtggacatctttacatgccaataactataaaaatacctcatcatttaaatccacacctacttctaatttgtcattttgctaaatcttatacatctttgtaaacctatttaaatcctttctggaacaagacaggctctttttttttttttttttaagacattttaacaatttcttaaagcagttgtttgctttaaatgaattactgaaggaaagaaatggtagaggagaccaagatcacaattaacattgggtaatttgcagtgcctgtgtcatttgggtgagtcacggctccttagtgaatcttggtaagaacatcaaggattcatcgttgttgctaaggttggttggtggaccgagacccagctgctcaaattgtttctccttgtttggaaatatcagggccgagtaattctgctttaagacttggatgagaaggctctttgcaagcaggaagcacccatgcccatacctcgaaggcccccttctgctttgaaggttctttggtgtatatcacaccccctccttcaaagagaattcccccagtgagccagttggcagggatgtatacaaaaggaaggacattatatttcctgttttagtatgaagggaaattaaaaatttaaaaaaaaaaaaccgtgggcaaatccactgaaatgtcaccacagcctgcacaaacatctaaaacctttggataaagaacttctctttgatacacggggtggggctgagggcagggaccccttttccatttgacaagaaaaaccttcttcacctttgtcaaacgtgaacagcagtcaaatagcatatttacaatagagaaaaggcatttttctgaatgttagaaatctgtggtgtatcaagtcctgactttatagatcttgagagttagactttgttttttccccccagggtgaaaataaattgagcaaaaagaagcattgtgaggaattggggcataaagcttctaatttgcattggttttgatccactggtcttttaagcactgcttgttatgtgtctgcattttctaggtattgtgcacacagactgcccccaagtcgtatttataggtttggaggtgagagctggcatcatgatccagtttcctagcggggtgcgttttgtgtgggaagaacggcaggatgggagcctctgaatgcatgatgaagactccagtagttctgccaccggggtgctgttagtcatatggtatcattctggtagaatttatttaaattatatttcaaattagcttgttagaataaaaatatgcttgtggggaacacatttagacatttgtcaaagactagagagatttaaaaaaaaaatttttattcataagcctggttgatagtcttattattattcctctgaggaattggagatggtagagtccccacccctgtgcagacaagcttaggatgaggctttgccactagccagaggagtcagggtgagagccgtgtattaaaaagaagctcttgagtacacaagtggctcccagtcaaaggagggccgaagtgagggcgggtcccagctatgcaggggctctaggaggcccctttctttgccctgcctggggaaatctctgtccagatcaccagtgaggggcaggccaagtccagtctgcctttagtcctccttttgttctgcgggtaatcttgtctgtgggttatggggtgggcggtatccacagggacctgatgagtgaggaatattgcagaccccactgcctgggcaatggatcctttttgggatctctaattgggaaagcttttaattggagtttttagataaatggaaaaacgaagagttgttttagcttgtgtcctgtgggagctggtgacagagagagtcctcatggggaaaaggaatggagcctcttccaggatgctccaaagacaaggaaaaggagctcccagtggaggtggcatcaagacatatttcagctcacttggtatgaggaagagctctctaactcctccaagtggactgagcgtagactcagctgtctcagctgcattgtcatggagcaccgttggttgtgggagctgggaaggctggttaagcacatacagctcaagccccagccctcctcaccctcactggctgtgtgagcttagatgacatattttctctctctaagctttactgtcctcatctattaaatgattgaggtgattaaatagaaaatgtgtatagagcatttagcacaatgccggacacataaatagtaaatgatggccaagtttatcatcattatcattaccactgccatcatttcttctttgggtgggaagttggccctttgggcaccgtctggagttaggtggttggggatgacatgtgcttccattccctcatccttaatccccttgggcactctctgagtcttcagccactgtgtggctgccttccagacgacccagtcactctgctcccagtcctgagcagtgccagagttggcttccagtcatcaggtgactcaggcaatccgaggcttaccctgtgaaatgttgcctcatattgctaagcctctcaggtggtgtgggtggaggaatgtcgccagccagaggatcgggaaggccgggagaatgagctgacccatgtatatcaacaagaaaaccggtctgccaactcgttgcttttacagggaggtgcaagtgtggacaaagttaagtggtttctccccattgtggcatcagactagggatttgtgttgctggtcagggagctcctcattgattatttgtatatgcattcgctcattcattcagcagtgacctacctgtgtcaggcattgtcgtgggtgctcggaacacagtgatggacatcggtggctctaggatgcttacaggctagtggagaagttggacatcacgtaaacactgcccaatggatgggcattggaggatgttgtaccaggggccatgtggactagtcagtagtttcagggtccctgtatgtctctggactcccatccttactcgtatggatctgaattcctttctgatcacccttcatcagttcgtcagctcttttacctttcttgatcctttggccaatgaccatcacctgaatgttgagtaccttctctgggctagacaccaggaagacaggtcgtaagacagagtccctgccttcctgagggagatggctggtgagcaggtaattagggcaatgaaataagcctgttattgaaatatgaacgtagatagatgcttaactctgtacgaagttagagaaggcttcctgaaggaggtgacatccaagctaaatcttgaaggataaagaggggtttctcaggcagacaaaatgaggaacagggcatttaggcagagagtgttgcctaagggaagtagtgaagtatgcgggtcaagaacagggaccttggacccagtctttgcctggccattcactgcctgtgtgactggagcaatgtgctgaccttctttgagcttccatttcttcatctgtgaaatgagaataataatagtattataccaatgttgtagggttgttgtaaggattgaatgaaacacacatgttgatttacattagctattaataataggcatggagatggaaaagaatgtggagtagaaggtgaatgtggagaaaggcttgggaaggtataggcatgaaggagagagctttgggctaaggtgttgggagttaatcctgtgagtggcagggagccagccataggtgaggctggaggtcaggggagcagcttgtcctggtgttgaagaatgaggcctgacctgggcatcaagcagtgggcttggagaggaagaggtgacttggggtgggtggcaggagcgcactatactgtatggacttcagtctgtaggcagtaagggaacattttcagttttgaagagaagaataatgcttgttttaggatttttttttttttttttttttttttgagacagactctcactctgtcgcccaggctagagtgcagtggtgtgaacttggctcaccgcagcctctgcctcccggttcaagcgattcttgcgcctcagcctcccgagtagctgggattacaggtgtgtaccaccacaaccggctaatttttgtatttttagtatagagggggtttcatcatgttggtcaggctggtcttgaactcctgatctgaagtgatctgcctgcttcggcctcccaaagtgctgggattacaggtgtgagccactgtacccagccaggaaaattattttagagatagtaatgaagggtagtatggagattggaaggaaagagacctcataggaactggtcacactccaggcaagaactgaagggatagagagagaaagctgatatagcagatttatataatgtaaaccttgccttgctctgtaatggatctgaggcagcttctagggttatatgtaatactgtaaaagaggaaaacatatggaagattccagacttctcactgggggtgagagttagatttttttttttttggaacagggtcttgctctgtcactcagggagtacactccagtgcagtgcaatcatagctcactgcagcctcaacctctgggcacaagcgatcctcccacctcaacctcctgagtagctggggccgcaggcacatgccaccatacacagctaatttttttttttaagacagagtctccttctgtcacccaggctagagtgcatctcagctcactgcaagctccacctctcaggttcacgccattctcctgcctcagcctcctgagtagctgggactacaggcaccagccaggcaccaggctaattttttgtatttttagtagagatggggtttcactgtgttagccaggatggtctcgatctcctgacctcgtgatccgcccgccttggcctcccaaagtgctgggattacaggcgtgacccaccacgcccagcccatgcacagctaattttttatgttttgtagagatagggttgcactatgttgctcaggctggtcttgatctcctgagcaatcctcccgccttgcaggtctttcatatatagttgttaaatgaggacacaattaagctatcatttaatgagaacttggtaggttggagtcactatgcagagtgctgtctatgcaatatctcatttaactctcacaacaacctccccattttctttttcttttttttattatactttaagttctagggtacatgtgcacaatgtgcagctttgttacatatgtatacatgtgccatgttggtgtgctgcacccattaactcgtcatttacattaggtatatctcctaatgctattccctccccactcccccgaccccacgacaggcctcggtgtgtgatgttccccaccctgtctccaggtgttctcattgttcaattcccacttatgagtgagaacatgcggtgtttggttttctgtccttgcgacagtttgctcagaatgatggtttttagcttcattcatgtccctacaaaggacatgaactcatccttttttattgctgcgtagtattccatggtgtatatgtgccacattttcttagtccagtctatcattgatggacatttggacaacctccccattttcacagttgaagagactgggcttaagagattcagtagcctaccaaagctgtcagtcaggacatggcagagttggaaaccaagcttgagcatatctgagagcaaaattcatgttcttttttttgttgttgttgagatagagtcttgctctttcacccaggctgcagtgcagtggtgcagtctcggctcactgaaacctctgcctcccaggttcaagcgatcttcctgcctcagccccccaagtagttgggactacaggtttgcaccacgacacctggctaattttttttgtatttttagtagagacggggttttgccatgttggccaggctggtctcgaacttctagccacaagtgatccgcccaccttgccctcccaaagtgctgggattacaggcgtgagccaccgtgcccggccaaaattcctgttcttaagatgcactttctggagaccaaagctcccatgagagtcatgtggtggatggactccactcttggttgttaggatgagagaatgcaagaggctgaattaccattgacgtgtatgtttctaggctgtgcggctgatagtggtgatgttgactgagattgggaacgtaagaggagatgcagttcttttggggaaaatgagagtttagttttgggcggatatggtgacttttcacttgtccaggctatccatagcaagtataaattcagctctaacactcaacagttcagatagagtcagagatacagatttgggagccatcacctctaagatggatttgaccttctaaggagaaagaaagtcaagaaggataaagatggaactctggccaaggcctgcaactggagggaaggaaaagaagccggtgaatgagcctgagaggtgatgagactcagaggaaggctggaggagagaggggttgcagaagccaggggagaggaggctgaaaaggggagcatcttcaacagggtcagaggcctcagaaagcttagaggaggcgggagactgagactgagactccctgtgggagtgggagtgttagggcactgagggagtttgagagcagcctcagccaaatgtgaaaacacaaatccatttgcaggcaaaatgcatttaataagtgagtatgtgaggagcgggtggagaagtctagctgatgatgaaggtagcttgaaagtgagtcagggtagaaggaccattgatgtttgtttcataagttgaggatgttgggagtctgagggtaaagaaaaggggagattgaatatcttagagaaggatgagaggcagtaaggttggaggcaggcggcaactagaggaagacctgaagaggagtgcatcgtcctcagagaccaggcaaggtgcaggtatagaggcattttgaggctgtggccagaagaggggcataggagcttgatcagctggcattttctttttttgcgggggacggtgtcttgctctgtcgcccaggctggagtgcagtggcgcgatctcaacttactgcaacctctgcctcctgggttcaagcaattctcctgtctcagcctcctgagtagctgggattacaggtgtgtaccaccacgcccggttaatttttgtgttttttcagtagagacggggtttcgccatgttggccaggctggtctcaaactcctgacttcaggtgatccacccacctcagcctcccaaagtgctgggattacaggcatgagccaccatgcccagctgagctggcattttcttctctgtgtgagataagggattgatctgagaaccggagggtagatcaagaaggaaaatgggttgataaagctggttgtagggttggggcgaggagtgagctgaagcaaatactgactagagaacagccttcagggaccggttgaagattgaagactgtgactttgtaaagctgccagtggccactggtagatggtgtgccaacatgccaagcaaccagggagtaagaacagatgcaagcagtcccagacccagaaggtgggtgcacagggacagccaccctgatcggactcggagtgctttgccatccacagccctgggcacaccatgtgggaggagggggagcctgctctgtctccattggtcacctctttgccctcacttctctgagttgccagtcattgttctgttgttaattcttccagaccctttctgaaaaatgcattaaaattctcaccagcatgacctctttgagtaatgagatctgtaagtttattaacctctgtgagaagtggattttcttgctccatgggagcggataatgtcttggagggaacgaacattaatgtgctgacctggagggcagaggcagtgtgagggcagcttatctgtgtccctcccaactctctgacttaacgtgtgtctcatggaactcagggaatatgggctgattgcttctgcacatcactgtccctcagcccactcagtccagcagcagcccagagtcagagaaaccaaaccataacaaaatccaagtttctgtcactgagtctcattcactaagtttgagaaggggaaagctgaaggtgagagcatgaagtcttatgcagagaagaatgtctagactgtatgtcattcacagtggcctgggaacccattggcgttgggaggggcagcaggatatttgctgtatgactatgttgaaacacatcctctgtcatcccagtgttggccttcaaatgtgcacatgtcatggatatttgacatgagctaagtagtgatgattcatgacttcatcctcattacttggatatttcaagcctgctataacctaacccaacctaatagtcttgtgtgtaccctgaatatttttggtccaggcccctctatattgtttagcacataaaacatttaattataatatgaagttataatctgttataatctgtgactcccccacccttgccttccagaccagctctgtctaatagaaataggagagctggccaggcatggtggctcacacctcacacactttgggaggcagaggcaggcagatcacttgagctcaggagttcatggagaaaccccatctcaaaaaaaaaaaaatacaaaaattagctaggcatggtggcatgcacctacagtcccagctacttgtgaggttgaggtgggaggatcgcttgaacctgggagacggaggttgcagcgagctgagatcacgccactgcagtccagtctgggtgacagagcaagagtctgtctcaaaaacaaacaaaaaaaagaaataggagaaccatgtatgtaattttaagttttccagtatccacattaaaagattgacaagaaacaagtgaaattaaaattttaatccaatataccaaaaatagtatcatttcaacatgtaatcaatggtgagcaaaacagacaccatccctctctgtgtggaatttacattctagtgagggagacagctccacctgtccctggcccctcccctgaaaacacaacctgtaaatggatccacaaataaaataactgcaggttgtgcttagtgccagagggaaaaaagcaagggctgagaccgactttagaatgtgtggttgtgagatgcccctctgaagaggtggtgacatttaggctgctaccgcatgtgcagaaagggagcagagcgttctaggtggaggaaagagcaggtgcaaagactgcaagtaggagggggatgtctggaatgtttgagagactgaagtcagaccagcagggcaggattgcagcaagtgaggggagggcaccctgtctcagattggagaaagacgtatgcgaggacgaaattgagctgaggcatggactggcggttttatttgatgggcagtatgattcaataaaagtgaaaggttttagcagggctgcagcatgatccttcttcagatttaagaagagcacacttctgctctgtgggggatgcagtggaaggggacaacagttgaaggaagcaaggagacccatcgaaggtctccaggtcaaagtggttgctggctgaggctgagaaggtcacagaggagacagaagtgggtgggttctacagaaggcttgcagatggatttgtaagaaccttcagatggatgagatatggcataagggatgagggagagggagagaataaagaaggcccctttgggttttaggttatgccactaggagatgtagggaagtctggaagaggagcaagttaggatgggggtgtgggagtcaaattcagtatcaacaggttcaggttgagggggtgagtggaggtggagctggggaggaggtaggtaattgtatgaatctgtggcttagccgagaggtcagctgggagaaggctagtgaggtcacccagggagggagggcaggcagagaaggagagggctcaggattgagtgtgtaacacccatcctttaggtggccatagaggaggaagagccagcagagaagatagaggaggagtggccagtgaggtgtggtggcctcagggtggccagtggagaagtgtcctaagcaggagagtttgggcattggtttgagcactgctgagatgggtccaggagccaggtgggttggaaggtgagtgcgaggctggggagcagggttatgtggaccacattttgaagaagttgactgttaagggagcagagaaataggaccatacatgagagggcgcaggtgcggagggaagcattgaaggcaggagatgcagcaggcgaggtgtgaggggagcgctgccagttgaaggcggggggcagaggagcccaggccttgagaagatgagaggctgtggttcagagccccagggaaggaggccaccatgacagagatgcaggcgggattggtgtggtgggaagacagagttcccatctgtggctcttcttttccatctgaagtatgaggcagggtcgtcagcagagagcgtgagtgggggacagggtgtgggaagctggaggagaaggtgatgtgaaattgttttccgggagtgggcggcaaggctaccagagaaacacaggcctgtcggccactgcagagtgacagtttgaggtcagagaacatgaatttaaagtgaaacttgtccaccctgttttgaccttgcccagtggcgtgggtgtgggtgtggaggaagcaggtggcagaaggcatcaggctggggttcggccaggcaggggggcaggatccaccggggattggtaaccatgagagaccatgggatggacatgggccctcccaggaagaaagggaggccgggaggtggctggtggagtggggaagtaaatcagtggcctggaggtctctgcgagatgggaaatgcatgtgcggggaactgggaggatgggtggtgtgggcgggaagcaagggatctgcagctcatgttttaaggtgatggaggattccagggtatggctgtgggtgagggtcactaaaggagcatggggaaggaggcattggagtggaagaggctgaggaactgagtccagggtgttgagggttatctctgtggatggtgacaggtggtgggcggaagaggaggctgggccaggagctgaagcccttggtgggtggcagaaagtaacgtggaggcaggcgaaggtgggtgggaacaggtggctgaatgacctcgcctccagggcacagagggactgcatgatgggggccaccaggatacccttccccctccctttctgttctgcatatgtggggggcggtggggagtgttgctctcagggactcactggtttccagtaaggcatgaaagtgaagagagtgttctggccagggatgctgaggcctgctgatttccagaaggatttcctgtgagtgtgggaggatagggagcgggaaggaccggctcagatttgggaacatccagggcagggagaactctgcgtgttgctgggtggcagggaagtgtggtgtccaccccttcccaaggtagagtgatggcacctattcatgtcttgggcatggggagtggggcgggtctttcgtgagtgtgagagagacttggggatttcgagtggaaggtgagctccctgtgagtcagccctggtgatgtggttgccaggatgctgcctcaaactctgaagaccttagtgaagtgtgaaagcactgtaggaaaggaggcagtgggcctgccccgctcccatctagaaccctgcgtttggttctgggcaccagaggtcccctaagtatagatgtatggaaggacatttggaggagagaatgcagagcaggaggggtctgggcatgtttctgtgagaatgatgagaaggtggggttcttggctgggtgcagtggctcacacctgtaaacctagcactttgggaggctgaggtgggaggattgcttgaagccacaagttcgagatcagcctggggtgatgtagtgagacctcttccctaccagtcattttttgtgttgttgtttctttttttattagctgggtgtggtggcatgcacctgtagtcccagctactcaggaggctgagacagcagaattccttgagcccaggaggtcgaggctgcagtgagccatgattgcaccactgcactccatcctggatgacagagcaagacctcatctcaaggaagggttcttaatgtgggatgtggggtctctgaacacccctgcccatcctatggagagttgtagataagtgtgtgcttgtctggggagggtgtccatagttttttttttttttatcagattttcaaaggggtccttgatccaaaggagattagcaccacctgtttaaaggacttgggcatacttagcctagagaagggacaacttgagctgacagtgagggcacggggaggagagagccgcccccctgtagattaccagctgccgtttgtggtggggagcttgctctatgtggacccacccagtggggttcagatcggtgggagggagcccagctttggctctgtgtgggcatctgagggagcctaagagcacctctcacagttggggtgtgcacagggcaggaggcaggaggagaaggcctgtgatgccgccaaaagctttgtccaaaccttgttctgaggagtaaacagctttgaacattgctgggttttcctcatcctcagagagagtgtcttgagggccgagctttgcgggagtgatgaagcccttgtggaggctcaggggtgtggctcaggaggcagcgcattaattctcatcttagggagtgcaccatcagcttgtcttggggcctcaattactcctctgtggtgtgagaatactgttccgtatggcattgccttggggtgtggtgggtagctcttccccaggtctttttttttcttttttcttttttttttttgagacagagtcttgctgtgttgcccaggctcaggctggagtgcagtggtgtgatcttggctcactgcaacctccagctcccaggttcaagcgattctcctgcctgagcctcccaagtagctgggactacaggtgcgcaccaccatgcctggctgatttttgtgattttagcagagacagggttttgccatgttggccatgctagtcgcaaactcctgacctcaagtgatccaccttccttggcctcccaaagtgctgggattacaggcgtgagccaccacgcccggccctcttccctacatcttactcgggaatgagctctcctgcataggcctttgcttgcccacctagatggtctctagcattgggctgtcttccataatatggatggagttgggtgagaagagtgctgaattaggccccccaggcctgggtttgagcacagctttatctcgtagtagaaagtcctgtcttcccctcacccagtgtgttcctagtgatggttagggctcctgtctttctttggcactaacagaatcagattcagtaaatttaaagtgactcctgtgagacagaactgctggttaattgagtttgactttgtgagagtgtcctctctttttcttctgtcagttttgttttgttttgttttgttttgttttttgagacggagtctcgctctgtcgcccatgctggagtgcagtggcgcgatctcggctcatggcaacctctgccttttgggttcaagcgattctcctgcgtcagtcttctgagtagctgggactacaggtgcatgccaccacacccaactaattttttgtatttttagtagagacggggtttcaccgtgttagccaggatggtctcgatctcctgacctcgtgatctgcctgcctcggcctcccaaagtgctgggattataggcatgagccaccgcacctggccttttttttttttttttttttaaagcaggcatgcttcaccaaggatgaaatattctgaaaaactggaattggaatcccacagcctgattgaaagccatatcactggcttcaagggagggagctaaaaaaagctactccttggcttctcccatgaattttaaatgttctgaaagctttgccttgagaaggaaacaatgcctcatgccttaaataattaagtggagtacactaagaatggcagtgtcagcccaggctggtcacactgtggccccagggggcctgtctctcaagggcagagctctgtgggtgctggacgaagttgtcctcatagcaaaaattggtacagcttcaaatactgccttttaggcatttggtgaaattggcataaccctggaaatgtcataaaagaggatgaaggtggcatgtggtagaatgcaagctttttttttttttttgatacagtgtcttgttctgtcgtccaggctagagtgcagtggctagatcttggctctgtatgggcaactgagggagcccaagagcacctctcataggcggggtgtgcacagggcaggaggtgcacagggcacactgcaacctccgcctcccgggttcaagtgagtctcctgcctcagcccccccaagtagctgggattacaggtgcccgccaccacacccgactaactttggtatttttagtagagacggggtttcattatgttggccaggctggtctcaaactccagacctcaagtgatctaccctcctcggcctcccaaagttcttggattacaggcatgagccaccacacccagccagaatgcaagttttctgctgaaaagctgcatccatcagctgtttgtatcagacaaacagtgaattcttagctggccttaatttgcccctccactgccacatgactgtccatgtgggatgactgtgggccaggcccaagtctgtatcctcccaacaactatagtattggcagtggtttctctgtacacttggtggaaacttctggagaatctgtgcagggaaaaggctactttatcttcaggcagaagaccctcccttcaggggcagtgatggcatctcagagctgcttcctggctgtctgtgcactctgtgattgcaccggacgcttacctctgaggctgcaggatggcatgctgtacagacgtcaggtcatgccaggcggtccttgtggtatcttacatggtttctgtggaagagtgagttctgccggggtaactaatacttattgactccctttatacggtatttcatttgagcttcacattttatggataaactagagttgagagaggtggagtgacttggttaaggtcacacagccagcacacagagtgaagttggtggttatgtgtgtggtccgaccctgagggaagtcacccagagggtcacattttgtgagacttttatagttccatgagaaaaacagcctttatttcaagagtacaacttgaagtctaaaaccaaaagcagagatgtgcctcagaaaagctgtgttaggccgggcgtggtggctcacgcctgtaatcccagcactttgggaggccgaggcggacggatcactggaggtcggagttcaagaccagcctgaccaacatggagaagccccatctctactaaaaatacaaaattagccaggcgtggtggcacatgcctgtaatcccagctactcgggaggctgaggtaggagaatcacttgagcccagcaggcggaggttgaggtgagccaagatcctgcccctacacttcagcctgggcaacaagagcgaaactccgtctcaaaaaaaaaacaacaaaactgtgttagcatacctgtaacagggtggaggctagtagccgaggcttcctttgattttttttttttttttttttttgatagtctcactctgtcacccaggctggagtgtgcagtgacgcgatctcggctcactgcaatctccgcctcctgggttcaagtgattctcttgcctcagcctcccaagtagctgggattacaggtgtgtaccactacacctggctaatttttgtatttttagtagagacggggtttctccatgttgggcaggctggtcttgaactcctgacctcaggtgttccacccgccttgacctcccaaagtgctgggattacgggcgtgagccaccgtgcctggcctcctatggatttcttttgctcagaacctgctaagccgttttccttgtcttccctttctcatccatctatctcccagcttctccctggtcctttttctcaggtttcagcagagtttctcagaatgatttagttctttgatcctgttggattgtatattacgatcacttctatgaaggcattattcagattacgtggtaggaatctaaatctcaaataagttaagcctgttaggctgggtctatgatcggctgtattgatactaatcttgacacacagcagggttgtaagctccccaaagcccacattgctcaccctctttttggccttgaatcagaatcttttccatacccagcaatgattcacactttagatggtcgtctgcattgttgattgtctcaaagatgcatgacagcttttttttttttttttttttagtttttatttttttgccagttgttacagctgtttttttgtagatggggctctcctggctgtaataggattcatctgttgggaatgtgagagggaaggtgatgtggttttcgggactggtttctcaaatcaaacagcactttatctccatagaagttgggagtttcaagctcctctatcctaggtgagaggtgagactgactttgagaagtgaaatttggttctttatgcatcttacaaaaatcggttgtttaatttatttatatgccctttttcttggagcaagtctacccattaaaggctaaactaacctagtgaataacgaatgcagcttgatgaagaagttacagtctaaaattatgatctgaacctagataggatcttgttaagtatttattgctggttattcatggttgcagtcttctaggtaatctgtttttattttttatttgcttttgttttctaaccaaaagagagctggagtaggtaatctggttttagaatgaaaatttttaggaagtctttggaactgttcttggtaacaggtaaagtccatttccccctacatccatgcaattaaatatttgcatggcggaaacagaaaccagtctatgtgctcagacctctcatgttctaaaggcttccaatgttttgtgcttggggttatcagaatcaacagctttatttaggttacctgtgttgcggtggccgccagtgggaagagagctgcgtccaagcagtccaggtggaggttacccttgcacacaatagatttagcccagtagtgtacttctggctggtctttaggccagcagtgcatttctagcagagaaaccactgccaatactatagtggttgagaggatacagagttgggccgggcccgcagtcatcccacatgggcagtcatgctgccgtggaggggcagaagtagcctagcggtgcacttttttttttttttttttttttgagacggagtttttgctcttgttgtccaggctggaatgcacaatggcacaatctcagctcactgcaacttccgcctcccggtttcaatcaattctccttcctcagcctccgaagtagctgggattacaggcatgcactactatgcccggctaattttttgtatttagtagagatggggttttaccatgttggttaggctgatcttgaactcctgacttcacgtgatccacccaccttggcctcccaaagtgctgggattacaggcgtgagccactgcgcccagccagcagtgcacttcttacatcctaactttgctcctccattcacgcagttaactaatatttactgagtacttgcccctgtccttgtagagcttacagtatagcaaggaacatgggaattgaatattataaaaataattactcaattatggaatataaaatatataaattgcagtgtggtttccaggactggtttcccaatcaagcaacactttatcgctatagaaattgggagtttcaagctcctccgtcctaggtaagaggtgagtaattattacaaaagtaattcctcaattataattcactcattcagtgagtatttgttaagtatctagtgtaggctaggcactgttcatgggagtgatgatatccatgaaccagacagacaagaattcttgccttttgaagcttacattttaatgagacatgcattaaatgaaaacaacaaataagtaaatttcatggcatgttagaaggtggtaagtgttgtgggacacaacagaggcaggtgtcgatgactgggagtatgggctgggctgggagtggcatcatatgtgctagagcctgaatgtttgtgtcccccacggattcatatgttgaaatcaaatcatgaatgtgatggtattaggaggtggggactttgttggggtgattaggtcataggagtagagccctcattaaagggattagttcctgtcttagtccattttgtgctgctgtaacagaatactacagtctgggtaatttgtaatgaacagaaatttactggcttaccattctggaggctgggtagtttagtatcaaggtgcaggcatttggggagggtcttgcttgtcatcacataatgaaagggcaaagagagagaaaaaagggtggaactcacccttgtataatggcatcaatcctccccatgagggtgaagccctcatggtctgatcacctcttcaaggctccacctcttaatactgttacaatggcaattacatttctttctttctttctttttgaagacagtcttgctgtgttgcccaggctggagtgcagtggcacaatctcagctcactgcaacctccaccttctgggctcaagtgattctcctgcctcagcctcctgagtagctgggattacaggtgtgtgccaacacgcccagctaatttttgtatttttagtagagacgaggtttcaccatgttggccaggctggtctcaaactcctaagctcagatgatctgcctgcctcggcctccaaaagtgctgggattacaagtgtaagccaccccacctggtcgaaattaaatttcaacatgagttttggaggggacagacaaactaaagcggtccttataaaagaggcctgagagagctgccttgctgcttccatcacatgaggatacagtgagagtatgccatctgtgagtcagaaagtgtgccctcaccagacaccaaatctactggcaccttgactttggacctctcatcagaactgtgagaaataaatttctgttgtttataagctatacgcagcctctcgtattttgtgatagcagcccgtgtggactgggacagtgtgtgtcagtgtcagggagtgggatatatgacatgaagattatagatgggttggacttactggtaatgaaaggttatgacagggagttggagaggcaagagaagagaaggtcaagaactgagcccagctggaagaaccatctatgtgtgtattgaaatcacaaagaatcaagacaagattagtgtaggagagagggactgtgatctagagctaaaatcattgagaaatgagggggagtatcatgggggttggtggttgacagagtctgatgataggagattcagggctggggaattttagggagggggaagagaattatctagaaggggcaatgaggagcctagtggtccagctgtgaaaatgttctgaaggagaattatggggtgccatgaaagcaaataataggtatctaacctggtatggaggggctgggaaggcttccctgaggaagtgacatttgagagggtggtgggttgggctagaggaggtcaaagggaagaaggaactcttaagggttacacagccaaagggaaatttctctgaacagttctgggggctgaatgtggacaaggagcttgagagaaagaggatttcccaaggtagtgcaaactaactccagcccatctagaatcctcattttatgcatgccaccctctgaaactgacacacatggtcctaggcagttcaggctgctatcatgggaggaagagacctgttgtggtagctggtggctacagagagacccaggggaccacatggaggttctgtgtggccacccagggggctggctgttgaggcaccaggtcctgcctaatgccccatcttactgaccccatggctggttgatgaacatggtctaaacaggcgtgagaggcacctgcaggggctgtgaaaccttgggctggaacctgaaggttttgggaacttaaggagtatttttgggctttctcctgagtgggactttgggaaaggctgtggagatcctattgatgagaggcttgggatttctgaatcattccttaaggcctgagatgacagctttggtaagggatggataaggatgaacctgtttaccccaagatcagctgagcacctcaagggcttcagcctaaacatagtggtagggggagaggaaaagggctgaggtggtctgggagaagagtgggtagaacaaaggtgtgggaaataactgatgatatgcacaatggaacaaagtaaagggaccctggagcatcacgttgggcttaggtgactgtcactgagtagctatgtgtggctttggacaagttacttaatctttttttcctttctgttttcctctgtgaaacaaagtatagatgccgatttctcaaggttgttgggaaaattgggtgagatgtatgtcagtgcccagcatgatgcccagcccacaacaggtgatcaataagcactagaacctccaggaagtaccttttccaaggttctgctgagattgcggggagcggatcttagcaagcattgccgtatgaccatggaaaggcattttctgtttagaaaacagatctcttaggagcagactgtgaattgccctgaagccctaagatgtaaatgtgcatggaaacatgtcaatctgaggatggaagcttgaagaagataaaagtgaagtcgggagaagtctacacacacaagccatgtggccctttggagaagacaagtgacatgtccctggtgcatgggaacaagcaggggctgttctggggccagactcaaaaaaaaaaaaaaaaaaagggccagcacacatgggccccagctgtctagacacctgctggcagcctcattttactaaaagtcaagcattgaaccttttccaaagggagaataaactctagaagatccagtaccatagccccacatctgattgatcttaacccgttacccacacagcagccaaagcactccagagtgacgggagaatgtgccggtcttctgttagctgcttacttctgtgtgctgaagacctaccaatactccgtaccttttctttccaaacccaaagaagtgtacaaggaactttactgagtgcttgctcccatcacctcttgttctctctttctctgtctctctatgtctgcacgcctctctctcacctctttgttgacacatttcctgggtgccaagctctgtcttaattctggctgagacacggcacgtaagatgtagtcatgacccttaaatttaccctggtagagctgtgctttacagcctctttcagaccaggcagggcgcattgggaagggtcacttgtacaaccgactggggaaaatgaaggaggttgatggtaagatcaaccataagccagggttccagctgtcaggccctgccaggagccgagagggtcagtgtacctcagcataccctgcgtgagtgtgggtgggtatgtgcacacttgcatgcgtgcatgggaggagaacattatctagcggttctgctgtagagcatgttctcagctccctgtactgtccaacaaagagctgctgtttgctttttggaattacacagggtcccactaggcaggagctggtcactctgagccctctgagactggggttcactcaaagcctctggccacaacatcaagcacctttttttttttttttttttgagacggactcttgctctgtcactcaagctggagtgcaatggcgtgatctcagctcactgcaacctccacctcccaggttcaagcaattctcatgcctcagcctcctgagtagctgggactgcaggcacgtgtcaccagacccctctaattttttgtatttttagtagagatggggtttcaccatgttggccaggctcgtctcgaactcctgacgtcaggtgatgcccctgcctcagcctcccaaagtgttgggattataggtgtgagccactgcgcctggcccaagcacctcttttatcaaggcactacaggggccccagaaatgaaaacctgatccctacccaaggggacttgcagcccaatttggggggaacacatctctagctacccaaagatgagcctgaataacatatgacggccacgagtgaggtatagagagagctggtatccagggagagaacccagtctggtgttggagccacgtgcctctgatggaagaggtgaccaatttgcactttgccctgaagggtggtaggattctgacctgggggtggtgtgctcagtgcaggggtgacatgagcagggggcattctggaggaaggcacagctcctcggaaagcacaggtatggggtgagcagggacatctgttaagcctgtaggttgggtgcagggattgatagggaggagatgacaaagttaggtggagacaaaggctgagtgaggacttggattttggctcagaaggctgccttcacaacctgttcatgaatagctggacaggcggacacctgtggttggtttgaatggagtgcagttggccctgtgtagtacaagggaatcaagcataaaaaaaggctcccttcacttgtgtctcactcgtttgaggttcacaagggctaactttctattgaatgtggcctctctcggcttcttccgagccagcatatacctagtgccgctgggctatgtaaagctgtggacacaaactatttttgtgctccttcaaatgcccatgtttatttttaaacttgaggctttgtaaagcagggaggtatcatgcaggctttacttttgagtaaaaaggttctcttgggctgatagaacctgcaaaaagtgttcttgatttagagttgtgcattctcttaatgcctcaatgcctgtagtctggcattatagggaaggccatggaactcatttgctttaaaacaaatcctggaaagaggaaaccccacatatgtttgccagttccttaaagtgtcctggcagatctgtgtcaggggcagtggtgctcatacaaggaaggtctttcagtgttggaggtggggtgggtgtgacaagctgggatgtaaatctgaatgtgccaagcccacctccaacctcccaccaataggagcccttggacaaggagcttagaatagaatatctgttatcttttaagcatatgcaagttataactgaaaaatgaatgagattaacttaatgttcaagatggaggattcagcacttgtgcttatttataccttctctccccagaacccattaaaatgataataaggagattatgaaaagtataatcccaggacagcaaaatgaatgggagggaattatcagtagttgagagattacaataaatttctggaccatagaaagctagtagaggaaaggcaatgtcagaaatatagcacagaggagaccagagcccagagtctgagtggaggggccacagggagttggggtagctgaccagtctgccctgcacaaccccagagaccctctgaactgagtctgcaggtccagcaagggcaggagtgagaagtggtgctgaagctggggctttaattggaggtctcaggtgatactaggtgatactcctgccacagggacactgtgcatatcagcgggatgggggacgagtggactccactggcagagccaagactgggagtgtggatgttggcattctagaataaagtcttccttggtctggcgtgcatccagggtaggcggatggtatttggaagcatggtatcagctcagatcagcgtggggaaagggggaaagtgtgacgtgctccagcaccaaggagtccggaaggggaggaggagccagcagaagcagcttctcatcagataagatgacaggagaagagtggagcaaggcctgcacagtggcacatgagggaaaacctgttttttttgagatggagtctcactctgtcctccaggctggagtgcagtggtgcgatcttggctcactgcaacctccgcctcccgggttcaagtgattttcgtgcctcagctagctgggattacaggtgtgtgccaccacacctggttaattttttgtattttttgtagagatggggtttccccatgttggccagcctggtcttgaactcctgacctcaggtgatctgcccaccttggcctcccaaagtgctgggattacaagtgtgagccaccatgcccgtctgaaaatcattttttttaagccatttaaaacaattgttttaagctgagtgctgtggtagtcgcagctcctagggaggctgaagtaagaggattgcttgagcccaagaatttgaatctagcctgggcaacatagtaagactttgtgtcttaaaaaaaaaaaaaaaaaagattgttttacccccagagtggtaggctaaaaaatgtctcccatagatatatcagatgctcatttctgaacctacgttaccgtatatgttaaagggtctttgcagatatgataagttaaggactttgagatggggaggttatcctgcattatccagggcccagtgtaatcacaagtgttctgaagagagtagcagagggagattttactacacacagaatagagaagaggatgtgaggatctctgcagagagctttgaagatgctttgctgcaggctttgaagatggaggaggaggccatgagccaaggaacgcagctctagaagctgggaaaggtggggcaatggatgcttccttagagcttccaaccctagagcctctggaggcagcatggccctggcgacaccttggtttcagcccagtcaactgactgcggatttctgccctccagagctgtgagaaaataaattcctgtcatgtaagcccccaagtttgtgggaatttggtacagcagccctaggatacatccagccaaaaccaatcaagtataagggggaaagtaaaggccattcctgatgtgcaaggacttaaagttgacctcccgctcatcttgaggatctacaacagcaaaacaatggcgaagactatgaaggaggtcatgatgtggggaagtgggcaaaaagaattgatggctcctgggagtctggtgaaaagaacttctggacagatggctatgaatgggcctcagaagcattcactccaaattacaggtggaagttactggctccaagaataatatcttgaggacagagactggagcagattccagacaatggacagagtgaacaagctggaatatactagggttatgggaagacgggctgtgtttctttcctcgatagagaaggcaataggaaaacatcacaaaaattaaaaattatcacaagcatgtcatgtttcaaatatgaagtgcacgaaagataccgcctgcttttgaacaactgggagagtgctagaaaggagaagcttctctctgaccttgatactaggaatgttttcctgtgagtagcactctgctgttgacattggaactgtacagaaagaactataatcctggcacattttttgcctctgcagggaacaatatttatatagtcataagaatgttcttttttaaaagggttacatagtactctattgtgttaatttattgacttgattcttcctggtactggacgttccaattaatttctggttgacctttttgtaaataatgctcaaacctgaggtcagtttgatctgtgaagcctctttgttgggagagttggataattggattattatactagtaatgtatgattatgtatgagaagggactccacatgcaacaatgatgactgaattctgcagggaggtggttgatggcttacctaatgactctccctcactgggctgagctgtttgtgctgggcgtctggccaacaggccaacctgtccttgatcctgtatggacgagcaacccgttgtgacttccctgagtaaggcctgaaggcagagagaggtgttgggtagagcaggcatgttaacttacatgtctggtataaatgggagagacctgagcttgtttttgccaacagaagagatccagaagcacagaggggctattggtgtaatctaggtcagtgtttcccaatctttttagtgtcacggacacatggaaaatatgtttacagcacctaggcaaatggacaaaacagtgcccagccctgggactcctgtggcccaggccctgctctgcaccctgagggttgagatccccttctcagcaggctacttcttcccaggacaagtgacatctttgtacaaattagaaaaaaacgcttctttaagacaccttctggaaatctgtgatctgccaggcagttgatgtaatgagtctgcgtgtctttcatgattgacactcagagttgtgccctgcacagccatttacggggccgagttcaacacacctgtggcccattggaggacactactaggtaggaggctgacagcctgggctgctgaggagaggacagcgagggagatgttcctgctgtgtgctgggtgtgagattcccaggtttctgccatagtgacagatccagtggtgtgagtcactgaaataggggtgcagggagaacagcagcagggaggtaaggtgcaagcatggggttcaggagagacacctgggctggaggtacacattcaggtgtcatcacatagacatgtcctcaaagctgtggaggtgagtgtggaggggaaaccccatggagaagaactaagggaatgagcccccaccagaccacccagcctcacctgctgaggtggggcctgatactcaagtaggacacggaaatgaggccctggtaggagagaaatctgagcactgtggtatcctgtcccgtgggcactgtcccaacatgatcacactgtcctgagaatagcatctgcctgctctagaggatccctggcaaagacctctggctgtgacacctgaaccccagagcaccgtggcctgagtatctgtaccctcaggtgctggagtttctgcacccagtactcatcctgagtcactgccagtgagtgctgtccgggagggatggcgtctatatatctctgtgtccctagggtcaagcgttagatttttgaaggattcttatgagagtagacactgggactttgatgagtgtgtaatgcggctcgggcaatgctgcctgcttttagtccctagttagctctgggccatttgctgcccaggtgttctccatgatcctgctccgagctgctcctcggagtagatggtccagctgaggagcaggctgacccagtcctgcagggctctagtctcagcagcagtctcgcccctaaactataaggatttggggcccccacacctgtcttagaccagatgaggttgatttcacttttgcccttgacattgtgggaaataatagagatgagttttgccttgctgggcacatgtgatataattttaaagccaaataatctagtttagcaagtattttgggcctactgtgtgcataggcctgcagcatatgaaaggctggtgggaggcacactgtttccaagtgtttacagcaagctcaccatggctgtagaacaatgggtttattcttcttaactagttttccttccttgaagacttcccttaaatgcctcaatctcataatattctaaacacgtaacttctccctctcacatacactggggtttgctgctgtccccacgggggcggatcttccccgcttgcaccttcctgcatgtgtctttggtatcatgtgccatgtccttgggtgcgaaggaaagggctgttccagcagttccccctggggccctgggagaggagggacaggtgcctgtgctatttccccaagataaagggcagctgttctgctctcagcctgctctagctggtaacataccttcacttgtggctgggatcctatcaattcttgaggccaccttggtgatatcctgcagattagaaaaccgtttggcggttatatgtgacttcttagagcaatgaagaaatgaggaaataaattactttttcataaattctgcctagaagggcaaactctttcaataatgggatttatagggaaaatgcaaatcagaaatgggtacttcttgttcagtgggttaactgtgagttagaaaaaaacaaaaattgtaaaatgagggctctgggccgggcacggtggctcacacctgtaatcccagcactttgagaggccgaggcaggcgaatcacaaggtcaagagatcgaggccatcctggccaacatggtgaaaccccgtctctactaaaaatacaaaaattagctggacattgtggcgtgcgcctgtaatcccagctactcgggaggttgaggcaggataatcacttgaacccagggggtggaggttgcagtaacccgagatcgcgccattgcactccagtctggcaacagagtgagactctgtctcaaaaaaaaaaaaatgagggctctggctctttccagagcagcccatactttgggccaagcagctggcaactcagggctcagctctcttagtgccaagtccccatccagcttgtgtcatctttgtccctttgccatctaaagctcttgagagtacttaacctctccccctctgccgaccctggtgtttggagcaccctcacacctgttctgtttggtccagcggggtctgcacttgacctttagattgggaagcaagagacactggcctctctcttgcctggataagacttctcattgcagcaaggctgtcctcacgtcacatgcatgcaatagacctattctcaatcctgtcggaagacccttgctttagggtcactgttttgtacctcatcccatgtacacacaggtgctcagacagacaggtaccaatctccctggattctgaggccatggctgtcttgtttcctgggatattcttggcacccagcacagctctcctttatagttgtggattaaatatttgttaagttaatatatatttgtacacatatttataagaatgggagcagaggatggtgctgtttagcaactcgctcttttcactccacgctccgagtgttggctgaatatttttggaattctggaacccatgaattctttgtttccccccattattttgtttcctctgaggcaagaagtttcaagtgacactcaagtccttcaaggtctggctaattctatttggtagggaaggggacagaaagttgtagctaggctgggactcagcaacactgggtggtctctttattttgtaacagtgaagtatagaatcaatcagaatacataaagaaaagaagaccatctttccatgtgagcaaatatttacttataattttgaaaggccaagtggtacttttcgcacggatatatcatacttaatttaaccaatcctcaactttggggcatttagtttatttacaggtttatttttgtttgtttgtttttgtttttaataagcagctcttcagtgactatcctttggcataagtatctttgtatatccttatttatcacttttgaatagattccaagaagtggagttgttgggttgaggagtatgcagttctaaggctttatttatctatttatttgagacagggcagctcactgcagccttgaactcccaggcccaggcaatcctcccacgttagcctcccagcagctgggactacaggcacgtgccaccatgcccggcaaattttgtttgtttgtttgtttgtttgttttttgtagcgaaggggtctcccttggtcttcaactcctaggctcaagtgatccactcctctcagcctcccaaagtgcctggattacaggcatgagccactgtacctggcagttctgagactttggatgtgtgatgataaattgcctcccagtgaattctatcaaggtatagtactccaacagtggtgtggaagaggcagacagtggggtttttttccagtcttctaaaaaaattatggcaaaatttatataacataatattatgataacataaacattaccattttagccatgttacatgtatagagttcagggcattaagtgcattcacactgttctacaaccatcatcactatctccagaattctttcagcagttgattttttttttttttcaattaaaaaaaattgaaaaaattttcagttgagcctcgaattcctgggctcaagtgatcctcctgcctcagcctccccagtagctgggactacaggcacacaccatcacacccagctagtttttgtattttttgtcacattatgttgctcaggctgatctcaaactcttggcctcaagcattcctcccacttcggcttcccaaggcgctaaggttacaggtgtgagccactgtgcccacctccatctgtcctctaaatgcacgccctttgcaggtttctctttggtgccattgagctgttcttcacagttgctcttcctccctttgtcctcctaaggactcagtcctgtcattatctctgtgaagccatccccgacctcaccaggagttgctcccagcacactttgttgttgtttagtaaaacacacataaaatgtaccacctaaatcatttgtaagtgtacagttcagtggcattaagcttattcacaatgtcgtgtagccatcactactctccatttccagaacttttcatcatcccaaacagaaactctgaacccattaagcaataactccccattccctcctcccccagccactggtaatcactgttctactttctgtctctatgaatttgacaatttgattcatataagtggactcatagaatatttattttgtgactggtttatttcacttagcatatttccaaagttcatccatgttgtagcatatagtggacttccttttttttttttttttttttaaagatggagtctcactctgccacccaggctggagtgcagtggcatgatcttggctcactgcaagctctgcctcccgggttcacgctgttctcctgcctcagcctcccaagtagctgggactacaggtgcccaccaccatgcctggctaattgtgtgtgtgtgtgtgtgtgtgtgtgtgtgtgtgtgtgtgtgtgtgtgtatttttagtagagatggggtttcaccgtgttagccaggatggtctcgatctcctgacctcgtgatctgcccggctcagcctcccaaagtctgggattacaggcataagccaccgcacctggccgactttcattcctttttaaggctattcgattctatgtgtatgccacattttgtttatccatttatctgttgatagactttgggtcgtttctactttgtggctgttgtgaataatgctgctttgaacctgggcatacaagtagctgtttgggtctgctttcaatgcttttgggtatatacctagaagaattgcagggccacgtggaaatgctgtatttaactttttgaggaagcaccagttttccacagccctgtacacgttttaaataaatgaccagaaaagagatggcacctgagaattcccagggagccaggatgagggactggcagtgggggattctggaggaagggtccaggatggagggactgcagcaagaacatttcctaaggcatgcaaagcttgactgtgtgatctgctgtctaccgtcaatagtttactcttctaagcaggggtttgtgttgctttcaggaagatggcctgatagagtgctgctgttgggatgaaattacagaagcaagaacaatagcagaaatagggggaggcaggctgtgtgccctgggctgtaggcagtaggtcagactctcaggctctgctggtaggcaccattggttaggaactgcatggggtttccagatgcagaagagaagttctagaaggatctggagctaccctctccgtgtagctcaggcttcttcaagatgatcagactacatcaggcaatgtttgctgttaaaaaaaaaaaatcagactaacctggaggcaaagtaagaaaagtggatgttctccttgggcactggtggctgccataaccaccctctccagggcacagggatgctgagctttaactccatcgtggcacttcatacaaggagtgaatagcagagtccagtatgacatcttcgtcgtctttgaaatatggcctgcccactatctgcaggtttgcttgtaacttccaaggctgcaccgcataaaaaccatttgctttacagttacctgactccctcttgtctctctacaccccagttttctgtgttttcagtatttctaagagcattatttaaaattttcctgttaataaaagaccctgaaataggttaactagtgtgtgaggttccctccttgggcagctgcaacccaagaaagtcattcagggcccagaacagtcacacacacacagtccgcctacttagggtataggctgccttcagataggtacacggttgttcctttagagatgtgcccggtatctgtcatccttcacttcacacccagtaggatggctatatcaaaaagacagacaataacaagtgttggtgagaatgtgcacaaattggaacgcttatacattgctggtgggaacataaatggagcagctgttttggaagccagcctgacggttcctcaaaagctaaacatagagttatcctatgacttaacaatgccactcctaggtatatatacccaagagccaagaaaacatatgtccacataattatagtatatggatattcatagcagcattatttgtaatagccaaaagatggaaacaaccctaatgtccatcagatgaagaatggattaaaaaaaaagtgatatatccatacagtgggctataatacagccataaaaagaatgaaacactgatatatattgacatggatcaacctcagaaatattacgctcactgaaaagaaaagctagatataaaaagccacatattatatgattcaatttatatgaaatgcctgaaacaggcaaattcagagagacagaaagtaagttagtggttgctaggggctgggggaagaggagaatgattgctaatgagtacggggtttgaggggtgctctgaaaatgccctgaaattaagcagtggtgatggttacgcaattctgtgaataaaaagccactgaattggggactttaaaaaggtagattttatggtgtccacattatatctcaatacaaataactttaaaaattattcattttttatgtgaaatttaaattcatttatttattttttgggacagagtttcactctgttgcccaggctggagtgcagtggtgcgatcttggctcactgcaacctccgcctcctgggttcaagcaattctcctgcctcagcctcccaagtggctgggattacaggtacttgccaccacacctagctaatttttgtacttttgtagagatgggggttttaccatgttgaccagtctggtctcgaactcctgacctcaggtgaggtcctgtctcggcctcccaaagtgctggaattacaggtgtgaaccacctcacccggccgtgaaatttaaatttagctgaaagtcctgtctttttatctgccaaatctggcaactctatacttgccaactgttcttgtaaataaagttttattggaacacacacatatagccattagcctgagagaccaactgatagtgtaaatgaaaatataaacactcttttgaggtatgtctgcacctttggttttatgctttacactttttgtaattgacttggcaagttaccagctctttacaccatgcaatctaattttaaactaaagtgattcctaggaaaataaaaaaacagctttttttcccctaaacctaaattcagagtggtagccgtacatttacaacgactggcttctagaagtggtactagggtacttcttgctgctacctggaaacctgaaagggtaggtacctgggaaccataaaaccagtttgccaaaactagaactaatttgcaagtaaaggaaaaaaacaagtcctagacttctaagtttttaaactttgaacaattttcttaagttataaaagcacagttattctttttgaagatttctttgtttaatttgctgatggtaatagggagagagagctagattctctatgggagggttgagctgtctaaggtggcaaagggattctcttccctgcagtggcgtcttacacctataatcaacataacattcctttaacagtctgctattaatagcaaaaaggcactttgcacatgttatcacatttaatcttaacaaacccttgaggtggttatattaatgtccctacctcacacagactgaagggacttagccctgaaccctcctcccttactccttaagaagagaaacggaaaagttgtgtggagcagccttcctcttgtttaactttgaccctgacagaaaccagacttgaaactaggcactgttacgttgctgagacaaaatgaagaatgtttctgaggagaacaaaaatcacctggtgaccattgaacaggccccggagacaaaaactcccatctgaggaatttagaagggagcaaagaccacctggtgaccatcaaacacgccttccgaggcaaactccttatctgggaaattagaagtaattgcacttccctattatctaaagcaggcatctggttccagatttctttcccccaaaatttataagtcactaggatttctatacatctccagaatgccatgccaaaacgtactgtgcaacccttgctgacattaaggcaccagaattactacagatgtaatcatttatcatgacctacgtggctagtatggtccaaattaccctcaagctcctgccttaaggtccataaatacccctaaggaaaaatccaccataaggtgctcagtcctctcaccgactcaccccactggactcctcggcagcgttccttctttctaataaaacttcttcaagcctatatggttgtcagtaaattcttaccaacccacgagtcaaccactttacaatgtgggggctttgacacctcacctggcagtatcatctttttaatgtgtatttgagatgtccgtcactttctttacctttctcagtaaaggtagggaaacaagttagccttttttttttttttttttttttttttttgagacagaatcttgctctgttacccaggctggagtgcagtagcatgatctcagcttactgcaacttctacctcccaggttcaagcgattctcctgcctcagcctcctgagtagctgagattacaggcacacaccaccatgcctggctaatttgtatttttagtagagacggggtttcaccatgttggccaggctggtctcaaactcctgacctcgggtgatctatctgtcccggcctcccaaagtgttgggattacaggcatgagccaccgcacccagctgaaacaagttagcttttaatatgatatgtaactgtaggatacagtaaaattcctcttcaaaggttttagcctgttaacttcctttaaaatccaagagtggaaaagttgttaagtacaatgagttctgagttcctcttcaaagagccaatatgtcagtatgttcagctctctggttctttgttctccattttaaagtttaacttccttgttctttacacctccttgcccctagcttcagtaaatgaccccctcctagcctctattacctgctctgaccttagtcatccttggtcacctgctctgtccttagtcatccttggtcacctgctctgtccttagtcatccttagtcacctgttctgtaaccatccctcccgccaaaactactcaccccaccactccaatttgtaccgctgtcctctttaaaatagccaatcagaattagcttagactgtgcagtccaaccctagccaacaggggaaagacacagcagtagggactaactgcgttaggaagaagacccctttcccctcccttgtcgagtgtgctctcgccattgctccatctgtgaggtgcacccttctatagaagtaaattgccttgctgagaaaacttttgcctgagtgctgttttcacttcgcagcaccaagcatttacttccaacatagccaaatggttttttggaatgatcaatcaacctgaatgatcttgaacttctttgagttccagtactctttcctggctttcccactgtgttcctggccctgtgttcatccaaagatagtaccttttcttgcccctgacatgagtgcctccctggtttggttgttcctctcctcttttctctctgcagaccctccctgagtggtttcatccactgtgatttcttctcatctgctgctgtgggctccctggtgttgtcttctaacacagcagtcaccccaaaaagaaataccactcacttcccaacatctcttccagttggttcacaggcaaggcacacccagcatgactaaaatctcctctcagttgcccaagccagacaatttagagtcactgagtcttttttctccttcatcctccatgtttgatctttttttttttttaaaaaaaaagcaaaacagctgactaaaagaaaaacttaagacaaaataaatttaacagaacaattactgaattgggcagccctcagaatcagaagagattcagagaattccaccctacaatgtggacattgagtatgtatggacagaaaagggctgaagaaagcagaaacaagaaagaacaaaaagcagatgggttgtttcaaagttactgtccctgtaaaggttaaagtggagggagcttccttatcatgtcagataaaactggcctgtgtgtggatttggctattctctgtcctgatttcttgaaagaccagataaaccacttagttttgacatggtcacctggaactttagtataagtgactccattttggtttggtctgttgggactgagtgcagaagctcagtctgaatcaatggcctcctataagtttaataaagctttattgagatataattcacataatatacaattcacataatatacattcattatacaatgaatgtataaatacatattcattgattttttttctactgtaatcagagactttggaaccatcaccacaatctaattttatagaacattttcattccccctgaaagtcagaatccattagcagtcactcccaatttcctctaccctggcttcctgtgcttggacagccactcatctactttgtcttcataggttttttgcctattctggacatttcatataaatggaatcatagaatgtctggcattttgtgactgccttctttcactgagcacaatgttttcaaggttcatccttgttatagcctgtatcagtattttatttcttttttattgccaaataatactctattatatggatacaccacattttgttatccattcatctgttgatgaacatttgagttgtttctactttttggccactcctattaattgatttctagtttaattccattgtggtatgaaaacagatattatataatttctattcttctaaatttgttgaggtgtgttttatggcccagaatatggtctatcttgaatgttccatgtcactttgaaaaagaacatgcaatctactcttcttggatcaatagtctgtaggtgccaattataccccattggttgatgtcgtgatgttgagttcaactatgtactgattttctgcttctttgaatctgtccctttctccctttctccctttctctccctttctgtctctctctttccttccttccttccttcttgctttctttcctttttctttccttcctttctccttccttccttctttctttctctttctttctttctttccttctctttctttctttctttccttctctttctctttcctttcctcttctcttctcttctcttttcttttctttctgatagggtctggctctgtcgcccaggctggagtgcagtggcacagtcttggcttgctacaacctctgcctcctgggttgaagcgattctcatgcctcagcctcctgattagttgggactgcacgcacccgccaccatgcccagctagttttttgtatttttagtagagacagactttcaccatgttggccagcctagtctcaaactcccgactctccagttatccatctgccttggcctcccaaagtgctgggattataggcgtgagccaccgcacccagcctcggatctgtccatctctaactgaaggctgttggtatttccaactatagtagtggattcattaatttttttcttgtagttctgtcagttttggcatgtattttgacactttgctgttaggcacatacacattaaggttatgtcttcctttagtattggcccctttattattaggtaatgactctttctctcttataactttccttgctcttaagtctgctctgtctgaaagtgatagagctactcctgctgtcttttgactagtgttatatggtgtatgtttttccatccctttgcttttaatctatatgtgtctgtatatttaaagtgggtttcttgtggctgggcgcggtggctcacgcctgtaatcctagcactttgggaagccaaggtgggcggatcatttgaggtcgggagttcaagaccagcctgaccaacatggagaaacttcgttcctactaaaaatacaaaaaattagctgggcatggtggcccatgcctgtaatcccagctactcaggaggctgaggcaggagaatcacttgaacccgggaggcggaggttgcagtgagccgagattgagccattgcactccagcctgggcaacaagagcaaaactccatctcaaaaaaaaaaaaaaaagtggatttcttgtagtcaggccttattttttaacccattctaacaatctctgtcttttgtgtatttagaacattgacatttaaggtgatttgatatcattggattaatatctgtcatatttgttactgttttctatttgttgcccgtgttctttgttccaattttttcttctacactttttctgccttttgtagttgtaattgagcatttcatatgattctatttcttctcctttcttagcatatcaattatacttctttttttacgcttttttactggctgccatagagtttgcagtatacatttacaatgaatccaagctcactttcagataacactatattgcttcatgtgtagtacaagtaatttataataacaaaataatcctaactcctccatcccatagcttatatcatcctgtcattcatttcatttacatataagcatatatatacatacatattcgaatatattattttgatcatactgttatctgttagatcaattaagaataacaaaaaagtttttatgctaccttcacttattcattctctgatgctctttttttatgtagattcaagtttctgtcctatctcattttccttctttctgaaacacttaacatttcttgtaaggcaggtctattggcaacaaactgcatccatttttgtatatctcagagtccttatttctcctgcacttttaaacaataatttctcagagtacaaaattataggttggtgtgtgcttttttctcttaacagtatatattttactccattcttctcacttgcagggcttctgagaagttagatgtcattcttatctttgttcctttgtaggtaaggtgtttctttcctctggcttttttcaagattttaaatttatttttgattttctgaagtttgaatgtgatatgcctagggtatagtttttctgggcatttatcctgcagggtgttctctgagcttcctggatctgtggtttggtgtctgacattaatttgggggaaattcttagtcattgcttcaaatgttgcttctgatttttctttccctcttctccttctagtatttttattatgcctatcttataccttttccagttttcccacagttcttggctattctgttttttggtggttttttttttttcagtcttttctctttgctttttagttttgaaagtttcagaacttccaatccctgagccttccgaaagcagtttaaggctgccttgaagactgagaaaggttctttcctcagccctgtcctgtctactaatgaacgcatcaaaggcactcttcgttctgttacagtgtttttaatctgtagcatttctgtttgattctttcttagaatttccatctccttacattatccatctgttcttgcatgctgtctactttttccatcaaagcccttagcatattaatcatttaaaaaaattcctggtctgataattccaacatgcctgccatattacgactgcaggttctcatacttgttcagtctcttcaaactattttttattttatttttttacttttggtgtgctttgtaattttttggtgaaaggtagacatgctgtcctgggtgaagggaactgcataaataggcctttagtaatgtggtgataaggtccgggggaggggaagcattccatagccctgtgactatgtctcagtctttaggtgagtttgtgcacctggactgtgaagtttaccaatgcttctcaattattttctctccgcttaagtaggacaggatggttgaagggggctggagttgggtatttcccttcctctagcttagttgggtgctgatagtaccccagctgattgggccctggtaaattagtttctcctgagggcaggccttgttaggaaggaacaggtgctctggtgtattttaaaatggctgcattcccctccccctgcctcaagcacgaggggatttttctctgatgctcactgtgaaaacctggtaaaactcctggaagtaaaactgaagacagtgggcaggcccccctatgattggatccctctggagtttttaactcttgagacctaccccacactgagtcttcagcaattccccaattgtagttcaggttttcctgccctggcactcatttccacagaggtctctgcttatggctttctgctctggtaagttgttattctcggtacctgcttgtctctctaattttgggggcagtggtttgccctgtgacctcacttctgtgacagagcggagaagaggtgttgatttttccgtgttttttgtttttttgttttgagccagtctcactctgtcgcccaggctggagtgcagtggtgtgatcttggctcactgcagcctccacctcccgggcccaagcgatcctcccacctcagcctctcgagtagctgagattacaggtgtgggccaccacgccaggctaatttttgtatttttagtagaaacggggttttgctgtgttggccagcctggtctcgaactcctggcgtcaactgatctgcccgccttggcctcccaaagtgttgggattacaggcatgagccaccatgcccagcccccagctaatttttctatttctagtagagatggggtttcaccatgttgtgcgagctggtctcgaattcctggcctcaagccatctgcccgccctggcctcgcaaagtgctgggattacaaggcgtgagccactgcgcccagtcttgttcagctttttacttgatgtggggtgtggcgtgtgtgtgtgtgtgtgtttagaggagtttcgctcttgttgccgtgtgtgtgtgtgtgtttagaggagtttcgctcttgttgcccaggctggagtgcaatggcgcaatctcggccaacggcaacctctctgtctcccgagttcaagcgattctcctgcctcagcctcccgagtagctgggattacaagcatgtgccaccacgcctggctaatttttttttgtatttttagtagagacagggtttctccatgtttgtcagactggtctcaaactcccgacctcaggtgatccgcccaccttggcctcccaaggtgttgagattacaggcgagagccaccgcacccagccttttacttgttaaaatggagtggcgacttccaagctcttcacgtgctgaactggaaactggaaatgctcccgacgccattttgaaatctcaggaacccactcccttccttcggtccctaccgctctaggccaggccctcatctccaggtgcctggatgattgcgaagtgcctcagtaatagcttccggtctcttcccccttcagcccatcttcaatagaagtgccacagtgatccctctaaattgtagttctgattgtgccactcctttgctcagcattttctaaatttattttactatggaacaatttacattttgaaacactagtggaagatcaaccgatcataaaatataacagactcttaggtggacagcaagatatggtctcacagatgaattaattgctgggagattattcacatttgtgtgtgaatgctttgtaacagaataaaacaaaattattttcagcttaagaacaaagtatgtaagtagatatctaacttcatttttattgtagatgaatataaaagccctcagtatttaaaattgagaacattatttttccagtcctttaaaaaaccgtatctagtcaatattaagaataatgtttccaagtcataccctcatatcaggtatggcatgacgtcttccataatttgtttcattacagtgtaatatgaaaatctttgcacacagatgtgttatagcaaaaggaagaacacaaacggttccttcgggaagattttgtgctctcttgaattcaactgtctcagaaatcattaatcctgtgacttgggcagcataccacctggttttttagaaatcacttggatattggctgggcacagtggctcatgcctgtaatcccagcactttgggaggctgaggtgggcggatcacaaggtcaggagtttgaaaccggcctggtcaatatggtgaaaccctgtctctactaaaaatacaaaaattagccgggcgtggtggcaggtgcctgtagtcacagctactcaggaagctgaggcaggagaatcacttgaacctgggaggcagaggttgcagtgagccgagattgcaccactgcattacagcctgggtgacagagagagactcggtctcaaaaaaaaaaaaaaaaaatcacttggatgttttccagttcttagcttgtggagttcatatgtgaatcgtaaactctttttgtttaaaacttcctttgttcatgatagattcaggtgggatgaatttttatagtataaatgttaaccataccatctacagaataaaatcacaaatatatgttgaaatcctgagacaagattccttctatagacagcatactgtggatagaaagtaaccatccatgcagtggctgctttgtcagagcaagaatacacctgtgttgtggctaacacgacagatacctgtgtattatgcagcccccaagctatttcctggcagtcttggcttgagaacacttcttgaaggtgatagcagataattatgagaatgactatccaaatgcttttaatgtttttcctacatgtatgttttttggaatgtatttggaagagaaaatagctccacagagcacattagggagatgctggccccgagttaaagactgatgtccttagcctggtgctcaggctccatggctgtctggttttggccctccctgagacctcatctcctgccacccgcttcctgtgccacacagtggcccttgctgatctcttgagtgcacctctggtgcctgaatagctgtttcctcccttatctgctaaacctagcagatttgctgggctctggactgaggtggagggagatatatgtgtggaggtgggagaggggtttctgtgcaggggttcaggggtgctgtttgaacataggatggcattgctatgttgctagtgagttttattttctcttctgtccctgtcctagacttccccttcacttcactcatccctgccgccgtaatgtttacctatcctgcgtcctcagagaagccttacctcctcctctgcacccctttgcctgtatttgttttccatctcagctttgcttctccacaactctgcctgtctccctcctggctgtccaggtcctcacccactgccctgggcccatccagcccttttggagaatcgggacccttttccaaagcacatgagaatggatctgatggcttttctgggtagccctctgcctgtgacccagccccagaacttagtcaaactcacatctcaggagggccaataggagaatgtatgttcaaagctccttaaaaactgtcagacactctaggaaataaggtagtgtcattaataaagcctgtcagcattcatcagcggcacttgcctcatccattccctggtgtaaatgtgacccaaaaagggaattcctagtcagaggactaggaggatttgtgacaagtatttcttctatcagatcactaatttatcaggtttgttaattgggcagtttgggggcaggaagaaaataactttaatagaatggggcagctgtgacctccttgaaggggctcagaccaggcaaggagacagacatctggctaaggtccagcagatgcagactcttcctagggtgcattgttgtaacaggatttctgtgtctccactaatgagcaatactgcctgtgtcatgcactcacttctttaggcttctatttctggactctctgctcttccattatttacctacttatttgctaagaccttctgccttgtttgctataactttataataatacatttcaatatctgagatggctaaaactcttcattgcttttcattttcagaatattttggctgtcctcacatagagttttccagtgaataaccctgtctagttctaaaaataataattttattatgttagatttatatattaatttagggataattgacagctttgtgttggctttcccatttaagaatatgtcttattaaagttttcttctgtgtgcctcagaagtttttgttcttactgtatttatttatttgggttttttaaaaaatgggtcttgctatgttgcccaggctggaatgcattagaaattcataggcccaattctagtatgtactagagcctggtctcaagccatactcctgcctcagcctcctgagtggctgggactataggggcacacaattgtacctggcttgcttttattttctaaacatagatcttgcatgcttcctaaatagagtccaagaaattgtatccttttggttgctactgtaaatgggatttttggcaatctattattatatattttttattttgagatggagtctcacctactgtgttgcccaggctgaagtgcggttgcataatctcggctccctgcaaccgccgcctccctggttcaagcgattctcctgcctcagcctcccaagtagctgggattacaggtgcccaccaccacacccagctaatttttacatttttagtagagatgtgttttgccatgttggccagggtggtctcaaactcctgacctcaagtgatccgcccaccttggcctcttaaagtgctgggattacaggcatgaaacaccttgcctggccagacaatctgttatattttctatctggttgtttgtgtatttaggaaggctactgattttattagtgattttatacctagccaccttactgaattttgattactcactttttcagttgattttcttgggtgttctctatgtgcaattctattatctgcaaataagaataacgttactgtgtggattttgtataaaagtagaactccaatatgcttgtaagttagattctttgcatgggagaatgtacaagaaaaaatttctgtccacatctcctttttccttcagttctctgttctgggttctgaggatttggccctgctggctggcgtagcctgttgaccacctagagtgtgggtcaggggccagatgagcccatgcttccagtcccttgtgatgggtgaccagtcaagggcctgtgtcttcagagcacaaatcagacttcacaagatgctatgacagtacatgaagggacagtgaagcgaggatgtattgggtccagtgatgggcacatgcattggctgggatgtgtgaaagtacagatgattcagaagttctagaaggaaagcagcagaagcccttctggtgagagggcagggccaggtggtcaggggacagcctgtaattcatgcaaagcactgggagctggtcctgttggggacagagccagggaagcctttgcagctgggcaggcagagtgtgacccatctggactagaggaagacctgtcggttggtgtagtagatggtgtttggaggggtttaagactcaagacagatacaaactaattagggtaccttacaagactttgtaatactgtaaaataatgtctgaagggtttgttttaattcaaatcaaatagaagtaggaaaaataagaattttgatgttttgtaggtttatgtcagaaaaagtgtggagctaaacattgcaagtgaagaattataagttaaaacatcatttctctctctcttgtttctttgcaaaagtagtcgtgctaattctttgcagaattatttcacatggagccagaaattgttcaaagcaggagtggcctctttgccgagtggttttcatattccaaacatacatatgttgcacagagtatctaattattcttgggaacaattactgtcaggttccagaatgtgttcaatgaacagcaattggtgtttattcagctctaaagagactatgcaaggaacggtaggttatattgtctgtctaaagaagcgttctgccatccggaaacatctgctttctatttaaagcactgaagaaggaatgggagtatatttgaaatttactctctgaacattgaacatcaaaggaaggagaataaatttggatatgaaggtaatttctgtcctctgatacactctcttcagcttttccctgctgggaaggaaacgcaggttggaaagttctgattctcttaaatctttctatttatattgatttgcacactggaggaaatgacttctatgtcctacttctagctcttttgctttctcaagtgaagcagaagactctttcaaagtcagggtctgcttttctgaattttgtggtgaggtctctgtttggattttgcccataaaggtgttaagatttgttgttcagtttgcctgaagtgatcctgtgacctttgattttctgtgtggtgagccctgcccactcacagccctgttgggaggattaaatgagaacatttatggtttgcttggtgtgtagtaagctttctgtgaaggacagtgtctcttctattgctacgtaataaactgtcacatacatagcatcttaaaccacattgctgtgtgtctggagtctggtatagcttagttgggccctttgcttcagggtctcttgcaaggctgtaatcaaggtgttgaccagggttggagtctcatctgaaggctcacatatggaaagatctgcttccaagctcatgtggttgttggctgaatttccattcctccaagggagttggactaagggcctcagttcctgtctgtcagttggctggagtctttcctcatttccttgtaaggtggatctccctaatatggcagcttgcttcatcaaaaccagtaaggtaatttattgagagagtctgataggagacagatgtcataatcctatgtgacttaattacacaaatgacatcccatcacctttgccatattctgttggttaaaagcaagtcacaggtctcacccacactcaagaggaggggattccataagggcatgaacactaggaggtgggggtcaccaggagtcacatccgaagctgcctactacagacagctattattataggaagagagaataacataatggctgagagggagggtttccatgtcacttagaaataatatcaaattgctgggtgcagtggctcaagcctgtaatcccaacactttgggaggccgaggcatgtggatcatgaggtcaggagttcaagaccagcctggccaagatggtgaaaccccgtctctactaaaaatacaaaaattagctgggcgtggtggcaggcgcctgtaatcccagctacttgggaggctgaggcagagaattgcttaaacccaggaggtggaggttgcagtgagccaagatcatgccactacactccagcttgggcgacagagtgagacttcatctaaaaaaaaaaaaaaaaaaaagaaatgacatcaaatttcagacctgtcatatactgcatgacccaagtcaggttacctggcctctctgagttcctgtttccccacctgttcagccccttccctgtaggattgttgcagtttcaaagtggagagcgagcctagcagaatggtaagtactcagtaaaggtcagctacgagcttttcttctccttgcctttcttttttgcctttttttgaaatatcattagactttttggattgtagaagaatagcatggaactccccagtgcccccagacttggttattcatgtgaaatcccagagcggcgggtagtttcctgccagactggccgtgcaatcctcccctgtttgcccaggggctcgaggatgaggaatgcaggtctttggcctctggagggccatagcttcctgccatggtgactacctcagaatggagctgccaggaggccctgcagtacccctcccaggtctctgtgcctcccctcacactggagcagccacttgccctgcagagggcctgaccatgttgaccaagagtgtggccaggtgagccattgtgttcttccaacatcgttgcatttctacttgggggtcccgagggcagctcaccatgacttcagtccatccacagagctgagcaggcagatttggagatggaacccttcttgtctactcactttgacacctggatcatgccgagcagacagccggctgctttgcctgtgcctggtcaggaagctctgccatcttctcggctccctgtgccttcccctccatctctccactttgctttcctcacttcctccctcctgtaggcctcagggacagagagtgcttgcggaaggctactgctgggccaccacaggccgcactcatctccaccctccttcctgaccagaacagctctgcctccccttgccccttgcccccatcctttgcatccagagaccctgttcttggtccccctgttgccccacctccagccccctctacagctgtgggagaactttctggagtctccctgtgtcattcagtcaccagtgttgttctggagtagagatgctggctctaggggccacttctttttttcttttttagatcatctgattatatctaatgtgaatgtctccccagcttccttgaaagtaaaaatcacctggagttcttaaaaatggagccccttgggcccttccttggagagccaggttcaaggggggctaggatggggcctgggaacatgtatttttagtaagtgtaccagctaattcctgtcatggagatttagggaacacccgtctaagcatgcccaaaccgagacccaatccctcttttctgatgtagggaataggagggaagatctgaaagtctgggtcccttcccagaaaggccttctctaacccgtgggcccccagcccagcccatttagtgctctgacaatgaggcataatttgattcttcaacaaatgttctgtagttgctgccctttaaattgctccttcctttcacgtatgtaggagaatactgtgtgtggaagtgttttcctttatggtgttgtacttagatgattagcaaaatatggtgctgggctgagagtggcacagctgggtgatccagactgcagactggattatatcacatggatggggtatgagggcttgcactgatatgcacacactccctgtcgtctggcctctcttgacagcagatgcgggaaattacagtgagaatcttccttttgtttctaacagctgtcacccagctgctggaagggtgttggtttagcatcgagtgtgtgggtgaacttggtctctgtttgagggaataaaaatgccctagtaatccacagccccagaggcacttgtcctgctccaggggacctagaagggaagtttcagggagcaaggaatgctgctagcctctgttctggaatgctggcctctgtaaacagctgcattgaagcagcattaatagcatgcctgaggagaaacaggcataaagaagattgctgcatttcttcaaaaccacggttgatggttgatgctgctggtgttactcagtagcccttatatgaggctcaaatggcaaattggttttctaggaaaagtttctcaagagcattcttaaaattttaataatgagtattctacattcaggatggattcaaagactgcttcgcctaaaatcattccatctagagactggaacacttcaaattcttttctctttgatttttttttttttgtatcttgtctatgtctcttttattttatctcttttgacattgtaaagatttaaaaaattgtctaagttaccttttaattttgtgtctctaataagtacttattaaatctgtagcattttataaacaatgggactattttttttttttttttttgagatggagtcttgctctgtcgcccaggctggagtgcagtggtgtgatctcagctcactgcaagctctgcctcccgggttcacgccattcttctgcctcagcctcccgagtagctgggactacaggcacccgccaccatgcccagctaattttttgtatttttagtagagacggggcttcaccgtgttagccaggatggtctcgatctcctgacctcgtgatccgcaacaatgggactatttttacacgttgatggctttttttctatttgtatcttattttgaacacttaaaggatttttgagccagtctgtgtaaagatgctttcttcaaaaataaatgtattttgtgataagtctgtgccattttgcattactttgggaagtagatagcttagaatacaaaatgcagtgaaatccattacaatttttattcatctgccttgtttctaaatgcgtattgtcaaaatctaattccccactcaacagaaagaaacataggtaatatgcaaatttggtgaatcgcataaaatgctttaggcatgtggagtgaaaaagcaacaatatagaggcaagaatagcagaagggatggatttgatgaatttacataaaactcaaaaggtttataagttggaaacatcaaatttgaaggtttggtcaggttgttgaatggttccagaagtagactgaagagatacagagataaaaaataattctatcatattaccaggtgcagtggttcatgccctataatggctcatgctgggattatatcccagcactttgagaggctaatgtgggaggatcacttgagatcaggagtttaagactagcctgggcaacacagagagaccctgtctctacccaccacctcccggcaacattagccaagtgtggtgtcacgtgcctgtagtcctagctacttgggaggctgaggcagaattgcttgagcctcagagatccaggctgcagtgagctatgattgcatcactacgctccagcctgggcagcagtgagacactgtctcttaaaaaaaaaaaaaaaaaggcgcagtggcttacgcctataatcctagcactttgggagcccgaggcaggcggatcacaaggtcaggagttcgagaccagcccggccaacatagtgaaaccccgtctctactataaatacaaaaattagctgagcgcagtggcacacgcctgtaatcccagctactcaggaggctgaggcaggagaatcgcttgaacccgggaggcggagattgcagtgagccgagatcatgccactgcactccagcctgggcaacagagcgagactctatatccaaaaaaaaaaaaaaaaaaaagataaaattatgtcattcataaattactgcaaatttgagaagtacttaatagaaatataacattaagctgcaaatagattggaaaatcctaaaattgttgcagaatcccccaaaatttgtcacaaaaattctaaaaagtgaattggttccaaaatcctaaaaatgacaacaggatgtcagaaaaagtataggacacttgacggggattcgaaaacactgaacaaggagttgccttttaagcaaattgttcattacaccaattgccctgcagtctcgggataacagctaagtggaatgtggtttgcaaaaactactcactggtgtctctttttttcttctctctttgcttttattttaattgtcttcatgcatatgtatgtttccctataagctatttaaaatcttttggggcagtaggtggcctagaaatcataaattatacattaagtcatgttctctcaactcacacgcccactctcttattgcagagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtaccaccccctcagctgattttaatactcccagttgcttatctttcatccaagatgcacccaaaatcctgccgtcttaacacataagttattgttataatgtctgtataacatattctgttctttttgcatttaaacttacggtaaatggggaagaaaaatatttctctgttaccactgtcttcataactaacattttaatgcctgtataataattctgccgacggcctataatgctcttaatttccccccgtggttggatatttaagtggcttccaatgttttgctattataaataatgagcatcttcatgtaccaaatatcctcaattgttcacataccattgctttcttttgaatagtccttaggatagattcctagaatattatggggcaagatattaacactttatggctcttgatgcatattgccagattgttttccagaagggttcgttcttccagcctgtatgagagtgtctgttgttgcacccttgccagcattgggtattgtatctagtcgggttttggtgttattaggcataggagttgaattttattaagtggttttggagtatttcttgaaatacatatatatttttgttattctgtctcccatgatatttttgccacattatcatgggaacagaattaagaagggataccagcagaagtatcaccaagtctttaaaaaaaaaaaaaatagacctgctggttttctgtcttcatcctgctgtacattttttacatggattatctgctgccacctggaattcagtgtatctaaagctgaattcccctttttgttctctaaaccacctctccatttttattccccaatcatttgggctaataaagcgaaccatagagtccttctttaagtttgtcaagtgaatctgcctttgaagtgtcacccactcgtgcctgctcttttaagaccataactcttgtcctatcacagtcttgcctggactcctgcagtagctgcctcatctcctacctgcagtctagtctgacttttgcctctagatcagccttcctatgcaacaggaagcaggggagtggggagtcaggggctgggcaatagaatgggccctgggtaaaggcttctccccacactccacaaacagaaggtgtggggaagcctccagggaagctctcccagggaaggcacgagagcctgctggtgcctcccgatctcttcaggagatcagggcacttcagcccatgttctctaagtgactgctttttaccctttctctgcactttggcaactgcagataaaggtggcttgaccctgggatcctcttgttctcccttccagttgccacagcccttcttcctcaggaagggaccccagaagtcctcattttacagctgaggtctaaggagaggcaatgacctggcccaggttcacgcctctggggaggctttgtaggccggggcgggtgcccagttatttgcacaccagttcctggtttgtcgggttggagcaggcttctcctggctggtagaggagagtttcctgacacctatcaggcgggtagtgtgttatctccctccgcttcagagatgaaggaactggtctttctgcctaagcaagcaggatgatagtaggatgatagcgcatccccaggatctggtgatctgatgagcagtaaggaagtgtgctagtgcctggcacatagtaggtaggcacctcgtgtttgatgggggaacatctgaaaggtgcctttatttttttccttctgagagacatagtgatgccacagttgtaattaccgtttctctcctctgtgcttctgcgctggaattgcctggactctttccaggatgttctgacagcagtggtgaatcaagctgacctgctttcttttatctatagattctgccagttcatctgccatccttcgatgggtttgtacttttgtcagttgagttatccaaggatatatcgggcttaaatatagataaaacgactttcttagagcaagtgctttagtcctattagctgagcttttagtaattcgtcaaagtgtcagccactgtgtcgttatggctctgcagttcctgaaggctgtgacaatgtggtggggttcaagccaaatatgacagttatgagaaatcagatgggtgtgggagggtaggctaagcccctggctgtggcacagcgctagtccaggctcagtgtgggagagtcatcaagctatagactcacttacaggctgggaatccaaaacctaggccatggggtgctgctggaactcaaagccagccagaggatcttggactaccctttctatggtgcccagccacctggtttttgttgttgttgttgttttttgagacagggtctcactttgtcgcctaggctggagtgcagtggcacgatctcagctcactgcagcctccacctcccaggatcaagcgattctcccacctcagccacccaagtaggtgggattataggtacccaccactatgcctggataatttatatatttttgatagagacaggttttgccatgttgggcaggctggtctcaaactcctggcctgaagtgatctgcccctcggcctcccaaagtgctaggattacaggtgtgagccaacgcgccctgccgccacctcgtgttcctcccttagtgctgtggcaccagagatccatgacagagcctccttctgcaaaaggaagcatcccatgagggaacagaaggccccaggaagtggggagtagggtggacctcagttgtttaattactacagttggcattcagggattggggatgggagcacgtatcctgtctggagaacctgaccacactgcactggaaagtggtcccaatgcacattcagccctgctgggccctctctcgacctggcaggcagcaacctgtaaacccagcagcctaggtctagatcatatcctgtgccttcagctgttccacaagtcgggtgggcatggagagagaaccctagggtgatagcaactgttgctgctgcctggtcccccgcggcttgccccttccccacccattactaaggtcctcatctccctgagcccaatctcgatcctgcctgaatactccagatggatcgcctgctgtctgcagactggaatcaggtgcagtgtgttgagcggactgctgggcatctgtgctgatgccagtgccttctccttatgggctcttgtctgttgcccttgcccaccctcacccccatctctgttcagtcggcttggttccacttctgttcttattcctgagcatctattctggttccatgttcactggctacccaagcctggagctctgctccctgcccagctgcacgtcccaggcctcatgcatgccgtggagcctcaggcagaccacttaggaatggatgcacctgggctgggggagtatgaacacttcctgatgtcctcattgtgttctaccacactgggtcagccccactttgttttaggcctttgatcccaaatgttgatctgaaccatgatgacaggtggtcagatgcgtttagcttttggggctgtgtcttagctcatgggctgcacctctgtgactttgggcaggtctagtgcctgagtcctgcctctctctgttggctgggccacatcaagtatattactttgagcttctgagtggtacttctgggccattcgttcctctcaaagcaggaggctgttgtgggctggaaggggaagccgcctccactcctccccagggaaggagtggatgtgtttcagtaagcagtggctggtgtagaatggactcagctcattttgagcaaacgccacatcagattcagcttctgtgtaaactgtgggcagccaaagagcacaggctctttgagaaggaaagctgtggccaacagcttcagcagctgtcattccatgccaggcacagccagctcctctgccctgtccaagcatgtgtcacgctctacctggggagggatgcatggacagcctctcctccttctggaagcagttggtgctactcatctcaggaagatctgtactcagacctgttctttattcttaaaacacgaagacatttccttcttccccgggacaatgtttcatgtgtcagttccagctgttgtctaaagacatgagtgggtgggaaaacttcagtgtgttgcctcagcattgcccaagctctaggggattatgtggatccatgtcagtgttggggctgccaggagactgtgagctctttgaggatggcagccatgcctggctcatctttggagtcctagcaccaagccagggtgggcaacgccatagaagggggtgggggaatgagtggatgatgaggtcaggcctggccaccttctctccaggcctgtggcaggtgtactgtgtccacagaaggacagcagggtcactgccaaggggggacccaaggacccaaaccttgggttgtccctgtttatagacactggacagatgggagccacatgagggcatctccccactcccagcttctcagagcactgctataaaccatgtggcacatgccaataggcatgtgatttatggtgagtttttaggcagaacggccaactccattataaagaaactccattttcagagcattggttaattgagccatcacagcacttgatttcattgtgctgttggcactctttccagactgagttaatcactgccatccttatgagaaactgcctgcctgtggacaagacttgcctgaagcaggtgcttctcctgggagctctggatgactctgctgcccttggttctcagttattttataggatcacagaaacctgtattggaagagaccttagaggtcatccattctacaaatatttagccacacctgttgtgttgcgagtgctgcctgattgtgatggttcagaggatatcagtatccaaaactctgacttatttggtattttcttttggaaatgtaaaattactttcaggaacacattcaggctctgctcgtccactcctcattagaattcactcctttgaataaatacagagcaccttctgttaagggagcaagcataaggaaggttccgagcacacagtaggttttcagtgaatatttcttttcttcgctgtctgtgatttgttgttgttgttttaaatttttaaaaagcacctgttaataactactcttggagcaggcaacatgtctttttattgctgtaactcagtcacagcctcttatggaaaactcccaggttcatccaacttcatctccctggatttgggaaagacttctcatgaaaggaatccgatgggcctgtctccccctgcctgtttcatgagcagcttcctctgaaatccagagcaggtgagactggagacaggagaaacttagcattttgctgcttccaagcagctcttgattacctgtgttttgtgcattttgtgacaacttggtcccactgatctgcaggactgggtcttttactagggtggcttctttctctgtgaaagttttagagatgactcacgcaagaagaaggtgtacacagagatgggagcctgtatgaagcttatgcctggggtgctttagcacagccccttctcccttctgggctttggttccttcccccaggtccgttctcccctctctccaggggtaaacagttctcattctgctaagtcattctgccgcattgagggcactcagctgtgccctcatccttcacacactcacccttggctcccagggctgaattcttccttggttgctggccacctgtggcacgtgtactgccaactccttcacctgctcttccttggttgcttccttaagtcagccttctgccctgggcctctcttcttttcttccaccagatgacactctccacccggtgacccctttacttctcatcccccagtttactcaagtctcgtatctcctctgacgccagaacccacaggtccagccacctcctcggtccctaacacaatcttccagtgtctccatgggcgggaaggatactacctgctgttttcataagcctctgcccactctgaagattagcctccctaacaactttgttatgggtttgtagactttatttttaaccatttgtattaataggtaccattcaatgtctaataataaagcaaacccatatgtacccaccacccagtggaagtacgtctttcattaatacctcagaagtccttcaatgggcctttccctaattagatgctctcccatccactcctcaagagatcaccactctattaagagtgtattaagcattcccttgcttttctgcatagttttgccacatgtgtatatatcgctaaaccagaagttggcaaactttttctctaagggtcagagagtaatttttaaaaaagttttttattcaggttgtacagtctctgctgcagatatttgactcttttgtagccagaaagcagccatagaccaatatgtaaatgaatgggcatggctgtcttccaataaaactttaattacaaaaacaggccataggctagatttggcctgagggttatagtttgctgacccctgccctaaataatctgttattcagttttacctgtttttgacctttatatgaatagaatcatactagagactcataatgtatgtgttcttttgtaacttccttctttttttttaatgttaaatttttgtgattcatccatgctgatcaatttggttagccttggttaattttcctgctggattagtatttcattgtatggaaatactgcagtgtatttatccattctgttggtagtggacattgtttttgcaagttctactgtaggtaaaatgctgtcaagtagcattgcatgctacagagaaatcttttgtgaaaggaaaaatcaaccaatgcagcaaatattgttgtcttattttaagaaattgacacaatgactccacccttcagcaaccaccaccctgatcagtcagcaaccatcaggatcgacacaagtccctccatcagcaaaaagattacaatttgctgaaggttcagatggtccttagcattttttagcaataaaatattttaaaattaaggtatgcagattgtttttattttttaagacaatgctattgcaaactatgatttctttattttctttctttcttttttcttagaggtagggtctcacttttgtcacccaggctagagtacagtggcacgatcacggctcactgcagccttgacctccggagccccaggtaatcctcctgcctcagccccctgagtagctgggactataggtgcacagcaccatgccctgctaatttttgtatttttagtcgagatggggttttgccatgttgtccaggctggtctcgaactcttgggctcgagcaatccatctgcctttgcctcccaaagtgctgggattacaggcatgagcctgcaaactacgattaatatattcaaggaaacagagggaaaatggacaaaatagatgaaaggaaggagaatactcccagagtcttagaattttttttgaaagagccaaatggacattctagaactaaaaaataacaatgtctgaaattaagataacaatggatagatttaacagcagattggagacatcagtggccaggattagtgacctggaaagcagattaatagaaaatacccaaatagaatcagagagtaccaagaatcagggaaaaataattgatgagtgtaaaaaatattgtgcatggccagcatggtggctcctgtctataatcccagcattcggaaggctgaggcagatggattggttgagcccaggagtttgagatcagccagggcaacatggcgaaaccccatctgtacaagaaatacaaaaattagctgggcatggtggtgcacacctgtaatcccagctacttgggaggctgagacgggaggatcactttagcccaggaggtcgaggctgcagtgagccatgtttgtgccacttcactctagcctgggcaacagagcaagaccctatctcaaagaaaaatgaaagacctagcatgtctgtaattggagtcccagaagtagaagcaaggagagagaatagagcggaagcaatattcatggagagaatgagaattttctaaaaactgatgagtctacagatttaagaagctgaatgaacctccagccatcgtaaatagacttagctctagaaatcagtccgttgttgctttgtaagtaagacatacattatattctttttagccacttattagttttatgaccttgaacaggtcccttgaccttgttaagcctcagtttcgccatctgaaaaaaatgggggttaaagactgtgaaaaagtgccctagaaactaagttttaaggaaatagcagggggtatcaccattgttattctagcttgactgcctctgggatagcctgtatggggtgagcttaagagccatatcctatactctggccagcctctttccactgcctttcaaggagacttggggtgtggtgactgacctaggggcataggcctgcagtgaagtagcagcaagatttaaagtgaatccagtttctgaatggatgtagtcattgctttgtcctcccaggattctggtaattgagagatgaccagggttggctttctggggtcacgtgatccatcctgatccagctcccagccacacaccttccttaggtctgtcttggttccaccatatccaccctgcttggggctgagccagaatccccccaccctccaaggtcccatagctttcccctacacttgccagtagtttagatctccattttccacgccctgcttccctgcccccatctcttgatagtgtccagtgacagtagacagatctcttgacttctcatgttgcattcagttttccagatggaaaacatttggtaaaatgtcctgactcagatggacattggcattatggaagggttattataaagaaaggaaaagtcagctggaccgtagcacatgaacatcagtacttcatagatggggaaaagaagaggggcagtaatgtttccttcatcgtgtataaaatgagaagcaacatgatatggaagtttataggacaagtcttggagtcagacaactgggtttttatctctagagtctcctactggccagctttaatgtgttaccttaagcaagttagtttaacctttcccaaatctcagccaggtgcggtggttcacgactgtaatcccacactttgggaggccaaggcgggcggatcacctgaggtcaggagtttgagaccagcctggccaacatgatgaagccccttctctactaaaaatacaaaaatttgtcgggtgtggtggcggtcacctgtaattccagctactcaggagactgaggcaggagaatcgcttgaacctaggaggtggaggttgcagtgagccttgatcatgccattgtactccagcctgggtgacagagcaagactctgtctcaaaaaaatcaaacaaacaaacaaaaaaactttcccaaatctcagttacttctgtgaaatgaaggaatagtcgtatgcataggctcgttgtaaggtttaagtgaactaatataaatgaggcactcaataagtgttcaacaaatagtaattgctgttgttagtattctaaaaattattttaccagctaagctaaggttttctcttgagccagtggcttatcagcaaactcaatagtctgatagatagataaatgtagatctagcaagagcaatgatacttctgttactactgacagctgtcacttactgtctagatccctttagttaaggcaacggtttgtatctggaaggtctgtcctttagcaaaagagtagactcaggttcctaccacagaaagcaagccctatgccattcaaactttttttgtcttctctgttttatcagttacaaggaaagtgttctgagttgaccattgagaataaacaaccttagtaagtaaaattgctggtaggttcactctttagaatacttacttagattgctcttattccctgttcagatcatctgatggggaagcagccagtggttattgctaccctgcccttacatagacacccagtaatcctttatttccaagagtatttttcctgagtgtttcttagagtcctagggcttgcaatgatttctactgaataagccattgttgatattttataacccttatcaattgtttgatgtctttgccctcttcctgactacttgccattgaaagaccaggaaccttgactcattcatctttgtatctttgattagcagaatgtctggtgtatagtaaatgttcaataaatgtttgaatgaataaaagtaccatgtgctagatattatcttcttacccttccacctcagattcatcctctacccttcttgacactgctctggtccctgaggggctaacttgcagacatcagtgggctcccaagccctctggcttctagctgggtttatccaatggcaagtggaaatcaaagggagagaggcgagggtgtttgctcccccagttccccactcctgtgaggttgccatgtgctgactgtgtcccccaacaggtagcttgctctacgtgacccctccccctcccagggtctgtagcctctccatcccctcattcttttaggccaaggagtggtgacagctagcaccaggctgctgcaccatccttacagattccctgtaccccactcacacccgtataattagtttctttgtcaattaaccctccacaaattatcctaattggactgtacctgctccttcctgttgggaagcagcaggcctcaattgcttatagagattttcaattgtttgagttggacactggggctccaggtgactcataaagcgacatagtgcagttcttccaagaatgtgggacatggctagccattaagggcactctgatgcgtggcagctttggggaaataaatagcagtttgggaaactattctttgtttaggagagactttctcccacggataacgtgtaggatcttattttagactgactgttaagtctctgaagttgccccttttcatggttgtgtatctgactcagcatgggttgttcatctgactcagcatgggttgttccaggagaacgcgggaccaaatttaacagggcagaggatacaggcttgaagcactggctttgccaatagaagactttctaaggaatgactttgtctcattcaacatttaaattttcactctttgggctgtttttctgcaggtgatcataaacagcacaatcacaccgaatatgaccttcaccaaaacgtcacagaagtttgggcagtgggccgacagcagagccaacacagtgtttggtttggggttttcctctgagcagcagctgacaaaggtaacttggtcctatccacagtgcagtaaatcccgcatcagatgccattctcatcagtgattgcccgccgagggatgtgcccttggtgagcaggattcctttctggtctttggtttcactcctcctggcatcacggggctgccaaagcagaggcccttttgaaataccaggttcacggaagtcatctggggaagggaaattcgtatctaacaaatgctgctttggggcctgaagttgcagtgtggccagtccatcctcccctccaggtgtcagccactgctccctgtgcccggtggtatcagcgcacagactgagcgctggcttgtgtgccaaaaccagatccattgggttttcaggactctgaggattaggtgaccttcctgtgtgagggcacagttatcggagggttgttactatagaacttccaaggaagagactgtgttcctgctgccaagaatgcatcttgatgaaataagcatgttaccccttttgaagtaaggcacactttgtctctgacagccatcaacgtcagtgactctgtttttggagctcttggggagtaaggtgatgcataatggaagcgcttagcttggactccccacgtgccttaaaatgccacacagtggtgtgtgtatgttactttttttctagggagaggattcatagctccaagtcacttctccaagggccctgggacaaactccttggatggttagaaaggtgttgaggagcaaatcatggctgaccacagacttggagaacctcaagaactgagggaataaactgatcgcctctgagaggccttactcagcagtttaaaggggctgagagcctgttttagagactacatttccttttagggtggtagaagagccctttgtaagtatttagaatattttggtttaaggtaagactgactagtttacaagtcaaagaaatttattggaagaatgttggagtctctcaaggagtgcaggagagagctgcaaacccagggaagggccagagccagacttgcttctggcagcttggctctaagaattgtttttctctagacccttgctgtgaacatctgactgactggctggacaagtgctgacccagcctctgctctgctgacaccatcctcagcactgaggatgcagagatgtggcccttgttccagggcttcacaaatttccagattcttggggaattgacagagttgcctagaacagacttgactgcttgggttacttgtgtgtattgaagacagttttcaaagagggggaaattagggtgagtcaggaagcctcccacagcagaggcctgctaactggtccccttcctttgtccagtgtgtgtgcatgtgtgtgtatactcacatatatgtgtgcacgcacacacacttctaaggaggtccccagcgcacagatccggccatcccatacccagtcacaaatgagcaccccagtggggataccccacagactgtcctctgcatcccaaggaacttccacgaagactctgtttccttagaagcctgagaagtccaaaatggcctgatggcactctgagcatccacccttgtgccgccctcttacagaagcattctttcctgggtgctaaaacctccagatcaccagggcctggaaacatggacaaaaagcaaaaatctcgagggcaggtcattggacatagttatgggagacgtcctctctgtccacaatccctcacttcctgggcttgtgtgctgtgatcctggatgttcagcaggcacgagtgcagcacagttctgcaaggcctgccacttctggctgatacggtacctgggaggagctgagaatcctatggcaatcactgttgcttcacttcatatgcagagaagtgagttctctgcagcctcacttggtttgaagcagtgtcatgtgggacagaaagtattgggtaaatctttggctgatagggctggcagaggcatggcggtccacagtatctattctggtgatgataaatcactcttcccctggaataaggggcccagtggaatcagccttcaccagggagctggctggtgcctagaggtgtgatgcttggcgtgggtcactgtgttgacagtaggatgctcagcagggccgggagtcagggtggctgtggagagcaggagtatgtgttttcaaggccatttggtgcctttttccctggcaccatggccagtgtgtccttaagtcttttgagcaagtaccaggctgcctggagaaagtgaatgactgggtatccatagaacagcccctcctgccacctagtttgaaatattctgttttgctgtaaaggcctctgaagagcatgcatatggaacatgagtattttcaggctctggttccatttggacccattgatgttgctgttgctcaaacctctttgtcaccttgtttcttcccggttcctcctcatgcagctaggcccttaaccattcccactgagatgtcaaatccaggccacctctgctgtgcatgtggcaccatgagatgttcggggtttgtccacagggaagatttcccttttccgtcgtctgcccgacaacaggatagctggagggaagtcgtggcactgtgaggtgtgtgagggaagctgtggagagttcactgttgatggagtgtccaggattttcgggtgggtaaggctgctaaggtccagtcgtggaaggctttattggtcatgccagagcttctggactttgtcctatggcctgagaaggattttaagaccagaaggaaaatgctcagatgcattttaggtagaattttttctggcagcaagtcagattagattgttttagtccagggtagaactgatgaagggttaagagttggagaaattttaaaaataccgaggcacaaatattggcaaaactggggtgaatagaagaggaagaagagattctggggtgatgagggatggagggtggtgaggccgttttctgaaatggggaagaggaacaggaacaggtgctgtgaggagcagagagaatttgtttaaagcagaagcaaatgagatggtgacttgttgaaagaataattagctggaacctctgtctgagggggtaatgggggtgtatgtctttccctcctgaagtggtccttggtgaggaagggtgtgttgggaactcccttcccctcagccgagtggccccttcccacacctgcctcatatcctggcaaataggcttgggagcttctgtccaagacgtgatccctggcaggcccgtcctggtcatgtgctcctgttccctcccagggctggaagttcttccctgaagccaaggatggtttgagagaatcactcacagctgcctggaacaatttcttcaatctttaaaggaacccaagcagctaggtagaaaggggggaaggtttctatgaaaagaatcgacagcaagaactccccacgaaaaccagaacacattgtccaagttaaatgctctgtgcctctctgagaactgaagagaccttgagctgtgctggcttccagggatggccacatctaatttttcccagacagaagaaaatgtcctatcattaaggaggagtgcaccgtcctgccaagccactcagcctctggtgcagtgctggagttctgctcggtgcccacaacctccatcgtcacaaagacttgtcagagaagccctcagataacccctttgtccaaatgtttcaaatcaacttcttcccctgctctctgaaggaaatgattaaccacacgctgataaattatcatgaagtgagtctggccatctcaacaagtgacagttagctagcacagaggaacttggcctccagggctcccaaggcgtgtgctgaggggacagccaggctgagtattcctgacttcccagagcaaccacccacagccctgtagggaaatggtaatcaagcactataactaggctagagaaaggaacaccagtgtggacattttcatctaagaacactttatacatacttccctctctaccccccagaaagaaaatagatgccttggtcttaactgctccattataaggactatttcccaaccacagtccaaaaagtattattacagggcaatttcctgctctttagataggctgtccaaaaatagtagaagctgtgttttctcagaagtaaactgggactcgtctgtccacccactggagaggacataaaaccccagcctactgaaggaaattgaaaaggcacttgcatgtgctgataaaaggaagagcttatgaaaggagacagaaggaggaacaaatataagaatgagccagtggttaaagtttagtttctttctggcatttgacctcgagttgtcactgttctaagtttggttccatcttattcattacaggcagaaggaaacatattctgcccttaatggggagcgacccaggatggcgttgccagtgcaccatggttgatctggccaaaccccgatacgtgcatggcatttgcttttgacccacttcagtgatttcatctgtaattcaaatttgtccccatgtagtcactttattcactcagtatcgtaagaacattgttttatctcctccctttctgggtcctgatttaacagctaatgtttaaaatggaggatattaataattattttgacatgttttaggtagaaagcttttggctgcaagtaacaggtaacctaatcaccgtgcttaaatacatgggataatttcctctcatgtgaagaagtcctgaggcaggtggttgctagtacagtggctccatgatgttgggtctgacaatctgcatggatttcatttgtttcttttttcttttatcggcctttcctttgtggtgataagatggcttctaaagctctacccatcacacctgcattcttggcgagagggaggaggaagaggctggtaccacagcaacccccctggcagacttctggggccccattatcaatgctgggtccctagcccattcccctaccccaccaaaaaccagggaaacggatttccatgattggcttagactagctttcattctctagcacctaggaaatttcctgctccagaaaaacttgagactctgttaagctacgggaaaagaaacagattttgaataaacaaacagtagtgtttgcttcaggtcttcaatggctaaggccaaaagaagccacaaatgaaatcaaacagtaatggtttcattttctatcatgataatgattttgtttaaaattattaccacaattttaataagtaccaaaaaatgaccttaatgaagatgtgagaattttgcaatacatttcggaaacctttgcaatttgaatatcctttgatccatggatttcattgacaagaatctattctaaggaaacaattgtaactgagtataaggatatcagtacaaagattgcagcatcatttataacataaaaaaaatttaaaagccctaacatccagtactaggaaattggttaaactgcagtgtatccttcagggtaatatgtagcgatcaagatgtgtaatagaggctgggcgtgatggctcatgcctgtaatcggagcattttgggagacccaggcgggtggatcacctgaggtcaagagttcgagaccagcctggccaacattgtgaaaccctgtctcctctaaaaatacaaaaattagctaggtgtggtggcaggcgtctgtaatcccagctacttgggaggctgcaacaggataatcacttgaacgcgggaggcagaggttgcagtgagcaagatcacgccactgcactccagcctgggtaacagagtgagactctgtctcaaaaaaaaaaaaaaaaaaaaaaaaaagatgtttagtagaaaatcatataattgcatggaagtattaatatcatattgtttatttcaaaagaggccataaaatgagatatataatctattttaaaagaaatgtaggtaatgaatgcaaatatacagacagaaaaatatcaaaagattatgtggtttgttcttatcttggatgatggtgttgcagggcaggggagctcataaattggggctccacctgggaaggttcttggctttgcctgggagggaattatggggtgagttggtggtagaagaaaacagctttattgaggtggcagtgttacagccctgtggctgctcctgcaaagcagggataccctgtaggcagtgtgtcgagaggagcagctatgcggcagttctgtggtcgcatttatacctacttttaattacatgcaaattaaggggcaggttattcaaacatttccaaaaaaagtgtggtaacttctaggtcattgccagggaatgagtaaactgtcatggctctggtgagcccattaaccagtcttccgtctagtccagagttgagtcctgcctcctacctcaatgggactgtaggtctaaatatatatatatatatatagctgagcgcagtggctcatgcctctaatcctagcactttgggaggccaagacaggcgaatcacctgaggtcaggagtttgagactagcctggccaacatggtgaagccccgtctctactaaaaatacaaaattagccgggcgtggtggcgcatgcctgtaatcccagctactcagtaggaggctgaggcaggagaatcacctgagcctgggaggtggacgttgcagtgagccaagatcgtaccactgcactccagcctgggagatacagtaagattcagtctcaaaaggggaaaaaaaaaaaaaaaaatatatatatatatatataaaataaataagtgatatatataacttatgtaacttaaaagttaaaaaatatatatttttccagatcatctccctcctcctaccctccaccctccaccctccagtaggcttctgtgtgtgttgttcttctctatatgtccatgtgttctcatcatttagctcctacttataagtgacaaatgggatctaattaacctaaagagcttctgtacagcaaaagagactatcaaaagagtaaacagacaacctacagaatgggagaacatttttgcaaactgtgcatctggcaaaggtctaatatccagcatctataaggaacttaaatttacaacaacaacaataaaaaaaccattaaaaagtgggcaaaggacatgaacagacacttttcaaaagaagacatacatgcagccaacaatcatatgaaaaaaatatttttttctaaattgtattttccaaatttacaagcatatatatatatttttttaagaataagggggaaatattagaaaatgcaagacttggagggaggcgatttttcaccaaaggacaattactaggcggctctcatgactggcagttttcttctgctagttggaggctttgagaggaagtttctctctatcattctcctagggcccactgggttgtttccagtgttccatatttgtagacaatgctggaattaacatcttggtattgagggccttttttccccccatattctcaattattttggcagaatggtttcccagaagcagtatcactgggtcagtaggtatgaatgtttttttcactaacaagacatatttccaaatagtttctcagtggggctgcaccaatacacaacactaccagaaatatcttgccagcacagggaatctaattgtctttagtgtttgctcatttcacaggcaaacaatggtacctcgttattttgatttacatttccaacaaggctgaatggtgttttctataagctgttactgcattttttattcctgaattttgccatttatttactgggcttgtcatacttttcagtttgtacaaactcttgccatactaaagaaaatagccctttttctgttgtactagcttagctatagatattttcccaaggctgttgtttcccttctggtttagttttttttttttttccttttatattcaaaagctttaaattattatgtagtgaagtctgtcacttttgtgggttttaagaaatttcttccaagtttagaaaattatccacccacctctcaagcagaagcttgatacatgctcagttctgtttgcatccagaatttttttttcttcagaagcatcctgattttttaaagtttgattttctttttcttgcccctttaactcatcaataatttatcatgctacaggtttgtgggatttaaattcatttctctcaatttactaaagttatctcaattatatgttgaataatcttcctcattaatttctgtttcccccttagtcataagctaattttttatataaaagttgaggcccatttctcacctgtttgttctgttccatcatgcatctactaataccacacctttaaaaatgattatttatttaaaatgtatctgatagggtatattagtccattttcacgctgctgataaagatatactcaagactgggcaatttacaaaagaaacaggcttattggacttacagttccacgtggctgggaaggcctcacaatcatggcggaaggtggagagcatgtctcacatggcaggagatgagagaaaagagcttatgggaggaaactctcatttttaaaaccatcagatctcctgagacttattcactatcataagaacagcacaggagagacccgccccgatgattcagttactcccaccaggttcttcccatgacatgtgggaattgtgggagttacaattcaagatgagatttggttggggacacagagtcaaaccatatctttccatcccctcccaaatctcatgtcatcacatttcaaaaccagtcatgccttcccaacagtctcccaaggtcttaactcatttcagcattaactcaaaagtccacagtccggtctcatctgagacaaggcaagtcccttctgcctatgagccagtaaaataaaaaacaagttacttcctaggtacaatgggggtagaggcattgggtaaatacacctattccaaatgggagaaattgaccaaaacaaaggggctacaggccccatgcaagtccaaaatccagcagggcagtcaaatcttaaagttgcaaaatgatctccttttaatccatgtctcacatccaggtcacactgatgcaagaggtgggctcccatggtcttgggcagctctgctcctgtggctttgcagggtacaggctccctcctggctgctttcacgggccggcattgaatgtctgtggctttacccaggcacacggtgcaaactgtcagttgatctactattctggggtctggaggatggtggccctcttctcacagctccactagacagtgccccagtagggactctgtgggggactttgaccccacatttcccttctgcactgccctagcagagttctccatgagagccccacccctgcagcaaacttctgcctggacatacagacgtttccatacatcctctgaaatctaggcagaggttcccaaacctcaattcttgacttctgtgtacctgcaggcccaacgccatgtggaagctgccaaggctttgggcttgcaccctttgaagccatggcccgagctgtcccttggcccctcctagtcacagctggagctgctgggatgcaggtcaccaagtctgtagactgcacacagcatggggatcctgccaaagctcggggacacagccaaaccatatcatagggcttatcctatctcattatattttaagcttactgtctgaaattttctttttgattctcacatgtttgaatgtaaacaaaatctttttcttagatacacttggagctcctttgaagaccagaaccaagtcttttacatgatttttttttcctaaagtggacagggctgtgcaagcctaaaactcgttcattcactgaacaaacttatttgtactgtccctgctttctgccaggtgtgggaggagggtgcagagaggaaagatgtggaccctgccacaaaggagttcatgataatgatgtttttccttaagaggtccccaaaaagaaaaggtgagggaggctttgtgcatccctgctggacctcgtgttttaagcaacaggtaatgtgattttcctctgccagcattgcaatagttaaatatgaagcctccccagctgtggctttactcacagggcctgcaacacaggccagaacagaaagactgacctttactgcttaccctagggtgctgggttcacctacatctgttatctggcaaggtttcctaaagtagaccactgttgtcggcattgtgaagatactcagaggatagcctgtgctcagaaataaatgagttctcaataaaacctgcagaattggtgatagccttgcaacttgctagtttttgttttgtctgcaaccatatttagctcttactttgtaataccaccattatcacaggctattctctgttcaaacaatgaatttgctaattaaaattggccaccttgttagtggcaataagctaatgggtgatatgattgtcccaggacttgaagaactgttttattatggaactattaagatattaataaaaagtggagggcatagtataatgaacacccatatacacattacctagatttaacagttgttaacattttaccacatttcttcatctcttttattgtttttgaagtactttaaactataagcatcaagacatttcactcctaaatacttagtattcatctagaaaaaaatgacactaagaggttttggatcttttcggtatggattatgaagttttccgtggatttcttttgtggtatagccaaatttcatttgccatttttgtattagtttgtttttaatacatcatcatcaaactagcttcagtagcttagatatgggttcagaactgaccttgcccagtgctgtttactggaatatacatccttatattcatttaatagcaaataaaattcttctggatttatacagaatgtatgggcctaaaatggatgcaaaataaataaaggtgggttctgaataccagccatgagtgaggttaataaaagccttaataactattcttcatgttcagtttgcagagaaattccaggaggtgaaagaagctgccaagatagccaaagacaagacgcaggagaaaatcgagacctcaagtaatcattcccaagtaagacattagtctatgaagtaaatcccagtggggttggtgatagggactctttgttccttgtcacttctggccagaaatagggaattttgacaataggtcattttgaaggctttttcaactattagcctgatcacagtgacatgtttttatgagactcttgaattttttaggatgtggtactgtatttctgacagaaaatggttgatgtgatttgagttaatacacatcctggcccaggagagacattctgtggtcactgtgtttaaatgccagaggcgaggcagcatgtctcctggctgtgctgggaggtgagtttctgtgtagggtaccttgtgcccacaagagagagacttgatgtcagacagcccttgtgttcatctccggttttaacagaggtcaggtggaagtggttattccaacagctctgtcttaacagaggagatccggcttggccaggaattcagtagtctgtctaaagtgtgaagattgactgaaaaggacctattttaatctgaaatcaacacacccactttcctgatgtctagattagtatatgtggtggtgggggaagtcgacctagtgacagggttatatgtagaaagccagggaaagggagacttcaggagagaatacttaggggcaggagtaagtgtgatatactagcaagatagccaggagtctgcctgctggcagctgaggtgtgctgtcggaggcgttgagatgtgcttggagatactgtgaagacctagaattcttcattactgggtaattttttatttattagctacttgtttaattattcttgagtagttggtggacgttggaagtgtgttgtgactgttgatttggatttcacctgagagggttggcttgcttgcagatggtaaggcaggcagggagggactgagagcagaaagattgtcgagggggctgtgaaggagagaatagctgggccagggaagcccggggagggggttgcaaatgaggacaggttgcaggaagagaaccaggaggcctgggcatcttgagcagtcaagatcgatgctctagacttgaccatcagcctcacaggggcagtagctgcagtctcgggtgcacaaagaagcagtggagagaggagggcagatgctggagccctaggaaataggcccagttatgaaatgggagccagcaaagatgacagggagggagaaattccagcatcgctgagccccaggagggagtatgcccaatatgtcggtgctcagagaggaggggagagaatgctgacagggaccctgggtttgtcagtgctgtggccgacccttgggacaggagatttggtgtggctcaggatgtttcacaaaggcagaacctatgtctgccttgagttgtctttccaataccttgttctggcctcatcatataaaatatgcccacatggacctatggaaatgcatgtgaattcgatttcaggtagacaggaactttcctgaatctttctaaataatctttaatatgattcagtgataccattaattttgtatgctaattacttgattaatctctgaggacctatgaaattcagcatctgaaattgtccatggtctagaaagtttctaatatactatctttttcagaataccgcatagtacagtgatatatttaagtttaatatctgaatttctccagataagattttgttttaatatttaccccctctcaaaagtttatttatttgagacggggtcttgctgtgctgcccctgggctcgagtagtcttcctgccttggcctcccaggtagctgggattacaggcataagctaagtattttaaaccttaaaaatacatgtatacctaataagatgttatttaacgtatatgtattatttaggaatgactttttgtttctaatctttagcagtatttatccttcctgatagttccccaggtatagaggttattgtatgtatttttttaaggctgggtacagcggctcacacctgtaatctcagcactttgggaagccgaggccagtggatcacctgagctcatgagttcgagaccagcctgggaatatggcgaaaccccatctctattaaaaaaaaaaaaagagagagaaagactatttttgtttttgtttttaagacagagactcaatctgttgcccaggctggagtgcagtggcgcgatctcagcttgctgcaacctctgctcactgcaacctctgctcactgcaacctctgcctcccaagttcaagggattctcctgcctcagcctctctaactgggattacaagcatgcgccaccacacccgactaatttttttgtatctttagtagagatgtggtttcaccatgttggctcaggctgatctcaagcttctgatatcaggcgatctgcctgcctcggcctcccatagtgctgggattacaggtgtgagccactgcacccggcccttgtatgctttttaaaattagtaatcacacaattacttggtttcctgaatctcttagagtatgaacactttgattaagttttcaaaatagttggatttttaagcagcctaattacaaaaacacttaaaatgtggggctgttttgtgactataaatgcaatacatgtttattgtataaaggaaaaatataccatactataaagaaggaaataaaaatcatctaccttctcaccacttgaagatattttattagtgttttggtgtgtatctttctaacatacttttccaggatatattttatattataccttttaactttatgtcatgattattccttttcaaaactgttttaatgactggacagcattctagtgttggtatcacagcttatttggttaacctataatttgtgacatctgcatttctaaaatttcactaatataaataacactgtgatgaatgttcttgcatgtctttgtgcatttggtggtttctgcataacttcttgaaatggagatattgggttaaaggtatggatgttcttaaagcttgtgatgcataccacaaacttagcctgcagaaatacaccattctaactcccacctgcagtgaataaggctttttcttaccacaccctcatcagcaaagctttgttaatttgacagatgaaaagtctttcttttcttttctcttctctttttttcttttgttttcttttctttctttcctttctctttcgctttctctctctctctctctctctctctcatcttctatcttctatctttgagacagagtctcactgtgtcatctaggctggagtgcagtggcgtgatctcggctcactgcaacctctgccacccaggttcaagggatcctcctgcctcagcttccccattagctgggattacaggcgcctgccaccatgtctggctaatttttgtaattttagtagagacagggtttcaccatattggccaggcaggtcttgaactcttgacctcaagtgatctgcctaccttggcctcccaaagtgctgggattacaggtgtgagccaccacacctggccttcattttgtacttctttactagtgagattaaatatttttatgtttatcgattgtatgcttttcttcttttgtgaatatcaattacctacccctttttaagttaaggtgttaatcttttgtattgattttcaagagctttatttttaaacacaaaaaaatgtgaacatatgcaaatctaggcataattgtataatggaccttcctgtacccataggtcagctttaacagttaggaaattatgaccaattgtttaatctgtgcacctactcatttgctcccccccaccatattttaaagcaaatgccagatgtttcatttcatccgtaaatatttcagcatgtagctctaaaagatgaggactctaagagcttgtcaatataggaaagatactaatatttttttccttttttttattttgagttggagtttccctcttgttgcccaggctggagtgcagtggcacgatctcagctcactgcaacctccgcctcccgggtcctgcctcagcctcccgagcagctgtgattacaggtgcatgccaccacgcctgactaacttttgtatttttagtagagacagggtttcactatgttggccaggctggtgtcaaactcctggcctcaggtgatctgcccgcctcagcctcccaaagtgctgggattacaggtgtgagccaccgcgcccggccgacattttgtttttcatatgtactgctgtatatattcccatcccctccccaccccccgggtttttgtctcattttaattttgtttatggtgttttttttgaaattcagaaattgaaacttggatttatacaccattctcttctagtttcttcctttgcccatgtacttatttgaggctaaataagatctttctaaggtcttatctagcaccagatgagatttcacctctacgtggtatgacttacggaaaacacttgaacatattcataacagcactaagtagtaagggagtgggcaaacaacaggacctggttcttgtctctttaatgaatgtgttgatctaactctccatagccccaagatatttaagttgtctccttttctaatatgtgctttttcattccttgtttctaagagtccctcctcccttgtggcttctgccctgtggtatttcaggagaccaggtctcccaagtttggtgggtttctccataaggcgtaagtaaaaaggctctgagcactggcccaggtgttcccttgtcagtaaagcacacagactttatgaactccacatggtctcttcagtgcctttttctttggtcatgatagtctttgttaggttttgttttcttttttgtttgtttgtttgtttaaaaaaaaaacaaaaacttgttagtctttgctgcattctggttggatgagttggttcgtccacactcgtaaagtttcttattatgcctaacttgctgccgatgtgcagacaagcaataacgtgtgaagataattcactttggccaggaatctgggcgtgaaaccccatcttctactcaggcatccagtgtcaacgggacggacgatgaaaaggcctctcacgccggtccagccaacacacacctgaagtctgagaatgacaagctgaagattgccttgacgcagaggtaaggctgttttaaagtccagattctattttctccaccttcagcacttccctagaagcctttcttgctggacagggtttcaggaaattgggagagaaaactgggacctgcttagagcatccactcttgtctcctggtgaaaggaaggccagctggcttcatggccctgctctggccaaccacatcagcatccatttgtgtgtgtgtgggaaatagagagtgtgtgtgtgtgagagagagatattgtgagtatgtaaatgtgtggagagagggcaaatgtgcatgagtgtggtagtgtcagagtgtgtgtgattgagtgtacatgtgtggagagagggtgtgtgtgtgtgtgtgaatgcacccctgtgcttgtgctttgttttgtttttgaggaggcaaatttatcatttatttatctataacattgactcttggccaagcatggtggctcctgcctgtaatcccaacattttggaaggccaaggcaggcggatcacttgagcctaggagtttgagaccagcctgggtaacatgatgaaatcctgtctctagaaaaaatattttaaaaactagccagctatggtggtgtttacctgtagtcccagctactctggtggctcagttgggaggattgcttgagcctgggaggtggcagaggctgcagtgagctgagattgcaccaccacactccagcttggatgacagagtgagactcttgtctcaaaaaaaagaaaaaaaaaagaattttgaacatctgagaaacgcatgtgaaaacataaactattaaaatatgaaatcacacaaaactcagtcacctatatacaaaaaagtcatgtggaatatatatttgaagaagagatcctttacagtatgaactagaaccataaactacatagaaataaacttaaatatacaagatctatgtgaagcaaactttaaaatgatttcaaggtttataaaataattgtttaataaatagccattctgttgggaagtggcaaaaagccttgatattttaaaagtatcagtttctcctaaattgatctataaatgtaacacaatccccataatgatatcagtaagattttaatttactgcatgagcggtgcttatgattttgtatcttgagaatgtggagcattccccacaggctgggctgagcttcgtggtttagggcggtcccatgagcacactcagggctttctgctggccaggggtaggggttcagcaggctttccccagtctccctcagaccgagaagcccccctcctcagagttgcccatttaagatctgtattggctgggcgtggtggcacatgcctgtaatcccaatgctttgggaggccgaggtggctggatcacttgaggtcaggagttcgagaccagcctgggcaacacggtgaaaccccatctctactaaaaatacaaaaattggccgggcacggtgatacatgcctgtaatcccagctactcaggaggctgaggcaggagaattacttgaacccgggaggcggaggttgcagtgagccaagatcacgccactgcactccagccgggtcgacagagcaagactctgtctcaaaaaaaaaaaaaaaaaaaaaaaaaagctgtatcatcttagaagctgtcttagctcaggctgctataacaaaataccacaaactgggtggcttaaacaacaaacctttacttctcacagttctggaggctagaaagtccaagattaaggcactggcagatttggtgtctggtgagggcctgcttcctggttcatagaccacagtcttctccctgtgtcttcacaggtggggagaggaggtgagctctctgaggactcttgtaaagacctggatcccattcataaagatttcatcctcacgccctcacctaatcctagttacctctcaacacccgcccccccgcctcctaagaccatcacattaggggtagggtttcaacgtatgaatttagggaggtctcaagcattgggtccataagagaagctgtcattttgaacttccccccattttacagatgaggaaactgaattccaagtgacaaagtgactccttgcccaaggtcacatggctagtaaaccttccatcacctcacatggcccgtgttccactcaaggctgcactcacagtctcttcaggagcctaccagaggcagcctgtccccttccacagccagagccgccacagagttggcccccagctctccaactcagctggcccggctgtgatctgacctaggaattccagaaagcacatgtgacccttagatccaaccccctgcctttggactgtgactctttgtcaggtacttcaaaggacagaactgtgaccagtctcttttcttactcatcagacaattgtgagagctttatttatttatttatttatttgttttttgaggcagagtctctgtgatcccagctgtagtgcagtggtgtcatcatagcttactacagccttgaactcctgggctcgactgatccccccgcctcagcctcccaagtagctgggaccacaggtgcacgctaccacacctggctgatttttatttttatttttgtagagatgaggtcttgctatgttgcccaggctggtcccaaactcctgggcttatcaagttatcctcccttcttggcctcccaaagtgctgggattataggtgtgagccaccacacccaactgagagctgtttttggttgtttaagtcacagtgggctgcctgggtgaaaatgtttcacccctaaaaataaatgttttcaaatctgagtttaatgagcaagtgaggtactacaagaatgggcaggaagctatttccctaaattagcttaaattgtcagtcatcaactctagaattcaccagataataacattttattatttcttcagtcagtggtgtttgaaagtgaaagtacatattttccaagtcctcgaggtccttgaggttgtgggataaaagataacacagatctattcagacacaccattgtatttacttaaaaaaattaggaagagcctttagaaagaggacttagccaggcggaaacctccccatgggcttgtcacgtgcagctctgccctgtcacctccagtcacattcagcgccacagatgtgtgggctcctagcaaggaaattgaaggagggtcagaagagaacaatgaggggaacctgattccagtttggttttgttttaaacgtcctcctcaccaagcatgtagaatcagatgaaacatgaggcctttgtggtgacagcagaggtgtccctcagattcctggtctcctcacaccccggggggatatgggccagccagagctccctccagacccctgttgtgcccccagggcactgattcctggtcactctctcctgtctccaagccctaggccctcagatctggattccttcaaaggctctgagaaggcacaggttacagtgggaccattattccccggagccaagctgttggcttcttgcttgtttaaacccagcgtcctggaggtccgtccatggctttcatacgattcttgaaggtcacccggtccacccatgaaactcctttcaggaggaagcagggcggccagtaaggaggatgggatgggccttgcccgccctgcagccctcatgcctagctttgtctcttcattcgtgaagaattgtgttttcttttttttttttttttttttttttggagatggagtctcgctctgtcgccaggccggagtgcagtggcgtgatctcggctcactgcaacctccacctcctgggttcaagcgattcttctgcctcagcctcctgagtagctgagactgcaggcgcccgccaccatttttttgtatttttagtagagacaggttttcaccatgttggccaggatggtctcgatttcttgacctagtgatccgcccgcctcggcctcccaaagtgttaggattacaggcatgagccactgcgtccggcccaagaattgtgttctcttctaaggtgattctttaagaagatagaccacaggatgacatgttcacaccagagagaggggccagtccctcctggccctggatcagggtagccagacccacctgccagcttactgtggggagagggcgtgggccccccaggggtgtgctgagggatggcggagtccccttccccacgcgggcggagccagacgggacagcacccaccccgtcgtcaccgcccgtccctgtcctgcagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaaggtgggtacggtggatgcagtgagccccgaggccagctggtgtgggcagtgggagatgggggcacccacaaccctttttctccctccccaactttgcccttatccccatggccagaggaagacttgctgcctctcccatgggaacgtccctccccctccctgcctttcttagtaggaatttaaccacgtacataattgactcattaccttttctggttttattttctttctttttttttgagatggagtctcgctctgtcacccaggctggagtgcagtggcacgatctcagtgcactgcagcctcctgtctcccaggttcaagtgattctcttgcctcagcctccgaagtagctgggattagaggcgcctgccaccatgcctggctaatttttgtatttttagtagagacagggtttcaccaagttggccaggctggtctcaaactcctggcctcaggtgatacacccgcctcagcctcctgaagtgccaggattacaggcgtgaaccactgtgcctggccagactcgttaccttttctgaaccaagttttataattcctcttactgaggagaagataaactggaggtgtcagccctgtctctctcagagtgccctccctcagcatttctgtggttcagtgaccctccgtggaggaaggggacccagagggtaggtgagaaacagacttgggagatggtgagttgcgcctgcttggaagtcctgcttccattcacattattgtttctaaacatgtaaatttggagttgagaaaaggattatggtgcttgaggcgtgaggagggtaaacaggtgctgacctgttgtacgccctctactctccgaccttgacatcctggcattttgatttgtttgaaaatgcacctgtaaccttccctgtcattagtcacactctagttcataaggtgcttttggggtggccagagaccccccattgaggtcttgaggtttctctgctaaccttgttttgatcatggttaatcctcccactagaaacacataggctttggagtatgctccgtcagtgcagggttttagggggacaggtcccatttagattggtgttcactcccccttgacccccttttctcccctgccctgcccgacctggagggcccctgcatcccagccctctgtcacactgtcttactttcatgctaatgccacataaaagtgtctcgtgtcattttttcatcttggtgctgacggttgggcaccaggccaattgctgactttgcacgttcccacccgaggcctggcagatctgcctgccagagggatcgattgccctttcttgcattttcaagaaaagagctgagtttctcactttggtctcagtctgatagccagcagcagtgcggggggagtggaggaagagcatcacgcacaactcgctcccttggaggcgtgtcgacctccctgagtcgacatctcacaagcttgcctcccagggttggaggcggaagttggtgtggtttccagcagcagcaggggctgggagttcagaccccaaggcttggtgcagcctgcctctgggaagtgtcctcggtgcccttcatgtcaaggactgctgctgcctgttcggggggacttcactacagtgcttttgtgttgcatgtggggtccacgcctgctgtccactctgcacacacattttggcccccagcattcaatggcagtgtgagagtgccaagcccttgcacccctgttccacacaggtaactgttttgaggggtcagccttggaaagggaaagatgcggtgtagggatttgccattcagccttggggaagaggcccacaggccaggccccttccacgtgcattcccaggggaaggtcaccttgatttataatattcgaaatgtcattgcttcccttttcggcagccactgtaccatgaggttgcttgatttttctaccctgctggcttaaacccttgagatgaaacagaataatgcaggacgtgattacagtggtgtaacagtcattctggagaaaagcagatcaattcaggggacacttggcccttgcttgtgatggatccttaaagcaaatctgaatctacttcttcacggccatgagaggaaaccagaagcccagagcatcttgaaggcaggctttattacttatttggctctgctggtaagatgcctctggtaaggcatcatgtgcaaagcaggtcccatgcaagcggtgcaggcagccccatgatggagctgcatggggtttgttcatagccacaaagaaaatcttataagtggattagtttagggtttattttaaaagaaaagagaagcatagctgtggtgatctcttgcttaatgactaatgttaagctggcgtccctgctttcctgtgtggtgtgtattgaagattgatgagctggaagaacaatgcagtgagatcaacagagagaaggagaagaacacgcagctgaagaggaggatcgaggagctggaggcagagctccgagaaaaggagacagtgagtaatggtgctccgagcagggccccttggcgtcctcttggccttgcggggtggcacacagcaggtgtcttggggcctatgactggccctggcagctgcctggatagcagcacggagagagagctgggagccacagcaaggtgcagacaggctggagcaaaggcctccccatgacctctgccgcctccctgttacccctgttctatagctggtcgtgcagatccacaagggagctgaacatttcacaagacactcagatgcgtttgtcatctgtcctcagaagttgagttttgctgccaaattaatgccgctagagacccatgatgtaaccacttattttcttttttaaaaaaatttaaaatgtatttattttatttaagatggagtctcattatgttgcccaggctggtcttgaactgggctgaagcattccgcccacctcagcctcctgtgtagctgggactatagacacacgccatgagagcaccacacacacgtgcccaccacaccgcagcccagctcccggcgccagccacctgcactcactgccaccatgcctggcctacagtcatttattttctagggggcagacagttaagtgcacacatgttggaggccgtgctcatgttaccaaactccctaggcctcactttctccacttataaaacagaaatcggaaaaacatctgccttgtggtggtgtgtacagacttcacgtgacaaggcgtgtgacacacttcacccttgaaattccctgagatgaagtattcgcatggtcactatcactgtctatgcaaacaggacagggtcccaaagctgcttccacgagcgtgcacacattggtgattttcaagaatatattttatctgacttgctttcatgttctatctcaaatttttttcatgtaggagctgaaagatctccgaaaacaaagtgaaatcatacctcagctcatgtcagagtgcgaatatgtctctgagaagctagaggtacgtgggttgggggcacagccatcctggctcagacaagaaggcacaaatgtcatggtactcattttcctgcttcctatcactttcacactgagaatgctgaaggagagattttctattcacaaaaagctggcagtgactgcacgccagatggcaccgcatccacccctgcccccggggcagactcagcaacgtttgtcttttggttttgcaagttctatgaaggcccctgtgcatcaccacagtgtagacgactgtttccttgcagatccctggtgggggtgaggagcgggggggcggcctgagagcccagggtcagggtgtggggccacttcagccactcccctgccagtggccttgggcactgaccttgggcaggccttcctccctatcctcagatttctgatcactaaaatgaggattttcagggcttcctccacctcggagcgcctcttccctgcaggtcctctgatatgcacacggcgcttcatgtagttacatgaccctggaattggtaactgcttcctgtgcacatgttcagaaaggtctctgtttattccctcaacataaagctcttatttgatatgaagagttaaaggcttatggctcatttaaggactcacagctgtcctgtctttgggaacctgcttgtgatttacctagatgtgcctctgtaggcttgtggggcccagcgccacagaacatctccatggtaacagcatcagagggtgcacagactggctgtccctgagtcattggcatggccagtccttcctctctgagggccagaggctggcctggggctgaggaggccacgcctctctgtgggaccaggggaacgagccactctcccatctgttctgtctctcaggatggaactgaaatgtggtctctgctagccactcagacagggatttcagactttccctgctgggccctgtgtgaggtctccctcaggcaggactctgcgttctgcctgctttgttgggtcttgggttttcaggctgggtgttggtccctctgtgggagagcaggcaggaaaggaggaggtcactgaagtgcctgctgcttcccttctgatgtcttggtcacaggcttgtgtgctggggtagcatgtctctaggcagcttaagccctggcccaggccctcagattggatggagaatggttggttcagctgtagcaggttttgaaggatgactctcgtcactcagttttctagacccttctcccttttgcttggccaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaa

SEQ ID NO: 38170 - DNA, 53622 bp, Homo sapiens; identical to SEQ ID NO: 37007

SEQ ID NO: 38171 - DNA, 6508 bp, Homo sapiens
cgcctctgttcaggtaggaggcggtatgcgggggaggggagtcacctgagggcggggatctcaggtcttggggagccattgttggcgaaccccaacttccgatacgacccggagctgttcctgcagttccagagacaattcatgggtcttggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgggcaggtgccacgagcccgccgcctcttcgccgcccgccgcctctcctcctctcccgcccgccgcctggccctcccctaccaggctgagcctctgggtgccagaagcgcggggcctccgggagaatacgtgcggtcgcccgctccgcgtgcgcctacgccttctgctccagttgctttcccaattgagcggaaaagccggggcatgttgccggggccctgggcgggacggttgtgccctgcagcccgaagcccgccggggcaccttcccgcccacgagctgcccagtccctctgcttgcggcccctgccaacgtcccacaggttggaaaccagaccctgcagcccccagctagcccgaaggaagcccagactgacgtcgcagggtaatggggacccagaggtagctctgtggggccccatcaggacctcagcccttagcggggctttctgtgtgacaccgtgggacctgaactggggaggtcccccttgcacagaattacaaggggcaactgtaggaaacaattaaatctattatgtgctaagtattgagagttccacggattgaggccctctctagaaggcttagaagtggggtagccggggtatgtgtctgactttgtgttttggtgcggtggtggtgagtgggtgtagaaactaatagtgccaagtgcagtgcctgtcaactagtaagttaataaaccttccgtgaatgaatgagaaggttctgtgactgagggagcagggctagagagggcatctctgctcatcccacccctgcctcccctgggctcaggcagacaaaagtaattaggttgaacctttaatcaaagctggtttcacaggcaagcagacatgatagaggaggtaaaggcagaaatcctggggacacagggtgctggcctggctcacaggcatgcctccttccgggacctcctccaccccctacagtttggcgctcagtaatctcttgttttcttgtctccctcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttgggtgagccctgaaacagcagggtggtggacctggggacacagaaccagccagacacactgggtgtttgtgtacaggcatgtggtgtgggtggattgtctgcacagtagaggccaggggccagtctgcatatgccagataaagaagctctgagatccatggacatgggtgcctgcggggctaaggagggctgcttatttgacgtgtgtgtgcatgccctggaggcactgtttattccgagagtgtttgaggggcttctgagcatggttttcacacctgtgtgggtgcatgtggaggcttcagggtgagtgctggctactgacactgtgagcactgggaactaaaaagttggcacaacgacttcatgtggcctggcatgctacccttcaggagggacaaggtccctgactccaatcctgagccctttgccccatgttgggtggtggagcaacagaactgctagaggcccgggactggcatccagagtgaggtgggaaatcccatatgcaaatcccagggagggggaactgccacgtcctgctccctttttgttccctgacaactgtagctgagaatcatgggtcagtctggggctagtgccgatggtgaggcaggagaagtggccgaagtagtagggccccatgagtgtcagattgcagcacaggctcctcctgttcctctgggaagtaacctgtctcaccccactgggcacccctgcacacctgaccccatgccttctttcattgctcctgtgtttctcccctggtccctaacccctaagtgtaatgttccctgcagggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaaggtgagtgcttccaaagagcctgtttggattgtcatagaggatgcctaaagagcatgtgggagcgccctttcttacccaccacctccacacccaacccagagcaggttcctgagcagttcctggccagctcctattgcttgtcaagatattttaggaggctgagagtggtgggatcaggtggcagaggaggaaactgccctgccaaacagaagcgccctctccctcttccctgtaatgtgagcttctggggctgccccatctgaccccaccctcaacatgggcagtaggctggacacctacgtgtcgccctctgccccacagtggtttgagccatctcagtttggcacttggtgggccatcctgtcaaccagcatgaacctggctggagggctgggccctatcctggcaaccatccttgcccagagctacagctggcgcagcacgctggccctatctggggcactgtggtgtggttgtctccttcctctgtctcctgctcatccacaatgaacctgctgatgttggactccgcaacctggaccccatgccctctgagggcaagaagggtgagcccccacccagaccgaccactggggcactcatttagcaggcagatgtttgttgaagactaggcgtttgcccggtcctgtgctggtcagtggatgtgggggaagaggtggtgatgtaggctgcatgggtagcaaacacaaatccatcccaagaggcagtcaagtactggacaagcggcagagccagcaagtgctgtgactcgttattttctggcccttcctcacaacagcacagacttccctgtcctggatagatagaatcatgagctttagtggcttggtcctgtttgtctttcattcattgagcttggtccttaagtggcttggtcctccctggtcctgtttctcattcattgaccttgcagcggagagggggagaggagagcagtggggtgagggaatacccttcatgctgatcctggctgtgcagatggactctgcccctgtggctggttaatgaatgttgggggttcaggttggggagagcagtcagggcagagcctgacgcccagccttttcccacctccaggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtaagatgagcatggggacaagggtgggcataaggagcaggaaccaatgcaggggatgcaaattcaggccttgcttccatttatcctctttattcgttccttgaggccgggcgctactcaggcagctatggccagtcacctatgggaaccctgtacctctccaggtttaagccattgtgggacaaccccaatgtgtaacaccctcccacccttcccttccctcttcccaccacaactccctactgcaggtagctcctacatgagtgccctggaagttgggggccttgtaggcagcatcgcagctggctacctgtcagaccgggccatggcaaaggtgagcgggcagaagggacaggaaggagaagggtccctttcagtcttcacggcgtggctgggacaggcactggagagatgggagtcccagggcacaggcaggttggcatctgctggtttagaccgggtgaagagggaatgattccaggctggtcttagctttcctacggttgtggaagtaaggctcttgggtagagttttaactgatgtgaaggacagccagaatatttcttagcttagctgtaggttgctccacagccccaggaaaatgggctgggaacagactaggtgccctccccagcacgtgtcctagtcctgcctgacgggggaggaggggatgttgtagagtttggcctcagaatgtaatgagcaggtcccagggcctcccagagctgcccagggccaagaactgtggtgggattgccaaagacccgtcagcagaggccctgctgtgtcagagtccaggggtgggtgttctctgccctgttctgaggacgtgacattgccgggactgtatccataggcgggactgtccaactacgggaaccctcgccatggcctgttgctgttcatgatggctggcatgacagtgtccatgtacctcttccgggtaacagtgaccagtgactcccccaaggtaattaagaaaggcctggctcacggcagggcacaaggagagaacgcaagggccactgactctgtctccctctcctggcttcagcctgggccaatcttttcttcgcctctcagatacccttttcagttctgattggaccgttcctctgtgtctgggttctcctcctccactctgggcctggttttcttttcttccctgtgctcctctaggatgttgctttctggactctggctcttcaccctctcgcggagctcacaggctttacagagcatgaggtgccttaaagatatctctggtttttctcctggtctgtctcacctttgtcctacccttctgccttacccctagccaatccagtttgtgtaaatcctgaggacagcctctagctcagagggatgacttctgtacctcctttccttgcccacctaggtccctgggtttgctcaatgtggcatctcctactctagctctgtattgtcagttgtgttggggagtggaaggaaaagaatcacttacttactgtccttttatgactactgtttgtttctggggaccaagccttcttcttgctttggcaggggtgggtaggcaggtcggctttccgactctgaatgccactccactctgcccttggcagctctggatcctggtattgggagctgtatttggtttctcctcgtatggccccattgccctgtttggagtcatagccaacgagagtgcccctcccaacttgtgtggcacctcccacgccattgtgggactcatggccaatggtaagtgttaacttctagagtctctccctcacccccacctgtgctttgcatatagaccagtgagaagctggagctagcaccactggcttaggttcttccctttccccctgacagtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaa

SEQ ID NO: 38172 - DNA, 135064 bp, Homo sapiens
ggctgggcatggtggctcatgcctgtaaccccagcactttgggaggccaaggcaggcagatcacttgagcctgggacttcaaaacctgcctggctgagatgttgagaccttgtctctgcaaataatctaaaaattgggagagtgtcatagcacgtgcctgtagtcccagctacttgggaggctgaggctgaaggatcccttgatctcaggaatttgaggcagcagtgagctatgatcacacccctgcactccagcctgggccacaaagcaagactgtgtgtctaaaaaataaattaattaattaaataaaaaaattttttttgagacagactttcactctttttgcccatgctggagtgcagtggcacaatctcagctcactgcaacctccgccttctggtttcaagcgattctcctgcctcagcctcccgagtagctgggattacaggcacctgccaccgtgcctggctaatttttgtatttttagtagagacaaggtttcaccatgttggccaggctggtctcgaactcctgaccttgtgatctgcccaccttggcatcccaaagtgctgggattacaggagtaggccaccgtgcctggccatttttttttcttttttgaggcagagtctcgctctgtcgcccaggctggagtgcagtggcgcgatctcagttcactgcaagttccgcctcccgggttcacaccattctccttcctcagcctcccaagtagctgggactacaggcgcccgccaccatgcctggctaattttttgtgtttttagtagagacggggtttcacggtgttagccaggatgatctcgatctcctgatctcgtgatccacccgcgacggcctcccaaagtgctgggattacaggtgtgagccaccacacctggccaatatttttaaaatatatgctagtaagccacactgtcttttggcgtttgtgcacctggtggggagacgtgtgaccttgaaaataatcaggagatctggccaggcgtggtggctcacacgtgtaatcccagcactttgggaggctgaggcaggtgaatcacctgaggtcaggagttcgagaccagcctgggcaacatggtgaaaccccatctctactaaaaatgtaaaaaatagctgggcgtggtgttgagcccctgtaatcccagctacttgggaggctgaggtgggaaaatcgcttgaacccaggaggcagaagctgcagtgagccgagattgtgctactgaactccagcctgggcgatggagcaagactccatctcaaaacaaaacaaaacaaagaaaaaaaaagaaaagaaaatcaggagatctgaagtctagtctccgcttggccacagtcatcatgaccttaaaccagtccctaaatgtctctgggatttctttcctaggcagttgcatgggaaaagcattcccttccgtcacctgccacagaggtggtgcagcctttgagatcaaggttcttgatggtgcttagcttagtgccttgtaagcacttccagtgggtgttcagtaaatgcttgtttatcgggtttcattccggggtcaggtgaccatggctccaagttctaagcgctgcagcctctccccgcgtgtctttgccagagtttgttactgaggctggggtcaggctgagtcacgctgccggccactgtctcatagatacgagattgtttggaaatgaagactgggcaggtctttgaactttgcttggcttacacagattcactaatcattcttcctaagcccaggtgctccaaagacgtgactccacagataaggaaagatgcacaggccaaggttcccaggagggcaaagcgtgagcctgggctcaggatgaggcctggtggcattcccttaggtcagcccactcatttggattcacggttacacttgggcgtggtgtgccaggttaggcagcttacaggagtaactggaaggccctctagtgaaaagtcactcaaaaaaccagagcaattccattttcaggcatagaaaaaaatagtgctgattgaaaattcagtatctattaatgcaggagtcataggacctcttcttgcagataacttggtcaacaattaatttgccataagttgtacccttgaataaagagaacattctctgggtggccaggcgctgtggctcatgcctgtaatcccagtactttgggaggccaaggcaggtggatcacaagatcagaagattgagaccatcctggccaacatggtgaaaccctgtctctaataaaataaaaaaaaagtagccgggcatggtgacgcacacctgtagtcccagctactcaggaggctgaggcaggcgaatcgcttgaacctgggaggcggaggttagagtgagccaagatcgtgccactgcattccagcctgagcgacagagcgagactctgtatctaaataaataaataaagtcatgtttttatagaatacttttatttcacataccaaaatttaaaataattccttaatatcatctaatagccccaccatattcaaatatctacagtggcccgaaatgtttctgtgattgcttctgtcagacaccaggaggtgccactgaggttttagtttagggtttgtttgtttgtttttatgccctttttaaattgcagccatgtggattcaaaccctaaagccagggaaggacaagctggtgcttacaaatgctcaaaggctacctttctcccctgatatgtttaggctgtgtccccacccacatctcatcttgaattcccacacgttgtgggagggacctggtggaggtaattgaatcatggaggcaggtctttcctaagctagtctcataatagtgaatacgtctcatgagacctgatggttttcaaaagaggagttcctctgcacaagctctctctctttgcctgctgacatccgtgtaagacgtgccttgctcctccttgccttccgccatgattgtggggcttccccagccacatggaactgtgagtcaaattaaacctctttcttttgtaaattgcccagtctcaggtatgtctttatcagcagcatcctttacccagatctgcaacctgatgtcaggtttccttgccatctccctttattaggtgggcttctttcctaatcttttacccacggtactctcttcagggtcccacttcagggagggcatctctatgccagtcctcctgggtggctgggctgcaaggctggaatcctggagcttctgagacccactcaggggattggtcacctgagggcaaggcccacagacaggatgtgcaaagccgagacaggatgaccacacttctgatgccacactctggatcctgggctccggctatactggaagccaggcctcccctggattcttctggtaggtgaaacaatgggttccctgtgttgctaaaacttgtgtgttctggattttctgtctctgaaaacaaaggtcttgaataaaatagttcattagagaacaaagcagcaggaaggtggggatggttaatgagcacaaaaaagaaagaaagaaagagaaaaggaagaaagaaagaaagaaaaagaaagaaagaaagagcaggccaggtgctgtgactcatgcctataatccctgcactttcagaggccaaggcaggaggattgcttgagcccaggagtttgagactagcctgggcaacatagcaagacccccatctctacaaaaaaatatattaaaattagttgggtgtggtggcatgtgcctgtagtcccagctacccaggaggctaaagtgggaggattgtctgagcccaggaggttgagtgcagttcatgccactgcacattagcctgggcaacagggcaagacctgcctcaaaaaaaaaaaaatggctgtgaccccagcttggataatgggctggaatagacaaatgtagagagaagcaagtgtggaagtaaggagacgagttagcaggccacttccatagaccagggaagagatactggtggcttgactacagagggatagtggaaaaatggaggtcactagagattgttgagactacaattgagagacgtttaggaagtgagatcaatggggctcaataatggactggagagtgggtgatggggagggagaggttacaaatgtttgctggtttttacatccttcatcggatgggtggtggtaacacttactgaatctggggtcacaaggaaagtaccaggctttttggggaaaccaggcatttagttttgtacatgttgtggttgagtccccccacattctggggtgggacctgattgggctccttgatcacatctatcccggaaaacaatccttgtagccaacaggttgtagcacgctgacacatcccactcaaaacacatggactgagaactggggaggacgaagagcagccgctgtgtctcacagagatctgggagaaaagggtgtcccaggttaggatttgggtgttcttggcatcctcagcgccattgaaatgccaatttgatcaaatctccacatcccaaaggtgctacttctgctctttcaacctgtctttaatgctcttagccttgggttctgcattaatgtttatgttggctggacacaggggctcacgcctgtaatcccagcaccttgggaggccgaagcgagtggatcacttgaggtcaggagttcaaggccagcatggccaacatggtgaaaccccttctctactaaaaatacaaaaattagccagacatggtagcgtgcacctgtagttccagctactcgggaggctgagcaggagaattggttgaacccaggaggtggaggttgcagtgagctgagatcgtgccactgcactctagcctgggcgacagttgcatttgcattaacctctctgttgtcttatcttttttatttttgctttgtattgttgtagtagttgttttggagactgggtctcactctgccacccaggctggagtggagtggtgcagtcatgactcactgcagcctccaactcctatgctcaagccatcctcctgcctcagcctcctgagtagctgggattacaggcacacactaccattttttgtagagacagggtctcactatgttgcccaggctggtcttaaactactggcctcaacagatcctcctgcctcagcctcctaaagtgctgggattacaggcatgagccaccacacccagcttgtcttatgttttagctatgtcttagttttttattctttgatcccatctgagaatatttgcccttgaatagcagagtttaatccattcttatgtcttacaattgatgtttgttcttctgcatcttattgtatgctttgtttcttatatgttcttgctatttttgaatttttcttttcttttgctatattgattaactttgcttaatttttatatccatgatttgaggttttacattctatttttattttattaatagtgcctacaggctgggcatcgtggcttacgcctgtcatcccaacactttgggaggctgaggcaggaggatcaacttgaggtcaggagttcgagaccagcctgggtaacatggtgaaaccctgtctctacaaaaaatacaaaaattagctgggcatggtgcctgggctgtgcctgtagtcccggctactctggaggctgaagtgattgagcctgggaggcggaggttgcaatgagccaagatcgtgccattgtaccccagcctgggtgacagagccaaactctgtctcaaaaaaaaaagaaaaaaaaaaattgcctacagagccctggagacccttgctggtacttagaaatccccagtatggctccctcttcctgtgatggggggcccacacgttgaccattgcactcaggctcccagaggtcgcagagccagtcctgcctctccccagggagcccagaggtcccagagccagcccttcctctccccagggagcacacagtccctgagctggctgaccttgacatcccatgtcattgcctacatggagggacactcctctgtgtccctcctccgcccccaccaacctcccggggacagctgggctgattccccagcaaatccacagctcccagcagttctcagatgcagccacacagcccactgggctctgcaaacacttagtttcacatggaagtcccggcctaccccagatgaaacagtgactcaaccaacagcctcaggcctccctcagtcagctgcctctaatactcctttcctccttatcaaatccaccatctgaaacccaaaagaaaggcatcacaatgaaactacttgctatctgttgtttaattcacactgatttaattaagtgataatgcttcatcaattaactttccctgtagtgtttttattttcaaagagaagcttataagccaaaaaggatttttcctgttttttggagacagagtcttgttctgtcacccaggctggagtgtagtggtgtgatagcttactgcaacctcagcctccaaggtgaaagtgattctcctgcctcggcctcctgagtagctgggattataggcacctgccaccacgcccagctaatttttgtattttagtagagacagggtttcaccatgttggccaggctggtctcaaactcctgagctcaggcgatccacctgccttggcctcccaaggattacaggtgtgagccaccgtgcccgaccatctggatctttgcctctaagacgtacacaagcaggcgtctctcagggcccctctcaaagagaggtcaatgcatgagcagcacccctgagcccggtgcgtccggggcctctgtcagcctccacccacaggagctcattatgctgtcagggtagggtgggaagctctgacacagagactgtgggggcattcgccccatgtttggaagatgctggggtcctgacaccctcaaactcagccctgggtcctgccttggtggagctgagactgcttggagccacctggaaaatgcaccccgccctccacctcttgctgacgtgtcccataggccagctccaggggtccaagggctcgatgagagcacaggaattggagctgggtcccagcatcccactgagaggctgtgtcagggtatactgtcttgtcccagcgtcattgtcaggacgtggagatagcaaagcctgtccctgaggctccaacaaaatcaaaggcgtgctgtcttagttgggaacggtgtatttgtgaagagcagaaatgcaaccgaggcctgcagggaatttctgtgtaagtcaagggcaggaagtacagcccggtccggcggttgtcagcaggtcatcgttcaccacccccgccacgctgacccccctcggaagcccagaggtcctcctctgcttctctccagccctgcatccttctccctggacagcggctttcctgcgaagggcttagcacctgctccccagcatacacttgtgtgagttttagggtgaccaggtgccaatcgtggtcccctctgcacggccttggcattcagatatcacttactgaggcctgagagggggcacctgagtgactgctggcccaccgtcccttcagctgtgggtggggtgggggacccccattattcaggtgtgagggtgcttggaaattccttaagcagtgcatagaggaaacagggaccaacatccccatgtccagagccccccacatcccactggaacagtgcagggacacgcaatctgccctttgtccttgatatgctattaacttacctggagacctctatagatcttctgtacctcagtttaccaatattaaaaatgggagggggtggactggatgatttctgaggtctcctgggcacagcccctgctgtcctcacagacgccactggagggcagcacctcctctgtcggggctgctggttctgcttgacccctccaatctgttcaagaaccttccttgctttaggttttgggggtttttttgtttttgtttacaaaatgacaccaacacagaaggtctttcagagaatttctggcactggtgagaggaacacccacggccagcaccatgtaacagctaacgggctgtgtctaaggaaggatgttttgtttctcaaaacttgtactgagcaacatgaatttacaggaaccaatattagaacatcaagatcccaggccccactagggtcttcccagcttctgcccctcgggagcagttgctcagtgacttccttcccactgacaacgtggttttgtggctgtttaaagaacacgattctttctgctgtccctgggagaggatgccccgttgtggctgggggcccacgcgtgctctccagcttctaggaggtttgtagaaaacaaaattggcctcaacaatgtagtttataaagtgaatgttagcccaaaagtaatagcactggaaggccttttatttcttcttggattttttttttagttttagttttgttgttgttgttgtttgtttgtttgttttttgagtcagagtctcgctctgtcacccaggctggagtacagtggggcgatctcagctcactgcagcctccacctcccgggttcaagcaattctcctgcctcagcctcccatgtagctgggattagaggcacgcgctaccacgcccagctgattcttgtatttttagtggagatggggcttcaccgtgttggccagtctggtctcaaactcctgacctaacgttatccgcccacctcagcctcccaaagtgctgtggttacaggggtgagccaccatgcccagctccttagttttagtttttaaacaaaattcaggtccaggcatggtggctcatgcctataatcccagcactttgggaggccgaggtgggaggaatccttgagcccaggagttccagaccagcttgggcaacatagcaagatcctgtctttacgaaaaatacaaaaattagccaagcgtggtgttgtgcacctgtggtcccagctgctcgggaggctgaggcagggggattgcttgagcacaggaggtcggggcggcagtgagctgtgatcacaccactgcaccccagcgagggaggcagagtgagatcctacctcaaaaaaaaaaaaaaaaacagcccttcgctcacttcctgttgctccacctgccctggcctcccgacctctctccgatcctgtttgaacctctgcatctgggagatacctgctcgtcccccttgactcaccctttttgctgcccaaggtgggacccacccccagcaggcacacctggagggactcacatggcagcaacagggaccacctgcctcccgcccaaccctgacctgcaggaggggtgtctgccacagtagggcctcaggaaactctttgtttgtttgtctgtggcagggtcttgctctgttgcccaggctggagtgcagtggtgcaatctcagctcactgcaacctctgcctccagggctcaagcgattctcccaccccagcctccggagtagctgggaccacaggtgtgcagcaccatgcccagctaattgtttattttttgtagagacagggtcttgctatgttgcccaggctggtctcaaactcctgggctcaagcggtcctactgcctcggcctcccaaagtgctgggattacgagcgtgagccaccatgcccagccccaggaaattctcattgcatgattcagtccaaccagcagcttcctggctcctatttgcctttccagaaagcagactctcccaggctgagcgccaagcctgccattcctccgtgagaaccacagtgagtgccaatgaacaccctgtaaactgtcactgttggaacaattgtgcttccaggtctgcgagaagcgcagggaaaatgacagcttgctcactgctcccaaagtgctgggattgctcagggctgaaggtgcttcagaaacccacgctttttgtcctcaaagtttttttgtaggttctgaaagtaatgatttttctggatccattagtcatatgggagtattgcctgggtccccctccttcatcgcaaagggaagagtcatagaatgatggaaagatgactggcttagagtctgagacctgagttcaaatcctggctctgttgctaatgaaagctgggccccagtttctctacctgtaccttggcaatcagagttccccgctcatggtgttgctgagagactcaagacaggctgagatccatgggaattttcaggaatgtttatttaaatttatttttatgttcattattgtaaagacaaggtcttgttatgttgcccaaggtggtcttgaactcctgggctcaagcagtcctcctgtcatggcctcctaaagtgctaggattacaggcatgagccaccatgcccaagaactttcaggatcttttgaaggacaacataaatgtgaatgaccctggtaaataaaacatcccaagagctagctcggtgctgagcccagttccggcctgcttcatcccagacaccccagccttgctttctgcatttgcagctgcactcctgcctcagaccagaatctcccggtggccctaggtggctgcagggagcacgtggctcctccagcccaggaatccagtggaggagatttctggagaccaccatgattccacccagagggcagcccttccctcctacaggacatattctttctagagccactgtgcagccgcttccataggcgagccctccctgaataggagcacagtgggagcagttggctgagctctgggctcacagctcagggcacaagggcaaagaagccatcctctcaagctcattgtcatccctggggtaaaacagaagatggcctggtggcctttgtgaggtgagtaaagaagcacaacaaggaggaggagagatccatgccccatgttcagtgcagagaacggcatgtgcaaaggccctgtggccggaacacatttggtgtctctgaggaacgctgcaaccagagctcggtgagaaaagggagggcagagacagatgatgcccagaaagcggccagggccagggaggcagaccacagctagggcttcggaattccttcaaggtgtaatgggggccaagtgtggtggctcacgcctctaatcccagcactttgggaggccgaggcaggtggatcacctgaggtcaggagttcgagaccagcctggccaacgtggtgaaaccccgtctctactaaaaatacaaaaattagccaggcgtggtggtgcatgcctggaatcccagctactcgggaggctgacacacaagaattgcttgaacctgggaggtggaagttgcaatgggccaagatcacgccactgcactccagcctgggcaacagagtgagactgtctcagaaaaaaaaaaaaagagagattatagcacactttttaatactacctataacattgaataaaagattaattttttaaaaaagtgtcatgagaaacaccggaagttttgaagtaggaaaatgatgtaatcagatttttattttaaagggataaatagtaataaaggtaataaagagtaataaatacccatgtatcaccacccaccttctgcagtaagtcgttaaagactgagttctcttccatccctcctcataattgatatcaccactacacttaatttcatgtctttcttttcttgcttgcttgctttctctctttctttctccttccttccttttctttctcttttttctttcttttcttccttcctttctttttctttctttctccttccttccttctctctcccccctccctccctctctttctttctttttctttctttctccttccttccttctttctctctctctctctccctccccctccctctctttctttcttttttggagactgggtctcactatgtagcccaggcagaagtgtgatctcggctcactgcagcctcaaccttccaggctcaagtgattctcctacctcagtctcccaagtagctgggactacaggtgcctgccaccacagccagctaatttttgtatttttggtacagagtctcaccaagttgcccaggctggtcttgaactcccgggctgaagtgatcctcccaccttggcctcccaaagtgctgggattacaggcgtgagccacttgcccctgctcggtgtttttcttattaattacctttactatgtgttgtgtctccttgacattatacagtcatgtgtcagtaaacaatagggatatgtgccaagaaacgtgtcatgagtcattgtgtgaacaccgtagggtgtacttgcacagacccacatggcatagcctacccacactaggctctgtggtgtggccacactgtggagcagtgtaactgctcctgggttacaaagcttcacagcatgttactctactgaaggctgtaagcagctgtaacacaatgctaagtattactgtatctaaacgtatctaaacatggaaaaggcacagtgaaaatacagtgtcaccatcttctgggcccaccgtcgactacactacccatcactgactaaaacattgtgatttggcacctaactgtgtatgtacatcattattttgttattcaactttttataaatactacgctattttttcctggacttgcttttgttgctcaacatgtttgtaactttttttgttttttgttttgtcattttgttttctgaggcaaggtctggctttattgccgaggttggagtgcagtgtggtgcgattttggctcacagcaacctctgcctcccagctcaagctgtcctcccacctcagcctcctgagtagctgggactacaggcgtactccaccatgcctagctaatttttgtattttttgtagaggtagggtttctccatgttgcccaggctgatctcgaactcatgagctcaagagatcggcccagcttggcctcccaaaatactgggattacaggcatgagctaccatgcctggccatgtttgtacatttctatcatgctcatatttctttttttttttttttttttttttttgagacggagtcttgcactgtcaccaggctggagtgcagtggcacgatctcggctcactgcaacctccgcctcccgggttcaggtgattctcctgcctcaggctcctgagtggctgggactacaggcacgtggcaccacgcccagctaatttttgtatttttagtagagacggggtatcaccatgttggccaggatggtctcgatctcttgacctcatgatccacccgcctcggcctcccactttggtgctgggattacaggcgtgaaccaccgtgcccagcctcatgctcatatttctaattttcattttctagttcatttgtctttaccactgcatgatatgatctctaaaacatcattattttacattcacctattgacaaacttttaggttgtttcctatatttttccattataagtaatgctgcgatgagcatgtttgtttcttatgcattcatgcaagtctctgtaaagtaaatacctagaagtggaatttctgggtcctaggagatgcccctgttcgactttatgaggtcttaccaaactgcttttagagcggttgcacctgttcacgctcccagccctggatgaagattgcttcacatcctcagttgcacttggtagcatcagaccttaaagtttttgccaatccgaggctgtgaattgatatctcattgcggttttcattttcattgccttaattactattgatcattcctatttctcctcctgtaaattgtcagttcccccctccttatgatttttctgttgggttgttagttgttttcttattgatttttagcatttctttatatgaatgctaattcattcattcagtacattttcactgagcatcttacataccagatagtcttttcaggtggttggagtttgtcgtgaaaaagaaaacaaaaatcccatcttcctcatggggcttacttcttcatggcgaattacacattcttctgtggcctgagtttccagaagcacagtgtgtactcttatttcgtgttcagtgatgttaacactgctcagtgtttccaaaggttgtcggcctgatccacagaataggataggatagaatagaatagaatgcaatatagtgtaaagatcccatcaatctcccatctaatggtgttggaaaccaatcatgatcattaccggggtccatcatttcattgaggctgcaaaatgactccttctgaatatactaactgtaattcctccaagaagaactcattctcaccaactctatagggtagaacagtggccaccccaaaagaatgtccccccagaacctgtgaatgtgaccttatttggaaaaagggggctggggggggtggctcatgcctgtactcccagctcttgggaggccaaggagggcaaattgcttgagctcaggagttccagaccagcctgggcaataaggtgaaactctgtcactataaaaaaaattgttttaattagctgggtgtggttgagcgtgcctgtagtcccagccatttgggaggctgattcgggaggatcacttgagcctgggaggttgagaggttgaggatgcagtgagctacgcttgtgtcactgtactccagcctgggcaacagagggagaccccatcttgaaagaaagaaaacgaactgagaaagcaggaggaaggagggagggaaggaaggaaggaaggagaaggggaaggggaaggggaaagggaagggaagggaagggaagagaaggaagaaagaaggagaaagaaagggaaaggagaggaaaggaaaggaagaaagaagggagggagggacagaaagggaagggcaaaggaggaaggaaggaaggaaaaaagaaagaaaagaaaaggatctttgcagatataatcaagtaaagaattttgagatgaagttctggattattcaaatggaccttaagtccaatgacaaatgaccttataagagaaaagcagacggacaaagacacagagaaaaagggaagaccatgtgaggatggaagcagagacggagtgatgcagccacaagccaaggaatgcccgtgaccgctggaagctggaagaggcaaggaagaagccccccagcatctttgagggcagcttggtcctgccaacaccctgatctcaaatttctggtgtccagaactgtgagaaaataaatttctgatattttaaaccatgtcgtttgtggttatttattacagcagcctcaggaaactgatgcaaccaaccataggatctctcagctgcagtgtgcacagggaaggcgggacatatatttgaccctttctttctatttgccaatttacagaaaaataaatggtttccctagcaacctccaaagaagaccagtgcgttttctttcacttatttttaggaccataatgaactcatatatttctatatattcagtgtttcaattttcaatccattgcagttatgattctttttatgatattgttcttttgaatgcttaagttgacccaggagccccttcaagatggccccagtgtctttttgacataaatccagtacttagttaaatttcttgttttctggcctaaaaagatatcccaggttcttcttaaatattctttttttttttttaatagacaggagtcttgctctgttgcacaggctgatctcaaactcctggccttaaatgatcctcccaaccctgcctcccaaagtgctgggattacaggagtgagccactgtgcccagcccatcttctatattcttgttccgcatctggaatcagtcatttctccaaggttccctgattcctcatagtgaaaaatgatatttagaagccactatctgggccgggcacagtggcttacgcctgcaatcccagcactttgggaggccgaggcaggtggatgatttgaggtcaggagttcaagaccagccttaccaacatggtgaaaccccgtctatactaaaaatacaaaaattagccgggtgtggtggcgcgcgcctgtgaccccagctacttggaagggtgaggcaggagaaatcacttgaacccaagaggtggagattgcagtgagctgagatcgtgccactgcactccagcctgggcaacagagcaaaagtccatctcaaaaaaaaaaaaggggagccattatctggttataaggtgttaattgcttgtaggttgtttttgttggtaagacgtttcagtgaacagacctaggaaatacatgtttttagaaagagaaaaagaatttattgccaagtgcagtggtgcgtgcctgtagtcccaggtagctggaaggctgaggcaggaggatagcttaagcctaggagttctgggctgcagtgcactgtgccaatcaggtgtccacactaagtctgacatcagtatggtgacctccctggagcaggggacaaccaggttgcctaaggaggggtgaatcagcccaggtcagaaatggatcaggtcaaaactcctgtgctgatcggtaatgggatcatgcctgtgaatagccactgcactccagcctgggcaacataacaagatcctgtccctaaaaaaaaaaaaaaaagaatttataaatttatattgatatttctaaatttatgattacagagtttttatctagctttgttaatttttttttttttttttgagacagggtcttgctttgtcacccaggctagagtgcagtgatacaaccacggctcacggcagccttcacctccctggctcaagcaatcctcccacctcagcctcctgagtagctgggaccacaggcatggaccaccatgcctggctaaattttattttttgtagagatgaggtcttgcggtgttacctaggctggtcttgaactcctgggctccagtgatcctcccacctcagcctcccaaagtgctgtgattaaaggtgtcagccatgaagcccagcctaatttttcaatttggatctctgttttttatgctgaaaatcttgttagtgaggacattaacataattatttgtgcacatatagtagtagaggatagtaattgcacacacacacaatttcaaaataacaataccaatataatttttaagaggattcctaagtactgtttaagattccttggtacttcttcttgtccttaggatatactgcagcaggtatgtagatgaaaaataccgtgtctaaaataacatgaaaaaatccttcagtgttcatgccaccggccctatgtataattgttcaattgttctgctatatttttatgttgaaacgtaactcgcgttttatgtttcaggaatgcttttttccttacttacttaattttactttgcaattacataaagcctgatgttccaaagtcaaaactaccaaacagggcacatccagaaaactccaccttcccacgccaccctcagcacccttcccctgccttctctttttaggaaacctttttttgttgttgttgttttttttttttttttttttttttttttttttttttttgagacagagacttgctctttcgcccaggctggagtgcagtggcgcgatctcggctcactgcaagctccgcctcccgggttcatgccattctcctgcctcagcctccctagtagctgggactacagatgcccgccactacgcccgcctaattttttgtatttttagtagagacggggtttcactgtgttagccaggatggtcttgatctcctgacctcgtgatccgcccccctcggcctcccaaagtgctgggattacaggcgtgagccaccgcgcctagcctaggaaaccattttaatttatttttggtttctttttccctgtttgtgcttcaaaacataaacaaatacttaactatattcatatttctaattcttcttgtgccatctgtaaaattgcttttttcaggcttaaaaacatagcctacaggccaagcgcagtggctcatgcctgtaatcccagcactttgggaggccaaagcgggcagatgatctgaggtcaggagttcgagatcagcctggccgacatggcaaaacccatctctactaaaattacaaaaattagccagggcgttagtggcatgcacctgtaatcccagctactcaggaggctgagacagaagaatcactcgagcctgggaggcagaggttgcagtgagctgagatcgtaccactgcactccagcctgggtgacagagactccatctcaaaaaaaagaaacaaatgtagcctagagattattccctatgcagttctctgttgtgtgaatagccctggtttagtcaaccaatccccaactgatggacgtttgtgttttttcctgtattttgctgttaaaaaggtcagcatgaatggcttttttgcaagtttctttctttctttctttctttctttctttctttctttctttctttctttctttctttctttctttcttttttgagatggagtcttgctctgtcgccaggctggagtgcagtggcacgatctcagctcactgcaacctccgcctcctgggttcaagcgattctcctgcctcagtctcccgagtagctgggattacagatgcacgccacacccagctaatttttttgtatttttagtagagatggggtttcaccatgttggccaggatggcctcgatcttctgacctgatgatccacccacctcggcctcccaaagtgctgggattacaggcgtgagccaccgcgcccggccacaagcctctcttaaggatagactttcaggggtgggagggctggatccctgaggacaggcaagtgtaatcccatctccatcttcatttccttgtctgccttcccacaggaatgtaagtaagctctttggccgtaccgcccactgttgcgtctctcattcattatagacacacatatctggtggaaagaatgaatcgcaccgtgtcgttcccctgtggaaaccctgcagtcgctgccgtcacctacagggtaaaatccgaaaccctttagtggcacagaagataccagtgacggcctgacctgccctggccacacccccgctttccgtgccagcatccttgaacttggtcctctgaccacgccaaattgcttccacttccccaggtgtcttcccatcagcacatgccacactctcgggttacaatacccccgcccctctctgacttggtttcccaggtgaactctttctcagccttcaaaacccaggccaagcacttggattttaaacacaggcgctccctccaccatggggcgatatggcgattacttattttagtgtccactctgctcaccagacccgagctgtaggagtgtgggagctgttctcacccatccctgaacccccagcacctagtgttatgtcaggctcagagcaagtgcataagaaagcttgttgagaaaatgaaagggaggcttcctatggttaaaagaatgtggatacaaaagacttgggttcaaatcctggcttttcatctgccacctaggagatcttgggcaagtcgacgtcttggtttgctttctgtaaactggggataatgcaagttcactgaaggtggccttcggggctgagggcagtcacgtgtggtggaagtgcttaggatatgacaaataatgacatggaaaaacaacagaggtaacaagagcagaaggaattcagaagagccagggtgagctcaatcagaagtgaggaggaagctaaggcatgggaaggaaggggcatcgatgaagggaatgcataagtgaccaagaaaattggtagcagccaggtgtggtggctcatgcctataattccagcaccttgggagaccaaaggtaggaagatcacttgagcccaggaggttgaggctgccatgaagctaggatcaccactgcactccagcctaggccacagagcaagatcctgtctcaaaaaacataaaaataaaaataaaaaatatgggtcactcttctgggtacttctcagtgttatttaatgataaaaaaaatatgggtcactcttctgggtacttctcagtgttatttaatgaagccacagccctatgagccctgtgaggtcatgttatcatcccacataactaatgggatgcctgaatctgggtctggtaacaaggaccaggcaccatttgaccaacaagggggtttgcagtgaggtcccctctcttctttccttctgtcctgggagcccttcttctttctcgtctcctgttttttctttgactcacagccactgctccaaacttccccactgacaaattctcagtgtaagaatctcttcctaggccaggggtggtggctcacgcccgtaatcccaacactttgggaggccgaggcaggaggatcacctgagatcaggagtttgagaccagcctggccaacatggcaaaaccccatctctactaaaaatacaaaaattagctgggcgtggtggtgcacacctgtaatcccaactacttgggaggctgaggcagaataattgcttgaacccagaaggcagaggttgcagtaaaattataccactggattccagcctgagcaacaaagcgaggctctgtctcaaaggaaaagaaaaggccaggcgcggtggctcacgcctgtaatcccagcactttgggaggccgaggcgggcggatcataaggtcaagagatcgagaccatcctgagcaacatggtgaaaccccgtctctactaaaaatacaaaaaattagctgggcatggtggtgcgcaactgtagtcccagctactcagggaggctgaggcaggagaattgcttgaacccaagaggtggaggttgcagtgagccaagattgtgccactgcactccagcctggcaacagagtgagactccatctcaaaaaaataagcaacaacaacaaaaaacacctccttcctttttattaatcttagtcttggaaatccctcccactttgatctctatcccttcacctatgtgcggttgtgggggagtagggggaggagtggggggaggagtcgggggcgggcagaacaaagaagggatatttgaagtaatacaaaggaataggaaagaaatttttaaatgacaaatttccaaagttattttattacatctaatgctaaaggaaaggtcaggctggtttataattcagacaggtcaacatatatgatttgatgggagaatagttagggttccatttcctttaagtttctattccaatcaatttccactggtgatgtctaactcagatcccgtctcatgaactgaagccatctcacttcctgtccaggatgatcgtttcccctcttttaatcagaatcccaacagctgccccagggggagcagcgtgttccagacacacatggtttcttagacaaggtagggtgcggctgcagcggacaggcacttctggctaggtcaggcttcaagctagttaatattgaatcttcctcttagctttcctcagttcaatgctcttcttaagtagtcaagaatttcctcaatcttatgtaggtaaaactggaattcagagcctagagtgtattctgtaaaaagaagagttagtcggaaatggttaaaccttgtacagtcctcacaaaaacagagaagggggacggccagacaccatacccgcatcgtatttttgggaagtcttttgattccttagaatgctctccacgtgcccggtgcattgcctttagtcatcttcactgtgtttgaactcaggcttctaagctgcccagagccaaggggtggcgtgttgaggtgggctgtactcttggattttggcttctcccacgatgccccccgtggcccttgcctgaggggatataggcgttttctagtaaataaatcgcaagaggtccgtatttggccatcgtcttgtttttgtaactgaccttggtttctcaattcactccttgcaggtgggttaatcatatcaaccccgctgggatacagttctctacagaacagtgaaataccatgagtcacgcagctgggttgaccacagccaatcactgctacatagaaatctgggcctggccaggcgcgatggctcatgcctgtaatcccagcactttgggaggctgaagtgggtggattgcttgagctcaggagttcgagaccagcctgggccacatggccaaagcccgtctctacaaaaaaatacaaaaattagctgggtgtggtggtacatgctactcccagctacttgggaggtcgaggtaggaggactgcttgagccctggaggtcatggctgcagtgagccaagattgcgccattgcactccagtctgggcaacagagcaagactctgtcaaaaaaagaaagaaagagaggaagaaagagagagagagagagagagagggagggagggaaaagaaagaaagaaagaaagaaagaaagaaagaaagaaagaaagaaagaaagaaagaaagaaagaaagaaagaaagagagagaaagaaaaatccaggcctgagggaaggtgggccaagatgatgcccagttgtctgttctataatcagcaaagggaggccacaattcgggttccctgggggtaaggaagccctctgatgctgaactgggagttgaagtaatcgatcctaaacagcgattcttagtggacctacagacaaatcacagcatggaatacctcagtctggggccggtacctagaacatctgaccccctcgtgaggagatgctagagtgacgctgtagtggaaaaagcatttcagatgtggcaaatagaacgatacgcagtctgttagtgactattgcaagaatagcgtaaaattgttttagggaaagcaggggaaatatggcaacatttagacctaggagacaggccgggcacagtgactcacacctgtaatcccagcaatttgggaggccgggcaggcggatcacctgaggtcaggagttcaagaccagcctaaccaacatggtgaaatcccatctctactaaaaatacaaaaattagcctggcgtgggggcgcgtgcctgtaatcccagctacttgggaggctgaggcaggagaattgcttgaatctgggaggcggaggttgcagtgagcccatgagattgcaccactgcactccagcctgggcgacagagtgagagactccaaaagaattaggagacagacccatgagtctaagctccctttggtcagcctgcttgcaattggacctgttaaagacgacatcactttcggacaaagggattcttgctgttaatgttgtatatggtataatatggggaaatgattactgtaactgatgtcagtttttttcttctgttagtattgtattggaggagtgaattgtatttcaggaaacaatatagaaaacacctatatcctctgttaattcagtaagtgaaccaggaaggaaaggtggggagaaaatcacaaataggccttattcgggttggggaggtggaaatttaatttttttgtttgtttgtttgttttggttttttgaaacagagtctctctctgtcgcccaggctggagtgcagtggcgcaatctcggctcactgcaagctccgcctcccgggttcatgcccagctactcagcctccccagtctcagcctccccagtagctgggactacaggcgcccgccacctcgcctggctaattttttgtatatttagtagaggcggggtttcaccatgttagccaagatggtctcgatctcctgacatcgtgatctgcccgcctcagcctcccaaagtgctgggattacaggcgtgagccgccacacccggaggaaatttaagttttaaaaggtacatataaagatgggataaggccgaacgaggtggctcgtgcttataatcccagcactttgggaggctgaggggggaggattgcttgtggccaggagtttgagaccagtctgagcaacatagtaagagtccatctctacaaaaactacaaaaaaaattagctgggtgtggtggtgtgtgcctgcagtctccgctactggggaggctgaggtgggaggatcacttgagcctggatgtttgaggctgcagtgagccgtgattgtgccactgagctccagcctgggcaacagactgagaccttgtctcaaaaaagaaaaaaaaagtgggataatattgagtacacaatattgataggatactgattctactgtattggaaaatataaaggtatcaggaatggttaacagaatgggctgtaaagacaatggattcaccacaactttacagaaagcagacaaaataaagatgaggaggctgtgaaatatttacactcttgccaacacagaaacgaggtgagccaaggacacggttggagcctgatccaaggaactggaggatgcagcggaggctggcctgcccgcacctgcttccagcacgctggggtctggggcctgcgccccaggcagatgcagggaacaatatgtggtctagttaactccactttgagagaatgtataggaggcgttgggggtgggttcataacacagactatgatcaagatgcgcaggaaataatctgggtggggttaataaggttaacttggccaggcacggtggctcccgcctgtaatcccagcactttgggaggccgaggtgggcagatcacctgaggtcaggagtttgggaccagcctggccaatatggcaaagccccatttcagttaaaaaaaaaaaattagccgggcgtggtggtaggtgcctgtagtcccagctactggggaggttgaggcaggagaattgcttgaacccgggaagcagaggttgtagtgagacgagattgcaccactgcactccagcctgggtgacagagtgagactctgtctcaaaaaaaaaaaaaaaaaaggttaacttgaacctacactcttgtgagagcttccggatgttgtggtcttcttgcttctcctgctctctctagccaagactaggtaggtaataaatcacgtagctgtcgcttctgattgtctcgtgtgttctactcactggcatccctgcctggactgggaaaaagtcatcaccctctgcccaagccctgtgcagcttggcccacctgagcctcttgctactgaaatgactctccttcccttatatcaccagaagagatgggtccacctagaggaaggagcaaaacaggagttaaactgcagagcatgatcaagagtcggtctcactcaccctgattcgggaagttggattccaccactctgtggttcaggggctgggtcctgcggtaatcgttgtggatggtcttgttgcggtgatccagtaaggaattctccagcttccaaacctgggggcaacgtgagtgcattatggaggggaagagtcactgggtaatttaaaagaaataacagttggcccggcgcagtggctcacgcctgtaatcccagcattttgggaggctggggcgggcagatcacttgagctcaggagttggagaccagcctggccaacatggtgaaacctcttctctactaaaaattagctgatcatggttgtgtgcacctgtaatcccagctactcaggaggctgaggcaggagaatcgcttgaacctgggaggcagaggctgcagtaagccagtatcacgcaaccgcactccagcctgggagacagagagaaactctgtctcaaaaaaaataaaaaataaaaaagaattaacaactgggctagagtttggatttatataaccctgatgaagtgactgtaagaagatctcaagtccaggggaggttctgggtgctgtgtctcaggcattattccagaactaatctatccgtgcattcttccaacaggtatctgcacacaagctctcttttcagctttttatatgagtatttgtccagtagtagaaaggagagaaagaagaagcagaaatatatcaagtggcaaactcaatttttgtttttctgaaaatgtcaggtttttctcttttttttttttttttttttttgagaccagagtctcgctctgtcgccaggctggagtgcagtgacgcgattgcggctcactgcaacctccacctcccgggttcaagttattctctcctgcctcagcctcctgactagctgggactacaggcacccacccacacacccagataatttttatatttttagtagagatggggtttcaccatgtgggccaggctggtctcaaactcctcaggccattcgcccactcagcctcccatagtgctggaattacaggtatgaaccacctcacctgacctgaaaatgtctgtattttgtctatatccttgaaaggcatctttgctgcacatacaattctatattggctattttttttccctcggcactttgaaattatgtttccactcccttctgactttcactgtggctgttaaatcaactctctgtctaataatactcttttcatgataatctgtcttttctttctggctaatttttaaatagtttctttgtctttgatgatttcaatgtgatgcgtttactgcaggatgttgtgtatacacacacacacatatctacacacccagagagagagagagacagagagagaaactaattggcattcttgaatatatgacttggtatctcttcctgaaaattgtcagccaatattttgtcaaatcatgcctcttccctactctgcctctcttctccttctaggattttgattagacatttactagacctttccagtacacaatgtctcttcacttcttttcatagttccatctccttttctctgtgctgcattctagataatgttattggctgtctccaatttactaattctctctcaaactgtatctaacatgcgttaaacccattcattgggtttttgtttttgtttttttgagatggagtcttgccctgttgcccaggctggagtgcaatggcatgatctcagctcactgcaacatccgcctcctgggttcaagcgattctcctgcctcagcctcctgagtggctgggattataggttcacaccactatgcccggctaattttttgtatctttagtagagacagggtttcaccatgttggccaggctggtctcgaacccctgacctcgtgatccacccgctttggcgtcccaaagtgctgggattacaggcttgagccaccgtgcccagcaaactttttttttttttgagacagggttttgctctgttgcccaggctggagtgcagtagtgcaatcttggctcactgcaacctccacgtcccaggttcaagtgattcttccacctcagcctctggggtagctgggattacaagcgccccaccaccacgactggctaattttttgtacttttagtagagacggggttccaccatgttggccaggctgatctcaaactcctgacctcaggtgatccacccactttggcctcccaaagtgctgggattacaggcatgagacaccacaactggcctggattattaatttttgatactatttttccatttctagaaattctatttgagtttttgtcccaagtctggatgtccatttttatacttttttgctcttttctcatatttaaaccttttatttctttatacatgttaaacattcttatgtcatattaattgtctgataattccactaactgaagtctttgtaggtctgattctgctggttctcatctataatgtctttttttctcatatgttttgtatttttttttcttaattgagctaatttcaagtaactttatttgtgaaaattcttctaggtctggatttaaggtcattttcccagagataatttaccatttgcttttgtcaggtgtctgggggcacttctagcctgactggcaacattttggagtgtgagtgtccttgagcaggggtcttttccacctttttctaaggaaatgaaaagtttaagaaaaggagatggccgggtgcagtggctcacacctgtaatcccagcactttgggaggctgagacaggcagactgcttgaacctgggagtttgagacctgcctgggcaacataataaaaccctgtccctactaaaaataaaaactagccgggcgtggtggcacactcctggagtcccagctactcgggaggctgaggcaggagaattgcttgaacctgggaggcggaggttgcagtgagctgagatcgtgccactgcactccagcccaggtgacagagcgagactctgtctcacaaaaaaaaaaaaaaaaaaaaggttggctagacgaggcacagtagccctgcacacagaaaatactgtaggaccccttagttgttgacgttcgttgagatgctggggagaacccttgttaaccaggcaatcgaatgggaagacttcggcaaagtgataccatacattacctgtgtcctggagagcttgacaaaatctgccagcacaaaccagtggacgttctcagtgcagggaggcgtggtgagtgagccatggtaggtgtagtagtgctggaggttcctgggcagcatgtcctgaacgtcaaggccagtcagggttgttctttgtcctgaccaagaagacagaaggtaacagaatgtcagggaccagcgctgcccctcgggaggacagctcaggcccaggcctcgccaggttccaatctcttgagttcagcagaacatagaagctgatgattaagaaacaatttcccagtttacttcttcctggaagggattgagaggagagactttggggatagacgcactcagacacctgctcctggctgagtgctcttggccgggtgctcaccctgcggccattttctcatctgtagaaagggaataatcagcaggattgttgtgagggtaagaaggaataacgtctggaaagcagctggcattgaaccactacatagggaagtactcctaagtgtaactgctgcggtcaccattatcatggctaggcagaggacacattttatgatcaatgaaagaaataaatatggcccctggagacttctgggtaagtgcccttgaagaaagaccaaaatgccttggtttgggctcattgagaagtgggtagacaacagttgtaaatgcagaatcaggccaggcgcagtggctcacgcttgtaatctcaacactctgggaggccaaggcgggaggattgcttggggccaagagttcaagaccagcctgggcaacacagggaggccccgtctctacaataagttgttttttttattatttttttaaataataaatgcagaatcagaaccaagccagggtccaggtacaggcatttggtcctgagctcttcctgccacaaccgctggaaaccaagcccagccacaggtggggcgtagggtggggccacttccaccaggcctgcaaaactcctgcagcagccacacctgctcctgctctagagaggtccttgtttcattcatgtcaacaacactgagcccctgagctcagcacaagactctcaaggcaacacaggattgagttggattttgcttcactttccctgagcacttctgcgcttcttaaaggcagagaacatagttttgatacatacgtagataggcctgttcaaccaaggccacaatgtctcagagtgcataagcccatgagtaggcaaaagagttctaagtttgattattattggaagatttcaagatataacctccaaaagggctctgtggtagagatttatttttgtaactctaatatatttaagtgaaagtcaagaattccagaatcatgatgcagccaccacggaaaatggtataatagttcctcaaaaaataaacatacggccaggtatggtggctcacacctgtaatcccagcactttgggaggccgaggcgggtggatcacctgaggtcaggagtttgagaccagcctggccaacatgatgaaaccccgtctctactaaaaatacaaaaattagctgggcatggtggcacgtgcctgtaatcccagctactcgggaggctgaggcaggagaagcgcttgaacttgggaggcggaggttgcagtgagccgagatcaaggcactgcactcccgccccagcgagactctgtctcaaaaaacaaaaaaaaattaaaattaaaaaaacatagattactatgtgacccagcaattctactcctatctacccaaaagaaatgaaagcagggactcaaagagatacttgtacacctatattcatagcagcgttacctcacaatagccaaaaggtagaagccaccaaaatgttcaccagtagataaatggatacacaaaatatcatatatccacacaatggaatatacttcagccttttttttttttttgaagcagagtctcactctgtcacccagactggagtgcagtggcacaatctcagctcactgcaacctctgcctcccgggttcaagcgattctcccgcctcagcctcctgagtagctgggaatacaggcaccctccataacacctggctaattttgtatttttagtagggacggggtttcaccatgttggccaggctgatctcaaactcctgacctcaagtgctctgccagccttggcctcccaaagtactggaattacaggcgtgagtcacctcgcccagccacttcagcctttaaaaggaatgaaattctgataacatgctacaatgtgggcaaacctaaaagacattatgctaagtgaaataatccagaccaaaaaaaaagacaaatactgtttgattctacttatatgaggtacctagaatagtcaaattcttagagacagaaactgtggttaccagaagctggaaggggagatggggagtaactgttgaatgggtacagagtttcagtttaggaagacgaaaaaaagttccggcaatggagcggggtgatggttgcatcatactgtgaatgttcttaatgctactgaactgtacatttaaaatggtttaaggggtaagtttgttgttgttgtcgttgtttgagatgttgttgcgctctgtcgtccaggctggagtgcagcgacacaatctcagctcactacaacctccacctcccgggtttaagcgattctcctgcctcagccttccgagtaactgggattacaggcgtgcaccaccatgcctggctaatttttgtatttttagtagagacggggttcaaccatgttggccacactggtctcaaactcctgacctcaggtgatcagcccgcctccgcctcccaaagtgaggggattacaggtgtgagccaccgcacccagccttaagtggtaagttttaattcaggctgtgggactgcgtggagtcactgagatgagacagagcctgactccacccaacatttagggcaggagccagaaagagagtgagagggcagagctggggcgcgccagaccaccctttgaaggtaaactaagacgagaagaagagtggcccatagatctgaccgtcactccggctccgtggagcattggggccagctcagggtggggtgggtgagaatggagaacaggactattctatgaccttttcaaggggagccagagaactgggggaagctggggaatggtaaggtcaggagataacgtttgtttgcttgtgtttggaggtgggaggaattagggcagatgtgtgtgctgagcaggaggctttaataaagagtaagacatcaacgatgcagaccgggcacggtggctcatgcgtgtaatcccagcactttgggaggccgaggcgggtagatcacaaggtcaggagatcgagaccatcctggccaacatggtgaaaccctgtctctactaaaatacaaaaaattggccaggcatggtggtgtgtgcctgtaattccaactactcagggggctgaggcaggggaatcacttcaacccgggaggcggaggttgtagtgagctgagatcatgccactgcactccagcctggtgacagagcaagactccatctccaaaaagaaaaaagagagagagagagagaaatcaacgatgcagaagaccagggagagaatagcaggaaaggaggccctgagcatgggagaggagtggggttgggccccacgtgggaggggtggtgttgacaagagcagggatttgtcatccgttgcagctgaagaggggatgtggaatttggtccagatgcacgtgggttaaggagcggagtgtttctggcctgtggcttctgtcttctcaatggagtgggagtgggagcgtcagctccaggggaattgctggagcccaggcacaggggcttcaggagagaggagaaagcatgtgacaggaatttgggaggtcagaaagaaaatgcccagcgtgatactttaggatttctgggcactgttcatatttgtagctatgaataaaaaataataccagttggccaggtgtggtggctcatgcctataatcccaaaattttgggaagttgaggcaggcagatcacttgagcccaggagttcaagaccagcctgagaacatggtgagaccctgtctctactgaaaatacaaaaaaaccagccaagcatggtggtgcacctgtagtcccagctactcaggaggctgaggtgggaggatcaactgagtcccagaggtcgaggctgcactgagccatgatcgcgccattgcaccccagcctatgcaacagaccaagaccatgtctcaaaaataataacgataataataccagttagatgtctatggatttctgtccagttgcattcagctgtttggctgccagccaaccactaagaaaataactaaaaaaactccagagttggtctggagatttgccaggtgagtttgtggaggggtggaggggtgagggctagagggtgtttgcatgggagtgttgagggagacttgagagtatcggggtggaatctaagctgggagagagatgaaaggacacaggcgtcactaggagcaagaatgtggaagccccaggtttggaggactccggtcaggtgaattgcaggaggggctgggtgctgaagtcagaggactgggaggctgggaggtgtggccggaatgggacgtgtgaagtcgaggatgcagagctattgtggttatagctcaaaagtcaagggttgaccctgggtgggaaatggctcttacaagaacgccgccctctggaggagaggggacggaagaacaccccgagtgtctggatgtccaagtggtatgacgagggcttccctcttgacattcatctcagcttggagccaggtggacatctctctagctgccaggactgtcactgccagctgaggtgacagtcatcgaagcaaggatatgcctacttagtgcaactccagtcagaagttccaatcatgggaaatgacacatcgaatttatgcacaggcttctcagagaggtttgctgcctaagccaacagcagaaatcactggaacaagtaacctggcacagggagggatggactcccttggcagggcccacgggccaccctccccaccagcatcaatcccctgccccctgggcccacctcacactcacactcacactcattccccttccctcctgcagccacagttggcttcccttacctgggtacttgatgttggccagatgagaaatgaagttgctgtaataagtgttttcagggtaattcttcacctgcagagaaacacagagcactgagcgtaagtgaagaagaggccccagcaccatcgctactaatccagccactcagctttctagcggattgggccgagcctagagagtaaggagaggcagcctgtgccgtcttgtgttttggcagagacagtctggctgttctttgctaccaaccacgcaggttcatgagtccttccagaaaggcattatctgaagtattttggcagcttccagggaaagaagcttgtcagtcattggtgatgccctcagaaatggccaactcttactctaaaaaagtcccctgtgcgcttgtttttgtttgtttgtttgtgagtttttttttttttttaagagtcttgctctcttccccaggctggagtgcagtggcataatctcggctcactgcaacctctgcctccagggttcaagcaattctcctgcctcagcctcccgagtagctgggattacaggtgcccaccaccacacctggctaatttttttgtatttttagtagagatggggtttcaccatgttggccaggtgggtctccaactcctgacctcaggtgatcggcccacctcggcctcccaaagtgctgggattacaggcgtgagccaccgcacctggtctgtgcacttgttttgggcagtgtcagccacagtcagattctttgtgatgaggagggcttgatctcacaagttcccttcttcatcctcaggacttccgacagagagccagatgtccaaggcagaacgactacaattcccccaacaccaggtcactctttctgaatgagtattgactttaacagtcagaaaagttgctttgggtgaaaaaggtctattttcaatggctcttttcagtcaagtggtgttgatctctttcactgtgcataaatttggctttcttggctttatgactgcatttgctatttgttttctagatgtctcgtgccttttttgttgcattggtccacctttactgccttcttttgtgttaagcaaatacttctcatttaccatttaatcatttttagttattttcttagtggttgctcaaatgattaccatatacaactcaatcacaatctatgtcaggttaatattaacttaatttcagtaaaatatagcaactttgcttcaaaagagctctatttcatcctcatccttctatttttgtcatatgcattatatctacatatattataagtcagtggtatagtcattgctttaaataatcttgatggtttttaaaaagaaattaaaagaagaaaacacaaaaaatatatgtatgtagtcttttctattctccatttccagtactcttcacttctttctgtggatcggagttaaccgtctggtattattttctttcagccagaaaagcatccttatatatgacttgtaagatagaccggctagcaattatactggttttcgtatatctgggaatgtgttgtttcaccttcatttttgaagggtggtttattggatatagaattcttgattgacagtcattccactgtgttctgatgacttgaaaagtcagccattaattgtactgtcattcccctacatataataaatcccttttctcttgctgctttcaacagtttgatttttgatgtatctagacttggggtttatttatcagacttggggtatttttagtttcttggattgataaatttatgtttttcctcagatttgaggcttttgggccattgttttgttttgtttcatgtttttcttccactttctctctctcctttccttctgggactcccattatatatatgtgtgtgtgtgtgtgtgtgtgtgtgtgtgtgtgtgtgtgtgtgtgttgctatacttgattttgtccccatgagtctgcaaggctgttcatttttcttctgtcttttttctctgtttttcagattggataatttcattgctctatcttcaaatgcactgattctttttttcttctgctgcctcagatctgctttgggcccatctagtgattctttttccattttgtttattgtacttttcaactctagactttccatttggtgcatctttaaagtttctatttctccattgagattccttttttgagtcattgtcatcatattttccttcaattctttgaacatagtttcctttcattcttcaaacatttatgatagttgttttttttttttaatttttctcccagccacagcattgatagttgttttaaagtcctgtctgcttaatcactctgggtccactcaggtcagtttctatagattgttttgagttattttttcctcctaaatatggattacattttcctatttctttgcatgcccgactttttttttttttttgagacggagtctcgctctgtcatccaggctggagtgtagtggcattatcttggctcactgcagcctctgcctcttgggttcgagtagttctcctgcctcagcctcctaagtagctgggattacaggcgtgcgtcaccacgcctggctacttttgtatttttagtagagatggggtttccccatgttggtcaggctggtcttgaattcctgacctcaggtgatccatctgcctcagcctcccaaagtgctgggattacaggcatgagccatcgcgcccagctttttttttttttttttttgagatagaatctagctttattgcccacgctggagtgcagtagcacgatctcggctcactgcaacctccacctcccgggttcaagtgattctcctgcctcagcctcccaagtagctggaattacaggcgcctgccaccatgcccagctaatttttgtatttgtagtagagatggggtcttgccatgttggtcagcctggtcttgaactcctgaccccaagtgatccatccaccttggcctcccaaagtgctaggattacagatgtgagccaccacgcccggccccaccatctagactttcttagaaatgcagaggtgttgactgggcctggtggctcatgcctgtaatcccagcactttgggaggctgaggtagggggatcacctgaggtcaggagttcacaaccagcctggtcaacatagtgaaacccgtctctactaaaaatacaaaaattagccagacgtggtggcaggtgcctgtaatcccagctacttgggaggctgaggcaggagaatcatttgaacctgggaggtggagattgcagtgagccgagattgtgccactgcactccaacctgggtgacaagagtgaaacttcgtctcaaaaaaaaaaaaaaaaggaaatgcagaggtgttgcctttgtctgactgagttgcaggtttccccttgcccttcgaacaatttgtgtctacgcaacccctctgggattccagctcttttaagtcagcttgtccacgttaaccaaggtccggagattgacagcacggaaggagcacagtgatcttccatcgagtcaatgtttccaagaactgtgagctcaggaaaagatgaagagtgataataaagaagactgttcaactagacttcacaccttgtttggacatcaacctataacttcaaatacagacacacatgggtagtttctgcttacctcaacgaaggctgccagtacagccaaaccatccggcgcatcttgggctatatcatagctcttgtatttagaattgtagtgaacaatgtgaatctgtaagagcaaggtagagtgggtcaagggcagttcatagaaattcaaatgcttaagatttccagggaaggaggaagagaaagaaaggtgctccgtctgaggcctcagactgttccacacaagcaacttggacctccatctctctccatctgggctgcaattcctatctatcaagagcagaaacttccccaagaatggaaagagcaagagtgggattctggaagatggcagttcgaggccatttcccgaccacacctccctccaggcagacaagctggcagagtctgaagggatcacatgaggacagtgggttctcctggagtgtctgggggctttgcagggagagtgagcttgcgccccttgtcccaggcaaccattgttaacatgtagtcatcctatggatggattctggcaaaagaggtaactcagaaaatctaacacagtccaggcacagtggctcatgcctgtaatcccagcactttgggaggccgaggcgggtggatcacttgaggtcaggagtttgagaccagcctgaccaacatggcgaaaccccgtctctactaaaagtacaaaaattagccggccatggtggcaggtgcctgtaatcccagcttctcgggtgggtgaggcaggagaatcatttgaacccagggaacggaggttgcagtgagccaagatcatgccacttcactccagcctgggcaaaagagcaaaactctgtctcaagaaacaaaaaaaaagaaaatctaacacatagaaatccagctgaaacaaaggagggcttgccacaccctgtgggctgtgaagtcctgccaacctgagtcctgtgagggcaggaccttgcctgaacccctgtcacaaagtggtgatctgtcaatagttgctgagtgaataaaaaataaactcaacttcagcatgacttaactgctaccatcgcacagtcttttggctgtttttgtttgtttgttttgttgctcagactggagtgcagcggcatgatcaggacttactgcagcctcagcctgctggcctcaagcgatcctcccacctcagcctcctcagaagctggaactataggcgtgtaccaccactcctggctaatttttttttttttttttttttttgtagacacaagatctcgctacattgcccaggctgatctacaactcctgggctcaagcaattcccctgccttggcctcccaaagtgatggaattacaggcgtgagccagtgcacctggccttggctattttaataagaaaagtgacggctgggcactgtggctcacgcctataatcccagcactttgggaggccaaggcgggtggatcacctgaagtcaagagttcgagaccagcctggccaaaatggtgaaatcccgtctctactaaaaatacaaaacttagtagggcatggtggcgggtgcctgtaatcccatttactcgggagactaaggcaggagaattgcttgaacccagaaggcggaggttgcagtgagctgagattgtgccactgcactccagccggggcaacagagcgagactctgtctcaaaataaataaataaaaagaaaagtgactatggggttcaaaggaaagaggacacagtgggggtcctcaggtacctcgatcacatgtctgatcccgtccacggtgtgctcagagccgctgatctccgaggacgcacctccccagtgaaagtgcatctgctgggctatgtatacagtgccgtcagccactgtcatgcgcatggtggagggcaggctgatctgcactggagagacaaggtggggctgagagcagagtaggtgaacacagaggggtcaggcctacaggctgggtagcttctctgctcacctcccacctgtctgagcccagggcaagccaataccatagactggcttagaatgccatgggcagggtcaccaaaggagaagaggcgtttgcgcacagggcacagggtgaggtcaggatggaggccaggcactaagtaaaccaggctgggcaagtgcctctccccagcacgctccttcccgcccagaaccaacaggccagaggcaggaccacacagtggcaggtccagcttgctggccccagggaaagggaaggtcctgaaaaattatggccaatgggcttggaaactagaattctactctctatctctggccaagtttggaatttgccgaaggtataagaataggaagtggggcctcttagaactgttttcttttctttgttttttttcatgctcactctgttgctcaggctggagtgcagtggcaccacgatgacttgctgcagcaactcactgcagcctccaactcctggcttcaagggatcctatcacctcagcctcccgagtagctggaactacaggtgcccgccaccatgcctggctaatttttgtgtttttagtagagacagtgtttcaccatattggttacgctggtctcgaactcctgacctcaagtgatccacctgcctcagcctcccaaagtgttgggattacaggcatgagccaccacgcccagctgaaatctctgccttttggaatgaactacacaaaaagaaaaaaacgggctcagttactaagaaaagtgactaagaaaaatatctatgaggatataatttcggcgttggaaaggcagcatgtgtctcatgagcaagatcttcctatttatttattttgagacagagtcttactctgtcacccaggctggagtgcagtggcatgatctaggctcactgcaacctccgcctcctgggttcaagcaattctcctgcctcagcctccccagtagctgggattacaggcatatgccaccatgcccggctaatttttgtatttttagtagagacagggtttcaccatattggccaggctggtctcgaactcctgacctcaagtgatccaacctcctcagcctcccagagtgctgggattataggcgcgagccactgcgcctggcaagatcttcctatttaaagtcatcaatggtggctgtaaacaagaacattttcttaaaagatagcaaatatgaggtatttaaaacctgtcacgtgccccctctttctttccaaattgtctaaaggagcggggagctatgattaaattcataacgtaatgtgctataatgcagtaatccggcctgaaaggttttcaccggctgtttggcagaacaaatgctctgtatttagagcttgagatgtagctggcctcaaaaatcaatgcttgcaagaaaaggacggaagggccttaaaaggaggcgtggaagggccttaaaaggaggcgtgcaaggtcagtgatgctgaaagcagacgggagccgaggagctgaggacccgagcagagctccctaaatggacagtaagcaccacaggagaaatgagagaggtcctcacaatttccccaaaacacagctcccgggagacggaatgtgttacttctggttacactgacaggcccacacaggcccaattggaaaagagccacaaccctgagcctgttactgtgctttttaaaaaagattttaattgaggcagggtcttactctgtcacccagcctggagtgcagtggcatgacctcagctcactgcagcctcgacctcccaggctcaaacaatcctcctgcctcagcccctcaagtagcagggactacaggcacacaccaccatgtccagctaatttttaagtttatttgtagagacagaatttcaccatgttgcccaggctggtctgaaactcctgggctcaagcaatccacctgccttggcctctcaaagtgctgggattataggtgagccacggcacctgggcaatatatattaatggatcagtgccggcacctgggcaatatatattaatggatcagtgccggcccaccaactgttactagtctgcaccaaaacagagaaattgggagttcattttagaaattttgtagcaacttgtctttgtttcaacagcctgtgtttcaatttgaatttctctttattgaaatgttgaatctaatttaaatttaattttaaaatgaggaggccaggcccggcagctcacacctgtaatcctagcaatttaggaggccaaggcaggcagatcacctgaggtcaggggttcaagaccaacctagccaacatggcgaaacctcgtctctactaaaaatacaaaaataacccaaaaatatggacaaaatctatataaggaaaatcacaaaactaatgaaataaatcaggaagaactaaataagtggagaaatattccatgttcacagataggaagacttaatactatctcaatgtcaattatttccaacttggtctatatgttaccaaaaaccggtcccaatccagaccccaagagagggttcttggatctcacacaagaaagaatttggggtgagtccacagaataaagtgaaagcaagtttattaagaaaataaaggaataggccaggcgcagtgcctcacacctgtaatcccagcactttgggaggccgaagcaggcagatcacttgaggtcaggagttcaagaccagcctggccgacatggcgaaaccccgtctttactaaaattataaaacttaatggagcatggtggtgcatgcctgtaaacccagctacttgggaggctgaggcacgagaatcacttgaaccaggaggcagaggttgcagggagccaaggtagcaccactgcactccagcctcagagcaagattctgtctccaaaaaaaaaaaaaaacggaagtagtggaataaagaatggctgctccacaggcagagcagccccaagggcagctggttgcccgtttttatggttatgtcttaattatatgctaaacaaggggtgtattattcatgcctcccctttttagaccacatagggtaacttcctgacgttgccatgtcatatgtaaactgtcatagcactagtgggactgtagcagtgaggacaactggaggtcactctcgtggccatcttgattttggtaggatttgtcaggcttctttactgcaacctgttttatcagcaagctttatgacctgtatcttgtgccaacctcctatctcatcctgtgactgagaatgccttaacctcctgggagtgcagtccagtaggtctcaaccttatcttacccaccccctattcaagatggggtcactctggttcaaacgcctctgacattactatacgatcaagcaagctcttggtaattacccacatggactgaaaacacacaaacctacacatggaattgattgattgattgattgactgattgattgattgattgagagaaggtcttgctctgtcacccaggctggagtgcagtggtgcaatcatagctcactgcagccttgacctcccaagctgctcaagtgagcctcgcacctcaacctcctatgtagccaggactgtatgtttgagccaccatgccaggctaatttttttattactttcgtaggtctcactacattgcccaggctggtctcaaattcctgggttcaagtgatcctcccaccttggcctcccaaagtgctggggttacaggcatgagccaccatgcctggcctgcatatgggttttataacagctttattcataactgccaaaactgagaagcagcccggatgtctttggataggtgaatggataaactggttcatccaggcaatagaatattcagcactgaaaagaaatgagctatcaagccatgaaaagacatggaggaaacttaaatgcatattgctaagtgaaagaagccaatgtgaaaaggctacatgctgtgtgattccaaccatatgacattttggaagaggaaaaactataggtcaaataaaaagatcagtgattgccagggtttaggaaggaagggaaagatgaacaggtggaacacaggattttcatgacactgaaatgattgctcgatacatgtgattagaaacctttcaaaacctgactgggcatggtggctcatgcctgtaatcccagcactttgggaggccgaagtgggcggatgacttgaggtcaggagtttgagaccagcctggccaacatggtgacaccctgtctgtactagaaatacaaaaattagccaggcgtggtggcacatgcctgtaatcccagctactgaggaggctgaggcaggagaattgattgaacccgggaggcggaggttgcagtgagccgagatcgcgccaccgcactccagcctgggctacagggcacgacttcgtctcaaataaaagaaccttgcaaaaccaaaaattaacaaatctttaatacgtcatgtcaactttactgttaagcttagtgttcatcaaaatctcattagattcaaagtttgtagattagctttttttcccccttcagtagaattcctgaatgtgcttggagcttgctgaaaagtagccaatggcaatagccaaataacttcaaaagctaaattataaaaatctttcaaaatactttatatcaggctgggcacggtggcttatgcatataatctcaacactttgggaggccaaggtgggcggatcacttgaggtcaggagttcgagaccagccaggccaacatgctgaaaccccatctctacaaaaaatacaaaaattagctgggggtggtggtgtgcgcctgtagtcccatctactcaggaggctgaggcatgagaattgcttgaccctaggaggcagaggttgcagtgagccaagatcatgccactgcattccagcctgggtgacagagtgagactccatctcagaaaaaaaccctttacatcgaaaaatggaattatggccagccttggtggctcgtgcctgtaatcctagcactttgggaggccaaggtgggcagagcacttgaggcaaggagttcgagaccagactggccagtatgacaaaaccgcatctctactaaaaatacaaaaattagctgggcgtggtggcacatgcctgtagtcccaggtaccagggaagctgaggcaggagaattgcttgaatctgggaagtggaggtttcagtgagccaagattgcaccactgcactccagccggggtgacagagcaagactccatctcaaaaaaaaaaattgtttttaatatatatataattaatgtgaactttgggtccactctaatgtccgacatgctgtcgtgtgaggtgagaaccccaaaggaacaggcttccggaccacagaaatttgagcagagccctaaaggaagaaggtacagggtcctctggaaattgggaggcgggagccgctgcaagccccttgggaagctgggctcttctcttccatatgccttccctcttctgggccctcagcacgaagcccgcactcagcaagcgttgcccatagagatcctccatcaatgattgcttcccaccagctgtccagggagggtgaacaaagccactgcctttggcctttgtgcttcgccccttctccacaaggagaggacaaggaggggaggaagagttccgcctgccaatctggaagcatcagagagtaactttggaaacaagagctcgacattatgatgaaaatgaggcttttgttcattctttgtgtatttcagggctcctggccacataaacctgagtccttttacagacagagcttcattctccaatttgctactttcaccaaccctataaaggacaattggttttctttctttctttttttttttttctttgagatggagttttgctcttgttgcccaggctggggtgcaatggcacgatcttggctcactgcaacctctgcctcctgagttcaagtgattctcctgcctcagcctcccgagtagctgggattacaggcatgcgccaccacgcccaaccaatttttgtgtttttagtagagacaaggtttcaccatgttggccaggctagtctcgaactcctgacctcaggtgatctgcctgcctcgggctcccaaagtgctgggattacaggcatgaaccacctcaccaggctggttttattttcttgattgtgcaagataagaacactaagtcctgtgacccttttatttttttattttaaagaaacggtctcgctctgttgcccagggtggagtacagtggtaatctcggctcaccacaaccttgacctcccaggctcaagtgatcctcccacctcagcctcccgagtagctgggactacaggcactcaccaccactcctggctaatgttttgattttttgtagagatgaagtctcaccaagttgcccaggttggtctcaaactctggcatcaagtgatcctcccacctcagcctcctaaagtactgggtttacaggcatgagccaccatgcctggccaagtccagtgactgtcctatcgctgtgtggcaggcagggatgtatctcaacccaagcaggagtgagagagtgcagaacctaaggaggatgtggccaagaaacctgacaactgggggtgtgagcccatcttggccattagacagtgtgtggccttgggtgagtccctcgacctcctgaggcctcagacttcctgcctaaaaaatgccccctcctggggtggtcatgaggctcagaggagtcgagccaacttggaaaatcaggaggatattctgcacaagtaaagcacagatttcacagtttccaggccgggcatggtggctcgtgcctgtaatcccagcactttggggaggctaaggtgggcagataacttgaggtcaggagttccagaccagcctggccaacatggtgaaacctcgtctctactaaaaatacaaaaaaaattagctgggcatggtggtgcatgcctgtaatcccagctactcaggaggctgaggcaggagaatcgcttgaacccaggaggtggaggttgcagtgagctgagatcctgccactgcactccagcctgggcaacagagtgagactctgtctcaaaaaaataaacaaaatttacagtttctcatatcggattcctgaagtggggcatccccacggccctgctttttctgtctgaccttcaccttctttcttgtagggatcagaaagccagagctttcttcttaaaactctgagaaaccctggtcctacctgtcaggtgctttgagctgaatagactcaatataggaaatgtggaaaagctgacccaaggtgatggacagaaagcccccgtgggaagggtggcttcagcagcacggcctgtcctgcctgtcacctgctgggtgggttgggtgagctcgggtaagaggataacgctgcaggaagggaccagcagggagttgagtcgaaagatggatgctgccctctctggaagagccactaggtttcggggccagtcagccctcatgttcgaccctcatgttcgaggcctccagctctgaggccgtgctctgtgtctctgtgcaagccattcctggcagggacacgtgtaacctgccttcccctgcaggctgcccatggactggagcccctcaccaccccttcctcttacctgtgtggccattgttgaccatggggaactcccctgcctgggtctcatagcctgtcatattgagccccttcaaggaggggttgtaccgcaccttcgtcctctgtaggttgataggcgactgtctctggcccccacaggcggggtagtgctgtggccagtgcgcttcgtccagtgccccttctaagacaggaaagacacagttcaaggggctgcctggctgcgcccactctggaggaacctcaccaggccagaggccagaggccagggcctgctgggcggggacccacggaggcaccttccagaaagcagaagcaggtcccccagaaggaggccaaaaagacaacgaggtcaactccaaggactctggtgtttggggggctttggtgctaacctctaactttcctgtggcaactgctggccctgggagcaagacagtgttttgaaatcaatggaagtcttttttttttttttttgagacagggtctcgctgtgtcacccaggttggagtgcagtggtgcaatcttggctcactgcaacctctgcctcccagattcaagagattatccggcatcagcctccggagtagctgggattacaggcatgcaccaccacgcctggctaatttttgtatttttagtagagacggggtttcaccatgttggccaggctgatctctaactcctgacctcaggtgatccacccaccttggcctcccaaagtgctgggattacaggcgtgagccaccgtgcccggcctgagagtgttttatacgtaaatttttgctctcgtttgacttatttccagctggtgaatgcatggagggatccttggctttgctcttcctgtgctgctcctggggcctcttcctcatttcctcccaagggcccagttgtccttccatgcccccaacaggaacacagcccccacctccccatgctgcaggaaccccccaccactattttcttgctccagccccttttatggattcccgtatggtaaagaccatctaggtgtctacacttatggattcagggaaactaaggaagcatcaggttccaggacaacctagaatgagtacttttttaaaattcataaggagaaagtttatcttttcagagagggttgataatcgtaggggacagagtaacataggtgagtgattatcatggtgacttggctcccatacagctgtggagcttggagtcagccatgtgacatggagaatcccacctctgttccctgttcgggggtagctgtgtggtgagtacacagcttgttttaagacaggtgtttgtggctgggcacggtggctcatgcctgtaatcccaacactttgggaggccgaggcgggtggatcacctaaggttgggagctcgagacccaccctgacaaacctggagaaactccatctctactaaaaataaaaaacaatcagccgggcatggtggcacatgccgttaatcccagctacttgagaggctaaggcaggagaatcacttgaacccaggaggcagaggttgcggtgagccgagatcgcgccactgcactccagcctgggcaacgagagtgaaactctcaaaaaaaaaaaaaaaggtgtctgtactagggccctcaccgctttttggtttgtaatcaaggcaattggcctggagcacaacgccttctcagagcaagatgctttggcccagggcactgtcaatactggaacatctctcaggtttccctggaaggcatttacaaaagctactctcaagttctcctggagcccctagtagtttcccaggaagcccactgtctcagaggctgggcagagcctgggaaggacaaggacttcattgtctgaattctctcttccttcacctctgaaccacctgcctgcactgcttggccaagtgaagcagaatgccccaggcttccgaggcactgccatgtgtaagatcactgtcctcaggaacagagcggttgttcagagctggctggactttctgaacctcccaggatgtccctaattccgttgcccttgacttaacagatcatcccgttcaccctgaaggaatgcttccggagcagctgaactggggcagactctgcaggaagcagatgtttgtctcacttcctgcatcagccagcggccaccagcctcctcatgggccccaatccatggtcccgtatggaaagaagggggatgcgggaagaagctctcctcactgcccctggaaagggctgtttagtgtccacaaagtccacagacacggccttctagctttggctcacatgtggaccagaacccatgttgaatgccaggattttacatttcacattttaaaagtctggtttggggcctggcgcggtggctcacgcctgtaatcccagcactttgggaggctaaggtgggcggatcacttgaggtcagaagtttgagaacagcctggccaacgtggtaaaaccccatctccactaaaaatacaaaagttagccaggcatggtgatgagtgcctgtaatcccagctacttgggaggctaagacatgagaatcgcttgaaaccaggaggcagaggttgcagtaagccgagatggcaccactgaactccagcctgggcaacagagcaagactctgtctcaaaaaaaaaaaaaaaacaaaaaaaaaaacacctctcattttggcagcccacagatcaaagggaactgggtccttatgtcaagatgttctgggtaaactgcctaccatgaaatttccaagaaagaaggtctcgcaaaccccacagcaccttccgtgaggttaccgagagtcttttctaagaactttgttttccacttacacggaccaacaaagcaaatggttttacaaatagaagcagtgagtgtgcttttgaaccagccaacactgtggatggaaaaaaatttaaagcaaaaagcctgtaagtaaatcaggagtttgtgaaggggaaagctatttccttcttttccttatttgaagtttaagttcagcttattctccataccttctgagacactgaaaaggtaacatctgaagccacaatgagcagacccccaacatatggcaagtgggctgcctggccatcctgtgaaatgccctaaaggaggactcttggccgggcgcaatggctcatgcctgtaatcccagcactttgggagatgggcagatcacctaaggtcaggagttcgagaccagcctggacaacatggtgaaaccctgtctctactaaaaatacaaaaattagccaggcatggtggcaggcacctgtaatcccaggtactcgggaggctaaggcagcagaatcacttgaacccgggaggcggaggttgcagtgagccaacatcacactactgtactcaagcctgggcaacagagcaagactttgtctaaaaaaaaaaaaaagaagaagaagaagggcacttgtcctgttgtaagggtgtgagggtaactgggggagcatgcagaagctaggggctcacctgagtaggtccagtcagacacatgctgggcctggccacccagcaggaacagggacagcagaagcaccagggccctcatggtgctgcacatctgtaatgaagactgattccggcgaagctcttcttttaaaggctcagaaactgtaaataacaatttacaattgatctgcccagctggctaaaccaccctttgctgcacccactaaaacaataacaccctccccataacagcacttctggctccgtgcattgcgccaggcagccccagcacctgcctgatctcctcccacgtcaatttcatatccggtcagtccatgggtttggttgttcagtgtcttaggaacacctgaagagccacacagtgcagccattgtggacaggtgaccgcggaaatgggaaaaggcccaaggcagggagaagcaggatgaaagactttcctggacgtcggacttcccatgctctttctcctgacattagagatctggggactgctgatgggatcaccactgcctgcaaaccctgcccatctcagtcatggacacaagccaccgctgcagacatgtggctgccctcagccaggcatccagggaggtggcctggcctccatgtttggacatttcacggtcctctccttaaaccagtggttgatcctgggtcccagctcatgagccacattccaatgtgtgcctttatgccattcaagctggtgtgggcgtctgcatttctacatggatttgttctgacacctgcagggctcttgggcacacctaagccaatcagccaattgccctcgcaggatccatggattacctaatcctgtgtattcacttggctagacagtccctgaaattagctgaaggagaaacttttgagtttatgcctgctgacaggccagcatttcccatgcccttccacaaggtcaaacacaaagggtagccggagctcctgcgggggggctaccatgctgccggacacaaagggccacccctgccttgttatggggagctgaaccccctcctggcctagcttaactcattgtccacttggtcctggaatggcaaacgtcagcaggccttcacaacaaggatgttagcggtgaacgtaggcctcccgaatacttctaagactccccactgtcatttaatagggaacatcagctgctgcaaagaacttgctggaaacttccatttctaaagctcaagagctgaaagaatctcagagagagagcaaagcatgttcaaggacaaggattctgaaactagacaggatctgtgccacctgctaactgtgtgaccatgggcaactcagcgctctgtgcctcagctttccttccttttcttttttctctttctttcttcctttctctctttcttttctttctctctttctctctttctttcttttttgagacagggtctctctctgtcaccaggctggagtgcaatgatacgatttcagctcacttctcttggactcaagcaatcctcctgcctcagcttcccaagtagctgggaccacagtcgcatgccactacgccctgctaatttttgtactttttgtagatacaggttttcaccatgttgcttaggctggcctcaaactcctggactcaagcgattctcccgcctcgtgctcccaaagtgctgggattacaggcgtgagccgccgcacctggccgcctcctttctttaaaaggagttagtgatagcacctcctttgtggggattcggcaataaatgtgcctgcagtagttggagcagtgcctggtgtgtagcaaatggcattagcatctattcagacccctcattttataggaaaaggaagtgatttatcattgccacccagctggttagtgagggaactggaggaaaaatgcttcaatctccagcttatggaccatttctttgcaaaaatgagaaacctactcttctgtccttgctaaaccagtgacgcccacctgctgactcccagccctgcggaaagggccaccttgtaaatcacaaggccccacctctgctgaggagaccaagaccctttacaagcccaggcaggacccctgacatcaaactggcaggaaaacacaaactcagtcatctgaattttttcttgggaatctgaattgggagacccagaaagaatcagggagctgcaggcaggcagagactaaaatgtcaggctgtcacggaagcctgggaggactggatgagcccaggcgaggggaactggagcaggaaggagctcagagaaagcctgggccaagggggaggggaagactgcccaaagaggggccctggagagtcagagagaggagtgcttgcgggagagcacagtgaaatgcagagggcccaccactcctggcagctcccagccccacgggtctcactgccctgcggtgagcatttggggcttcccaggagagctctggggcgttccttgcctcacacagctccttaaaatacagtgcacatactgcgtctgtgaagctgtgatgccagcagcccctctgcagaactgctgtgcagcgtatccacccatcacatctgaagctttgccctggttttgcctttcgctcaggcaagagcctggactggccagcaacctgttgacctggctggtgttgagaattggtgtgaaagtgagtaattaaggcaatacgggggtcagatcagatgatggcctcttggagaagcaaggccatctgccaacgagggcatatttctagagagagggtcccctccctccgctgtacagcacactgccaaggacatactggacccagaatcaggtgtggtcagtagtgttgcctattttctgactccttgtctacttcaaacctgaaattttccgtcacctttgaacatgagtcttcttcttggatttgggaggcacattgtttgtttgggtttgcttttgttggtggtggtggcagtgggtttttgttgttgttgtttttggtttttggtttcttttttgagacagggtctcactctgttgcccaggctggagtgcagtggtgcaatcatggctcactgcagcctcccagtgctcaggtgatcctcccgcctcagcacccccttccgcctcatcccctccaagtagctgggacaacaggtgcgtgccctatgtgtgctctgtttttgttgcttttatttttagtgtgtctctctatgctatgagcttccttctgccttcatccaaccatatccttggctgatcaaggttgtttttttaattctaaactcctatttttctagggtctatggttggattggctgtcggagatgagttgacaagtttatcattattacaacatcaggtcaaagggagaaaggagcctttgttcttccttgcttctaccactgcccccccgacaaggcccactgaggcaaggaaaaagaaggaggcagggaggcatggccagcccaggtgggcaagaaggcaccatcagcccaggtgagcagggacagatcatgaaccaaatgactagggaggcaccgttagcccaggctgcacaggaccagcataaaagaatgagtctggcaggccaggcacggtggctcacacctgtaatcccagcacttggggaggccgaggtgggtggatcacctgatgtcaggagttcaagaccagcctgggcaacatggtgaaaccccgtctctactaaaaatacaaaaattagccaggcatagtggtgcgtgcctgtaattccagctacttgggaggccgagccatgagaatcacttgaacccaggaggcagaggttgcagcgaactgagatcacgccactgcactccagcctgggcaacagaacgagactctgtctcaaaaacaacaacaaaaacaaacaaaaaacaaacaaaaaagaaagagtctgcctacacaagaatatgcttatttgggtgtaagtaacacagaaaggctattgttctgtttcatgcaggagtgtgagctcatcctgaagaatgagtcactctgaacaagtaagttctagatggttacaggctcaatcctatgtaagcaccaagatgtttaaaacctctaaaatgtacggtacagttttaaaaagataaagctgaattttattaaacttttcttaatgactgagtcccactaatatgaacatcaattattctcctgcattgtaatatattgatgtctgctgggcctataacatataacatatatatataattctccctgcaagaaacgacccctggccaggcacagtggctcacacctataatcccagcactttgggaggccaagggggatggatcacctgaggtcaggagttcgagcccagcttggccaacatggtgaaaccccgtctcttctgaaaatacaaaagtagccaggcatggtggcatgtgcctgtgatcccagctactcgggaggctcaagagggagactccatcgtctcaaaaaaaaaaagaaagaaaggaaagaaatgacccctaactgtagtttttggatttcttttaccagatactgagagaggaaagttagctagcttaattgattactaaagcaatgcacgtttatgctcaggggtatccataaggctgggacataaccaatcaggacagaagccagacttggtgtggaggaaagtctgaaagctccctgctctgccaggagttaaccctggattggtggattgtagggagattgggaagttcttgggaagggctgagcggcaggagcagctggaggtaccattgtgtgtgtattgattttgtttttcattgttttttcattgttagcatttctttctttttttcttttcttttttttttttttttttttgagatgaagcttcactcttgttgcccaggctggagtgcaatggcgtgatctcggctcactgcaacctccaccacccgggttcaagtgactctccggcctcagcctcccaagtagctgggattacaggcgcccaccaccatgcctggctaatttttgtatttttagtagagacggggtttcaccatgttggtcaggctggtcttgaattcctgacctgaggtgatccgcctgccttggcctcccaaagtgctgagattacaggtgtgagccaccgcgcctggcccactattagcatttctaacatgggcttccagctcttgcctcttagggttgtctgtctgttctcatctcctggcttcctcatctgtttggcagaaaccagatgaccacacttcttaaaattacatgtccaagaagaatggatagagctaagccaacagcccagagactgtcctctacctaaaatacacacactctgaaatgccttcggcattttgatgctaaactcacagatttctatttcctttctgactttcagctatatccatataaatggagcattgacaagtcattgtgtaaactaacccactcgcaaaatatccagctacagtcaggtccaactccacgggggggcccttgctttctctcactagcctcctggtgatgagttccccagtcttagagagtatctccagcctcacacatcctcctggaattcagcacctgttgggtagggttgtctcccaacaggcatctcctcctgtgtctctatcctcttccccactgggtaccagtaacccacatccaaaagcaatcagcccaaaaccctagtggaaatcctcttttctatcattaatttaggtataagcaaaataggaaccaaatacctaaaaatatttacagctcagcctgccatcatcctgtgccccttctctgtgcaaactcaccatcctcctgccacgagaattggatgttctgtttgtatctcttgctggctctaccttctacttcttgtagaagtagagttctgtgttctgtgtcttttatgtggcagaagccgggaagtcttccgtgggctttgctcaaatgggagggtaaaattccctactaggagtgttgcatctgtatatgcctgggattggccagagtgactccatcttggttattatccatgagtcttgcttatatctcttcagtgtgctccacccctagtaggccagagtcttgcttatatctcttcagtatgctccacccctagtttacatctgcatggcaggtttgtatgcctttcagctccacccttccctggtcaataagcaggtcaaatccacccttcctgatcaaatgcataatgagtcgtcaccctcccctcatgcctaagggaccgattatgcaagcagaggattgtattagtttcccactgctgtaacaaactgccaaaaactcagtgcttaaaacaacacaagttcattatcttacagatctaaaggtcagaaattcaaaaccagtttcactgggctaaagtcaaggtatgggcaggggtggctccttcagaggctctgaggggatcatcggttcccttgcatttttcagctcctagtggccacctgcattccttggctcgtggcttcttccttgaatcactccaatctcttgcttcctttgtagtttgcttagtccttagtgcagctaggtccgagttcttgctctacgaccaagaagaataaggcacacagacagtggagagtgagtagaatagaacaggatttattaaacaaaaggaaaactctcagcaaagagaggggtcctgaaagcgaggcagaaatttaaaaataacaatcataataataagtactgcacttattcaccccaagaaaagtaaaagctaaggcccagaatgtggcaaggcaaggtttcaaaagaaaaagaaaaggacaagttttcctctgcttagcaagctcatttcaaggactgttaacaacgctgtcggaatagccaaggccaaaggaatgggctccagacactcccctgcttccagagcaaggttgagggggaaaaaagagagaaagacagattattttactgttactcttttctcagtcttcttaagcattattatgttttacaaatgtctgtatttagccagctcttgtttttctttcgatgcagctgcaaggccaccagctatgtaaggtcacaaattatgttatgctatagattacgtgacctgtcactgtatgattaactgcttttgttttgcttctgtaaggccacttataaaaaccccactctgtctttgttcaatgctcagctttttggatgtgagtccactgagccagtgcataccgaaaataaacaatcctcctgtttctctcatattggtctctccattcctcagtttattgcaacaaaagcaagttgccagaaacagggctgagttctgtgtcttttatgccgcagaagccaggaagtcttttgtgggctttgctcaaatgggagggtaaaattccctcctaggagtgttgcatctgtatacgcctggggttggccagagtgactccatcttggttattatccatgagtgcctaaacaaaacccaccagggggctaaaaccacaatgctaatgttatgttaatgacattataatgagctgggtcaagtgaaggacatttaggttgatttattgcacctgcgccttggttgggacagtcacttttgagcaacatcctggcacaaggggaaattcttaaccacatttcttccctttagctgttcttcagttgtttctgtgaacattgtcccactctgtccttctccagagaccctccctctctatctgcctaaccagctgctaactgccccctccctcacttcctcctttgatcttcttgacctccctcatattacggtccttgtgattacatttagggtctacccagataatccaggatgatgagatgagacttagtcacatatgcaagtcccctttgccgtgtaatgtaacatacacaggttccaggggattaggatgtggacattttggggggggtcattattcagcctaccacaaagatattgggaattaccaagataaattaaaccatgagttgctgaaaattggatttagacttcagagaacggagtaataactcagcaatgtcatgaaatataccaggaatgaagagtcatagaggagccaaatgaacaagggctagcctgtccaaagaatgtactattgccaggacattttttctgagctcttaatggtcacagtgatatgactagagtcagctgactagactggaaaagtcctggtaacctgcaaaacagtaaagagagaagcagggtcaaacacccagtgtgagccgggctcgctggctcacgcctgtaatcctaccactttgggagtctgaggctggtggatcacttgagctcaggagttaaagaccagcctgggcaacatggtaaaaacccatctctacaaaaaatacaaaaattagccaggtggagctgggcacggtggctcacacctgtaatctcagcactctgagaggccgaggcaggcagatcatgagatcaggagttcgagaccatcctggccaatatggtgaaaccctgtctctactaaaaatacaaaaattagctgggcctggcggcacatgcctgtagtcccatctactcgggaggctgaggcagaagaatcacttgaacccaggagtggaggttgcagtaagccaacatcatgccactgcactctagcctgggtaacagagcaagactccgtctcaaaaacaaacaaacaaacaaacaaacaaaacaagccagttgtggtcgtttgcacctgtagtcccagctacttgtggggctgaggtgggacaatcgcttgagcccaggaggcggaggttgcagtgagctgagatcacgtgactgcactccagcctgggcaccagagtgagaccctgtctcaaaaaaaaaaaagaccgtgctcagaccagcactccttgaatgtggcctccctcacccaagatacaagagtcaacttttggctgaatcacagtttggcatgaagagggaagctccacatcagaaatatacagtcttgtggccgggcgcagtggctcaggcctgtaatcccagcactttgggaggctgaggcggacaaatcacctgaggtcaggagttcgagactagcctggccaaagtggtgaaaccccatctccactgaaaataaaaaaattagccaggcgcatgtctgtaatcccggctactcaggaggctaaggcagtagaatcactggaacctgggagggagaggttgcagtgagccaagatcacaccactgcactccagcctgggcaacagagtgagactccatctcgaaaaagaaaagaaaagaaaaaaaaaatatgcagtcttttacttagtgtccacacaaacttctatcatatttttttcttctatttatttatttatttatttatttatttttgagacagagcctcacactgtcaccagggctggagtgcagtggcgcgatcttggctcactgcaacctccacctcctgggttcaagcgattctcctgcctcagcctcccaaataactgggattacaggcactcgccaccacgcctggctaattttttgtatttttagtagagacaggctttcactatgtttgcgaggctggtctcgaactcctgacctcgttatccacccgcctcagcctcccaaagtgctgggattacaggtgtgagccactgtacctggccccatacttttttttcttagagtcttactctgtcacacaggctggagtgcagtggtatgatcaaagctcactgcagcctcaaaatctcaagttcaagtgatccttctgcctcagcctcccaagtagctggaactacaggtttgcaccaccatccccaactaatttttaattttttgtagaaatggggtctcaccatgctacccagtctggttccaaactcctgagatcaagtgatcatcctgccttggtctcccaaagtgctgggattacaggcatgagccactgcacccagcaaactttcacatattgatctaaaaataaaagagatgtaatagggagagagactctgtttcaaaaaaaaaaaagtcaatatacaaaatacaattgtatttctgcaaaacagcaacaattagaaaatgaaatgtaaagtttttttgattttaaaaattataccattacaagaactctgcatggtctttgtaacttttctgtaaatctaaaactatactaaaattaagtttctctttaaaaacttctaccactttacaatgtcatcagaaaatatcagacacccatgaataactctaataaaagattattactattttagacagggtctcactctgttgcccaggctggaatacagtggcatgatctcagctcactgtagcctctacttcctgggctcaagcaatcctcctgcctcagcctcctgagaagctgggattatagtcatgcatcaccacacccagctaattttttttgcactttttgtacagatgggtttttgtcatgtaacccagactggtctggaactcctgagctcgagtgatctgccttgtctcatcttcccaaagtgtgaaattacaggtgtgagccaccacacctggccaaagattactgagagaaattcaatacctgaataaacgagggaattggcaagaatttttttcttcagtctctgtgctactagaatttcttttttttttttttttttttttttaagaatttcttggtcgagcacagtggctcatgcttgtaatcccagcacactttgggaggccgaggcgggcagatcacaaggtcaggagatcgagaccatcctagctaacactgtggtttactacaaatacaaaaaattagctgggtgtggtggcacgcacctgtagtcccagctacttggaggctgaggcaggagaatcgcttgaacccaggaggcggaggttgcagtgagctgagattgtgccactgcactccatcctgggcgacagagcgagactccgtctcaaaaaaaaaaaaaaaaagaatttcttaaacagggctgggtgtggtggctcacgcctgtaatcccagagctttaggaggccaaggcaggcagatcacctgcagtcaggagtttgagatcaggctggccaacatggcaaaaccccatctctactaaaactacaaaaattagcggggtgtggtggtgcacgcctataatctgtgctacttgggaggctgagacaggagaattgcttgaacccaggaggcagaggttgcagtgagctgaaatcatgccattgtactccagcccgggtgacagagtgagactctgtctcaaaaaaacaaaaaagaatttcttaaacagaatattaaaaaaaagagattataggccgggcatggtggctcatgcctgtaatcccagcactttgggaggccgaggcaggtggatcataaggtcaggaaatcgagaccatcctggctaacacggtgaaaccccatctctactaaaaatataaaaaattagccaggcgtggtggcaggtgcctgtagtcccagctacttgggaggctaaggcagaagaatggcgtgaaccctggaggtggagcttgcagtgagccgagatcgagccactgctctccagcctgggtgacagagcaagactccatctaaaaaaaaaaaaaagaaagaaaagagagagagagagataatctgagcaacacaaaagttaaaaactcgaggggcatggtagctctcacctgtacccagcactttgggaggccaaggtagatcacttaaggccgggagctcaagatcagcctggacaacatagcaagaccacatctctacccccaaaaaagaaaaactaaaaactttagttcatccaaacatgtcataccaagtgagatgccaagccccatagtaggagaagatattttcagtacatgtaaccaacaaatgacccatatccagaatatataaagaacacttacaaataaatgagaaaaaatccagctcatattcaaataggccaagactcatggtacctttcaaaagaggatttccagatggccaattaacatctgaagaggttcaacctctttagtgacaagagaaatgaaaattaaaaccatagtgataccactgcaaagtcaccctcaccctgctggcaaaaatttaaaaggctaactgatatggtttggctgtgtccccacccaaatttcatcttgaattgtagctcccacaattcccatgtgttgtgggagggacccagtggaaggtaattgatcatggaggagggtctttcccgtgctctttctcttgagagtgaataagtctcacaagatctgacggttttataagagggtgttctttgcacaaactctctttgcctgctgccatccatgtaaaacatgactttctcttccttgccttccaccatgattgtgagaccaccgcagccaggtggaactgtgagtccattaaagctctttcgtgtataaattacccagtctcgggtatgtctttattagcagtgtgcaaatggactaatacactgacaataccaaatgttagcaagatttcaaagcaatgcgaactctcatacattgctagtgagggtgcaggaaacaggttcagctacttcggaaaacactatctactaaagttgatatatccaaatcctatgacctaacagttctgctcataggtatatacccaacaggaatctgtacatttgggtgccaacagacatgtataagaacgctcatggccgagcatggtggctctcacctgtaatcccagcactttgggaggctgaggcaggcagatcacttaagtccaggagtttgagaccagcccgggccacatggcaaaacctcatttctacaaaaaatacaaaaattagccaggtgtgatggcacgtgcctgtagtcccagctactccagaggctggggctggaggatcacttgagtccaggaggaagaggttgcagtaagccaagatcatgccactgtactccagcgtgggcaacacagcccatctcaaaaaaaaaaaaggaatgttcataaaaaccctactcattatacccccaaattggaaacaacccaaatagccactaatagcataatggataaataaatggtgctacgttcatacaacagaatgaattagctacagctataggcaacaacatggatgaatcttagaatatgttgatgaaaaaagccaatcatagaagaagtatagaatctgattctatttttataaagttccaaaatggacaaagctgacctatagtgttagaaatgattggaagggggcctccaggagagctgggcatgattttgacccaggagacaagttactcaggggtgtaacagttatttcggggtataactttcttctggtgatgctgggattacaggtgtgagccaccatacctggccaattattaacgttttaagttttatctactgaaaattgcacaaattataaatgtacagttcacaaaatcatctcaaatggaggcagtagcaggaggatcgcttgagcccaggagttcgaggccagcctaggcaacatagtgagatcccacctcaattttaaaaattaaaaaaattaaatgaggtcagacgcggtagctcacacctgtgatcccagcactttgggaggccgaggctggtggatcacctgaggtcaggagttcaagatcagcctggctaacatggtaaaaccccttctttactgaaaatacaaaaattagcccagcacagtggcacatgcctgtagtttcagctactcagcaggctgaggcaggtgaatcgcttgaacctgggaggcagaggtcacagtgagccaagatggcacagtgagccaagatggcaccactgcactacagcctaggcaacagagcaagactctgtctcaaaataaataaaataaaataaaacaaaataaaataaaataaaataaaatagggccaggtacggtggctcatgcctgtaatcccagcactttgggaggccgaggcaggtgaattacctgaggtcaggagttcaaggccagcctggccaacatggtgaaaccccatctctactaaacatacaaaaaattcattgggcatggtggcgggtgcctataatcccagctacttgggaggctgaggcaagagaatcacttgaacttgggaggtggaggttgcagtgagccgagatcatgccattgcactccagcctgggggacagagggagactccatctcaaaaaaataaatacataaacataaaataaaataaaaaataaagtggccaccgacttcccagcccctctgtggctaaaggtagacatgtcatgcactttatctaatgggattctgagaggtgcatgctgtgatgaagatgaacgctggaaatattacactaagtgaaataagccaggcacaaaagaacagatgttatataattccacttatatgaggtaactggaatggatatattcatagaggcaggaagtagaatagtggttaacaggggctggagacagaggggaatggggagttattttttgatggatacggggtttcagattgggatgatgaaaaagttctagaaatagatagcagtgatgattgcacaacagtgtgactggacttaatgccatcaaattgtacacttaaaagtggcttaaggccaggtgcagtggctcacatttgtcatcccaggacttttggaggccaaggcagatggatcatttgaggtcagaagtttgagaccagcctggccaacatggtgaaaccccgtctctactaaaaatacaaaaaattagccaggtgtggtggtgcgcacctataatcccagctgcatgggaggctgagacagaagaatcgcttgaaccaggaaggcattggttgcagtgagctgagatcatgccattgcacgccagcctgggcgacagagtgagacttggtctcaaaaaaaaaaaaaaaaagtggcttacatgtttagttttacaagatgaagagttctggagattggttgcaccacaatgtgaacatgcataactgaactgtacacctcaaaatgattagaagattaggacgggacgcgtgcagaggctcccgcctgtaatcccagcactttgggaggccgaggtgggcagatcacctgaggtcaggagtttgagaccagcctggccaacatggtaaaaccccacctctactaaatttacaaaacttagccgggtgtggtggcgggtgcctggaatcccagctactcaggaggctgaagcaggagaattgcttaaacccgggaggcggaggttgcagtgagccgagatggcgccattgcattccagccttggagacaagagcgagattccatctcaaaaaaaaaaaaaaaaggttaggatggtaaatgttatgttgtgtatattttactgtgattaaaaaaaaagttaataatgaaaagttctttgtccgttaatttgagaatgtagatcaaatagacaaattcctacaagaatataacttaacaatgtttaagaggagacaatcagaataattctgtatttattaaagaaatcaaaccaacggtagaaaactattctcatgaatcaaaaacaagcccataacatattatgggcaagttttcccaaacattgaagaaacaaacatttccaaaattacataaaacatagcttagacagggctaggtaaaccacagcttgtgggcccaatttggcttttacgtatcgtctgtggctactctcacactctaacggctgcgccaagcagtcacaacagagacacagggcctggaaaacccaacatgtttaccatctggccctttacaggaaaagtttgccaaaaacagaaaactctctccaactcattttgtgaggctcatatatctttggcacccaaatctaacaagaacagcatgaaaaataattataagccagtgccattcatgaactcagatgtaaaaatcctaacaggattgaatagaaggaatgaatgaataaatggctgaatgatcttcccaagacttttgtagttttcagaccatatttgctgggcttttttggtcccttatgtaagtgtcatcttttattgatcaatctcttccatttactcaactgtggcagacaccaatccccttcccttgcccccttcccagcccctcttgtggctaagggcagacatgtcactcacttttagctaatgagacatacagggccctggagacacttttgggcaaggttttgctttcttataaaaataggcaactgggcacggtggtttatacttgtaatcccagcactttgggaggctgaggcaggaggaacacttgaggctaggagtttgagaccagcctgggcaacaaagtgagactccatctctataaaaaatgtaaaaaattagccaggcatgccagctgcagtggctcacgcctgtagtcccatcactttgggaggccaaggctggttgatcacttgaggtcaggagttcgagaccagcctgggcaacatggtaaaaccccatctctactaaaaatacaaaaattagccaggtgtggtggcatgtgcctgtagtcccagctactcaggaggctaaggtggaaccaggaagtggaggtttcagtgggctgagatcacaccactgtactccagcctgggtgacagagcaagactctgtctaaaaaaaaaaaaaaaattaaccagatgtggtggcatacacctgtggtcccagctactggggaggctgagataggaggatcacttgagcccaggaggtagaggctacagtaaactatgatcgcgccactgcagtctagcctgggcaacagaaccagaccctgtctcgaaaaaagaaaaacaaaaaacaggccagaggagagcaggggagcgtgacagcattgcttcacctcccttctttggtcctaaaattaggtctgatgcctggagctgtggcagctatcttgcagccatgaagataaaaagccagcatgctgacgacagtggagcagaagagaagaagagcctgggtcctcaaaagctccatagggcacctgaggcagtgccagcaattgccaccagatgtcttgttttccaagaaaaattactcctctttctttctttttttttttttttttttgagacaaagtcttgctctgtcacccaggctggagtgcagtggtgtgatctaggctcactgcaacctccgtctcctgggttcaagcagttctctgtctcagcctcccgagtagctgggactacaggcacgcaccaccatgcccggctaatttttgtatttttagtacagacggtgtttcaccatcttggccagggtggtcttgaactcctgacctcgtgatcaacctgcctcagcctcccaaagggctgggattacaggcatgagctaccatgcccagccactcctcttttattgggtcactggtaattggatgttctgttacttgcatctgaaagcattcctaagtgatacatcctcacatatacactgtttcagtgtatattttctaaacatcacttagaaaatatattgaaggtagacctgttatggtctgttaatggattgggcctgggatttcaatattcccacactcatgaacatgaataggcttcttcttctttttttttttttttaagaaacagggtctcgctgtgttgcccaggctgctctcaaactcctgagctcaagcgatgctcctgcctcagcttcccgagtagctggggctacagacacacaccactacacccagctgggagtagtttttaagaatcattaaaatccttaagacttacagatggacccacccatgggtgaaaataaccctggctagaagtgttcactttaggccgggcgtggtggctcacgcctgtaatcccagcactttggtgaagccgaggcaggtggatcatgaggtcaggagatcaagaccatcctggctaacacagtgaaaccccgtctctactaaaaatacaaaaaaattagccgggcgtggtggcgggcacctgtagtcccagctactcgggaggctgaggcaggagaatggcgtgaacccgggaggcggagcttgcagtgagccgagatcgtgccactgcactccagcctgggcgacagagtgagactctgtctcaaaaaaaaaaaaaaaaaaaaaaagaagaagtatttactttaacctagcatgagccaagggttactttcttttttcttttcttttctttctttttttttttttttttttttgtgatggagtctcactgtaacaaccatgctggagtgtaacctctgcctcctgggttcaagggatcctcccaactcagcctcccaagtagctgagactacaggcacctgccaccacacccagctaatttttgtattttcagtagagacagggttttaccatgttggccaggctggtctcaaactcctgactgtaagggttgccgagagataagacaagtagagccaaagtcaggccagcaagtttattaacctgccgggctgctcctttatagtcagaggaggcagccccgagctagcaaagcaggggattgatatagggggtgaggcttggggattttctaggtgggaccatatcctgggtctgtttgccaggcctcttgaaattttgcaaaaacaattactggaatagaacaaagaagatgggtaatgggggcagtctgaggaggaagttatagtggtatagcagcctcacagaggggttacaagagctgtttgtgaggcttatgggggaagagaggggtagctttgtctcaaacatttcagccttttaatagataatagataatagaagaggggcaccattctcatctggctacttcaagctaaagagggtcgctggttaaggggaaaggccggatggtggagattgggtttggagcggttggtatccttggagcagcatcatgtcttgtattgttccatgggtgaatgctctgatacggttctgtaaaaactgggtagggagacataagaggcaggggccaaatgctaaaaagaaagaaagggttatagcaggacctaggaggggcagaggccagggagcccaggagttactgaaccactgaggccatgtggattgactgtcccttaatttttgtgctcggtctttgagttttttgaccgcatctcatactaatccagattggctgagatagaaacaacattgttcacctaaaaagacacagagaccgcccttttcggctgtaagaagatcaaggcctctgcggttctgtagggtaactgctgctagagagcctaattgattttggaggtgagtgagagaatctgcaatctcttctgatgatgcttgaaagtctttggagagtgactgaaaatatgataatgaagttcctaagcttccagctcctagtccaacacctgctgtgaccctgagggctgctaataaaggaacaaattgtattgccttctttgaacaggcatggactgtggcgggcatatggagttcttggtctgggggaacgagattaatattgggggtaaggtaaattaaggtgcaggtacctgtccagttggtagggagacaggagtagatcgtggagccacagaagaaaaagatgcctgaggtgttgatacaaacagacaagtgaattgagaacagatgctgtagcatgtacgttcctcatttagagagcctaggcttggcttcggcaacccagagtgaggaggagagagagacctctttgagaacccctgtttggggaaggagtttctatgtctgagaggccgggggagaggtgatgtgaaggggctgagtgaggagaccgttggcttcaggaaagactgaataatctactcggagtgaggtgtgggaagacgggtgaaagatgatttgggttgaattacaggtggaaggagggacggtgcctatgtgtacgtgtctattggaagaagtgatacataaggggacttggccaattctagtggtgtcgagggttatggggccttgaatggtagggtgagggagcttggagcagttgtagttggcagtacatgtggagaggagtttggtagctctgttagctaaggtggtaggatagtttccggcgagggtgagggctttgtctataaaggcagagaccctcattgtagtagtgaagctctctcagtgagggaatactggggttggactgcaggggcaatgaggaggagagaagcaggggcagaagaaagggaggcttcttttgctgcttcatcagcctttctgttccctcttgaaatgttatctgatcctgtttggggtccttgacagtgtataactcctgcttgagttggcaggtgtacagcctgaaggagttggtaaataagggggccgttagtgatggggttccctttggcagtaaggaatcccctctcttgccagatggtggtgtgggaatgaaggatgtgatagacatatttggagtctgtataaatgttgactcatttgcctttggaaagggttagggctctggtgaaagctgtaagttctgctttttgggaggaggttcctggaggtaggggcttggcttcaattactcagtcaagagaaacaactgcgtatccagcaattttgggggagccagtggtcccagaagaggagccatctatgaatagctggtcatcagggttggtgagagtctcagaggaaatgtttgggaaatgtggctgcaggtggtctaggatttcagtgcaagaatgagtaggaggggaagaggatacagggagtaaggtattcccaggaaggatgctgggttgagggtagcactcttggcaaggctgaattcaggatttttgataaagagagcatggagtgattgaatccgggaaggaggaagggagcttaatgctcgggaggtgaggagatcttgtagattatgaggattgtggatggtggtgttttgtccgaatgttagtttcctgctttctagagctagaatggctgctgctgctaaagccctaagacaagcaggccaccctttgattgtgttatcgagttgtttagagaggtaggctacaggggcaaaggaaggaggatttctcttctgttgccctagtacactgagggctgttccttggttctcggcagtacagacagtgaaaggttgggtgatatcaggtaaggacagagccggtgcagtgagaagagtggtttggagtttgtggaaattggggagtatgttatatgaggggtttaggagttcattgagggggactttggctgcttcatagagggggtgagccggaagggcaaagttgggaatctgtattctaaaaaagcctgccagccctagaaaggaaaggatttcatctttggaggaaggcgggggcagattgtttatgagtgctgctcaggctgggtcatagcctgggccccaggagaaagttgaactcctgagcaagtcactttggggatggagagctgagccctggaaggggaaactctatgccctttggcagcgagaaagtttaaaagagtgactgtgtgagtttgagagtcttttagagaagggctgcaaaggagaaggtcatccacatactgaaggagacggctaggagagaggtctaaggaggtgaggtcctgggtgaaagtttgtccgaagaaatgagggctatccctgaagccttgagggaggacagtccatgtgagttgttgtgactggaggatgtcagggtcagtccaggtgaaagcaaagaggtcttgggaatccaggtataaaggaatggtgaagaaggcatccttggctgggtgtagtggctcacacctgtaatcccagcactttgggaggccgagtcgtgtggatcatgaggtcaggagttcaagaccagcctggccaggatggtgaaaacccatctctactaaaaatacaaaatttagccagatgctgtggtgggcacctgtagtcccagctactcaggaggctgaagcaggagaatcacttgaacccaggaggcagaggttgcagtgaactgagatcacaccactgtactccagcctggcgaaagagcaaggcatcctttgggtcaatagcagtgtaatgggttgtgtcagagggatgagaaagagaagcgtatatgggttggggtctatgggatgaatagggaggacagcttgattgacggctcagagttcctggacaagtcagtatgagccatctgattttttaacggagaatgggggtgttatatggggaacgtgttggtctaagaagaccacatgcatggagcttgtttatgatggtctgtaggcctctttggtgagtcagagaaatagggtactgggggacattgggaaatttggaagggtctttgagccaaattttgatggggtcatggtgagtggctaaggaaggggtggtggtgtcatacataattggatcaacaagggaggcgggaagtgggtactggggagaggggtcaggggctgaagtagcgcgagaagcaggagagactccggtggagggagactggaggaagtgatagacgctttgaatttgactaaaagatctcgtcctaaaatagggattgggcagcaaggcatgataaggaaagagtgtgagaagacagtttcaaacagggaacaggtgagaggcctggtgacacgtggacgagaaataagtccatcaacccctacaactgagacctggaagggatgagtgggtcctgaaaattcaggcaaagccaagtaggtggccctggtatcaattaaaaaagagattggcttacctgccactagtagagttaccctgggctctgatgcagtgatggcagatggggccgggggccctgggccttgtcaatctttagtggccaggccaaggagctgcaagagtgcaagcggctcttcgccctttgtgttgctgaagaggtggaggtctggagggacaggtttgtctgactgttgaggggacaatcagatttccagtgacctatctgttgacaaaccgggcaagggctctttggtactcgtgaattaggacatgcccccgcccagtggccttccttgctgcacttgaaacaaggcctgcgagggatgctgctatcagatcttttgtgcccttcggtactatgcctaggctgacagatagccgctgctagaagctggtatttagcacaatctctttgggctttatttaatttattttgctcaaccctgttataaagactttgaaagccaggttaaggaggtcttgctgtggggtttgagggctatcctcgacctttttaagtttgcgccaaatgtctggggctgattgggaaataaaatgagtattgaggacaatagtcattttacaggaggtaggatcaacacaggtatatttttggggaacctctgtaaggtgggaaagaaactcagcagggttttcatctgctctttgggaaatttctttgagtttttttaaagtttacagctttgtgagcagctttgttaaggcctacaatgaggcaagtaaccatatggtttcaggacgctcggctggggtctgtgggttgctattcccaggaaggctcttcctgggggactgctgcagcccctactggcttagtaggatcttcctgatggaggtcattggcatgtgcctgggccgagagccacactctttccttctcttccagaaagagggtagagaagagaataatatagagatcatgctaagtaagtttataagactggctgagatatttaaattctttgatgtaagtattgggatcagaggagaaggacccaagatgctttttgatttgggaaagatcagtaagagagaaacgaacatggacatggacaattccttcagctcttgcgacctctcggagcgggagtaaggaagggcatcccgggtccgggagcaggtaagaagtggagacagggaggacttacagtctgaagccaggtggtttgagagaggaggagaaggggacagagctggagcaggggcatacggtggagggtcggggtgatggggaggaggattagggcgcggttggggaatggaaaagtcagcagggtcaaaagaagaggagtcgtcggttggagctgatgggagggaagcagaagacgagtcaggcttggagcaggcagggaggatttggaaggttgaacaggactggcaaagagaaggatggcaacagagggtgaaaaaatcctggacatgaggaatctcagaccagtttccattgcgatggcaaaagttatctaagtccctgagtacactgaaatcgaaagtgccgttttcgggccattgggaaccactgtctaatttatattgaggctatgtagtgttacagtaaaagataagcctcttaggacggacctctgaacagaggcagagagcattgagattgcgcaggagacacctgaagggggtaatcttggaaagggtagactgagaggctcccatggtgaagggaaggagagggtagaggaagaagagactgccgatgacaagaacggcaggagaaggcatcccctgtcctgccgatcgtgccaggagaagggaggtaacccccgaatcaggcatccccgagatggaggaactaaaggcctggaggctggaggaagcccttgacccagcgctgggtctttcgggcaagaaagagtcggtcaaggattccaggtaaatggtaagggtctctcttactgacccctgtggaggccctgatggtggatgcagtcgccagcaatggtagagtctaggagattcttcgggtctttggcaggtttgggaaggggaggacagctgggagaaggggtgatggcgatggggagtagacagagagagagagagagggagagtcccttaaggatgtccagccagagcctatccccttcccgggtttcggcactaaaatgtaagggttgccgagagataagacaagtagacccaaagtcaggccagcaagtttgttaacctgccgggctgttcctttatagtcagaggaggcagccccgagctagcaaagcaggggattgatatagggggtgaggcttggggattttccaggtgggactatatcctgggtctgtttgcctgggtctgttttggaattttgcaaaaacaatcactggaatagaacaaagaagacgggtaatgggggcagtctgaggaggaagttatagtggtttagcagcctcacagaggagttacaagagctgtttgtgaggcttatgggggaagggaggggtaacttggtctctaccactgacctcaggtgattggcccaccttggcctcccaaagtactgggattacaggcgtgagccaccacgcccagcctgttttttgttttttgagacagagtctcactctgtcacccaggctggagaacagtggcatgatctcagctcactgcaacctccccctcccaggttcaagtgattctcctgctttagcctcccaagcagatgggattacaggggcatgccatgatgcccagctaaatttttgtatttttagtagagatgaggttttgccatgttggccaggctggtctcaaactcctggcctcaagtgatctgcccgccttagcctccaaaagtgctaggattacagacgtgagccaccctgcatggccagatttcaacactttgaccttcatgaacatagataggcttttaagaacaattaagctgggcccagtggcacacacctatagtcccagctatttgggaggctgaggcaggagcattccttgaacccaggagttcaaatacagcctgggcaacttagcgagaccccatctctaaaataaaacacattaaaaccttataacttgtagacagaccctgttggtataaatgaccctggtgtccttggatgtgttagatttaacctatcaagagccccggtttacttccaacttaatttgttgaccttcattcttaacttaaaaaaaaaaaaaaagttgacagggcactgtggctcacacctgtaatcccagcactttgggaggccaaggcaggcagatcacttgaggccaggagttcgagaccagcctggccaacatggcaaaacctcatctctactaaaaatacaaaaattagctgggcatggtggcatatgcctgtaatcccagctactcaggaggctgaggcacaagaatcacttgaaccctgaaggcagaggttgcagtgaatcaagattgcaccactgtaccccagcctgggcgatagaacaagactccatctcaaaaaaacattatataaaaaaacgttgccgggcacggtggctcacacctgtaatcccagcactttgggaggctgaggtgggtagatcatttgaggtcaggagttcgagaccagcctggccaacatggtgaaaccccgtctccactaaaaatacaaaaattaactgggcatggtggcagacacctgtaatcccagctactcaggagcttgaggcaggagaatcacttgaacctgggaggcggaggttgcagagagccgagatcatgccgctgaactccagcctggacaacagagcaagactccgacccccaccaccccaaaaaaaatgttaacaatattcctataatggacgattttccacagccaagaagaataaataaaggtactggtttgcacattcaggcctctctgagctaccccagctgagagaagaaatcaagagtacttttatcaatgaggaaatgctgatgccaaaacttggtagagctgaaaattcataatcatactgctctgaagtgagatcaactctgttcagggcaattgacaaggaagttgctctctagtaaaattaaaagaccagtcattgggatataaatagtgacaataagcaaccacttgcttgcttgcttttttaattttatttatttatttttttttttttgaggagtttcgctcttgatgcccaggctggagtgcagtggcacaatttcggctcactgcaaccttcacctcccgtgttcaaacaattctctggtctcagcctcctgagtagctgggattacaagcacgtgccaccatgcctggctaattttgtatttttagtagagatggggtttcaccatgttggtcaggctggtccaaactcctgacctcaggtgatccacccgcctcggcctcccaaagtgctgggattacaggcgtgagccaccatgtccggcccactttctttattttaactttctaggtgagcaagccctgtactgtctgaggccaaagggttcaaggttgctcatttttctttcagaactgttttttttttttaaagacagggtcttgctatgttgccgagactggagagcagtggctattcacaagtgctatcccagcacgctgcagcctgaaactcagtagctgaaacaacaggcaggaaccaccttgcccacctcttagttacaattcttgagaggtgtccctaagaatactttattttagattttttttttctggctttggtagagacagagtcttgctatattgcccaggctagtcttgaactcctgacctcaagcaatcctcctgcctcagcctaccaaagtgttgagattacagtagtgagccactgctcccagccttactttagatttttatattcctcccgtaacagctgctccactgaaatattctggaaaacgcaaagaagcagccagtgctgtgtttttgtttatcttcaactgtctacattttctctgcttctcaatgtcttgcttgcaaaaacaaagcaacttttgaagggtttattacttgctgccgcatcccctgcagtcaggagaaccaccaccatattgaaggcagtcctgtaaatatgcagtttttccagctgaagcatttattgtacgctcatgacacccagtggtcagaaaaatactgtgcagaatttttgttatgtttttgtttttgtatttgaggcagagtctcgctctgtcacccaggctggagtgcagtggcacaatcttggctgactgcaacctctgcctcccaggttcaagccatcttccagcctcagcctcccgagtagctgggattacaggtgcacaccaccatgcccggctaatttttgtatttttagtagagacagggtttcaccatgttggtcaggctggtctcaaactcctgacctcaggagtttgatccacccaccttggcctctcaaagtgctggaattacaggcatgagccatcgtgcctggctaatgtttgtatttttagtagagatggggtttcaccatgttggtcaggctggtcttgaattcctgagctcaagtgatctgcccacctcagcctcccaacgtgctgggattacaggcgtgagccaccgcgcctggccctgttttttttgtttttgcttcatacaagatccacggtgtgaccgcaaacagctggttctgcggagggctgagggatggaaagatatggaagccacgaggaaagaggaatgagcctggtgtctccctgatgcattgccaaggagactcagggctggaccaagaaacctaccggatggtcaggaagctgcccagaaacggctgtttggatattgaggcaatcccattttccagaccatcaaatacttgtttacagagaacttgatttgtttacaaactcatattggggtaaaattaaagtaatataatacaacattaacctcttttttttcctattttatagagacagggtcttgctatgttgcccaggctgatcttgaactactgggctcaaacaatcctcccgtctcggcctcctaaagtgctgtgattacaggcacgagcaactttttttatatatttttttcttgagacagagtctcagtctgtcgccaggctggagtgcagtggtgtgatctcggctcactgcaacctccaactccctgtttcaagcaattctcctgccttggcctcccgagtagctgggattacaggcacgagccaccacacccagctaatttttgtgtttttagtacagatagggtttcaccatgttggccaggataatctcaaactcctgacctcgtgatctgcccgcctcggcctcccaaagcgctgggattacaagcgtgagccaccgcgcccggactttttttttttttttttttttttttttttttttgatacatagtctccttctgtaacccaggctggagtgcagtggcgcaatctcagctcaccacagcctccaccacccaggttcaagtgattctcctgcctcaccctcccaagttgctgggactacaggcgcgtgccaccatgcccggctaatttttgtatttttagtagagacagggtttcatcctgtgcgccaggctggttcgaactcctgggctcaagtgatcctcctgcctcagcctcccaacatgctgagattacaggtttgagccactgtgctggacacattaacttttttttttttttttgagacagagtttcgctcttgtccaagctggagtgcaatggcaagatctcgggtcactgcgacctctgcctcctgggttcaagtgattctcctgtctcagcctcctgagtagctgggattacaggcacccgccaccacacttggctaatttttttctatttttagtagagacggagtgtcaccatgttggccaggctggtctcgaactcctgacctcaggtgatccactcacctcagccacccaaaatgctgggattacaggcgtgagccaccgcacctcaccacattaacgtttttaaaaagtacacttcagtggcatttagtaccttcacagatgctgcgtaccagcccctctatcttgttccaaaacattttcatcaccccgaaagaaaaccccgtacccattagcggtcattcctcattcccccctccccatcccttgacaaccactgatctgctttctgtcttgataaattcacctattctgaatatttcgtataaaggggatcattcatatatttcacataagcggaatcatgatctttatgtctggcttttaacacttaaggtcatgtttctgaggttcatctacgttgtatcacacatcagtagttaatttgttttcacggctggatgatattctgttgtatacgtatataccacattttgtttctccattcatctgttgatggaattttgagtaatttccactttttggctattgagaatagtgctgcgatgaacatttgtgtgcaagtatttgtttgactatctgttttcagttcttcggggtgcgtacctaggaatgtaattgctgggccacaggataagtctgtttaactttttgaagaactggtgatagatttttagaccccttgaaattaatagagaattgtatttagactagcaccacattttcccaaatgaacagttgatttttttttcccttgagcaattttctttattatgtatatctgacttgttagctcggtctcgaagtacccatgggaatgaatgcagatggacaggataaaagaacccattcaggggaaagttaatttgcctaaagattccctgttgctatctgtttagcttgagtgacagctcagcaaacagaaatctttgctccaaatctttgttatgatctctgtcataacattttgtttgaaaatcgcctccagacctaaaatgaatttgagcagccaatgtgaattaattaagctgaaaagaactctcaaaacaatgatttctctgatgtgtttttatccaaaccttccaggtcactaatttgtcctgttttctttaaaaggagaaaataatgaaggggtgtatttggtgccctctacagtaaaatatctttgatatcagtggagaaggagctgcttggcataaatgaatgttcttgaaaactcgagatgacccctttaaactcacattataaatctgttaaccctttttggatgaaaagttttctaaaaccaagtgctcaatttcctggcttgtttggttcagatgttacccactgtgttgacaacaaccatttttgcttgattgttttgatacagtctcgctctgtcgcccaggctggagtgcagtggcatgatctgggctcactgcaacatccgcctcctgggttcaagcaattctcaacctcagcctcccgagtagctgagactataggcacacgccatcatgcctggctaattttttgtatttttagtagaaatagggtttcgccatgtgggctggtctctcgaactgctgacttcaagtgatctgccagcctcggcctctcaaagtcctaggattataggtgtgagccaccgcacccggccaatttcctgccttcttaaacagaagatgctgtgtatgatgaacattatttgttggactaactttgagctcagtggtcttctcaagagctcagagcttgaaaagcgtgcctgtaatttacttcaaaaaccctcagcaccaactgtacgtgtcacttagcttcagcctgctttctaggggcagtcagcgctgcggaattgggagcgcgaaattccaggggtgattagaacctacatttgaaagactcaacaaaagccactctagctctatctccaatccacaccagatggtttgttaattagcacaatgagagctaagaatgatttttcattgataaaatgagtagtgttcaaggccattgaaccagcaccgattactctctgtggtctagatgcccctgcctttgtatgagcaaatccagtgagccctggatgtcattttaattttcaaatagccatactttcgaaaagcaaaaagagctgggcgcagtggctcacgcctgtaatcccagcactttgggaggccgaggtgggtggatcagctgaggtcaagagttcgagaccagcctgaccaacatggtgaaaccccatctctattaaaaatacaaaaattagcccggcgtggtggcacgcacctgcaatcccagctactcgggaggctgaggcaggagaatcacttgaacccgggcggcggaggttgcagtgagccgagatcacaccactgcactccagcctgggcgactgagtgagactccgtctcaaaaaaaagaaaaaataaaattaaaagtgaaaagaaacagagatgcaaaggcccagacctcatgtctcaatttgggaccagagcttcattgcagaaacggcctcagttccagcaacactgggttctccctctgccaggtcctgccttcctcactacctgggggagtcttttccgagaaagacacccccaggcaccctctgtagagtgtttcacgggacaccaggactcagctcagtttaggaagttctccctctatggggtgagcctctgcagtgtgcaacaccatctccctaccacgtaggtaacgcgcaggagaggagcatgctcggagggaaaccagaagggttatttctcaggtggaaaccagtctcactccacgtgtttgccaaagccagaatggggctctgcagtcctgacgctttggtctttagaaggtagacaatatgagctcactaagaaaacaaaccagggagtaagttatctgcactttttagcaaacacgcacacggtcaggtgcaatgaatggctcactgctcttggccaacctgttaaattccaggatttggggaggctgatgggaggattgcttgaggccaagagtttgaggctgccatgagccatgattatgccactgcactacagcccgggcaacagagcaagaccctgactcaaattttaaaaactttttaaagaaaagaaaacacacccacacccacccacccccgcacaaacacacacacacacacacagcaatcagtaagaataacactgggatggccgggcgcattggctcacacctgtaatcccagcactttggaaggccgaggatggcggatcacttgagaccaggaggttgagaccagcctggccaaaatggtgaaatcccatctaatttttgtcaccccatttaatctttgtaaacatacaaaaattagccaggtgtggtagcacacacctgtagtcccagctactcgggaggctgaggtaggagaatcgctggaacctgggagacgaaggttgtggtgagccgagatcgcgctcctgcacttcagcctgggcgaaagagcgatactcagtctcaaaaaaaaaaaaaagaagaagaagaaaaaagaagaacactgggatgatttctgaggagtttcccatgtagtaaaatgtagttttaaaatactcagtgagaatagcaagaatcttctagagaccttaatcaccctgggtctttgggccactttctttttttttttttttttttcagagtaaagtgaatgcaagtttattagaggagaaacaaaagctactccatagagcagccccaagggctactggttggttatttttttttttttttaattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactctcaacgagcacgctgccttcaagcatctgtttaacaaagcacatcttgcaccgcccttaatccatttaactctgagtggacacagcacatgtttcagagagcacagggttgggggtaaggtcacagatcaacaggatcccaaggccgaagaatttttcttagtacagaacaaaatgaaaagtttcccatgtctacttctttctacacagacacggcaaccatccaatttctcagtcttttccccacctttcccccctttctattccacaaaaccgccattgtcatcatggcccgttctcaatgagctgttgggtacacctcccagacggggtggcggccgggcagaggggctcctcacttcccagtaggggcggccgggcagaggcgcccctcacctcccggacggggcggctgtcggccactttcaatcagcccaacctcagagatgacaacaacaaagttggccaaccagtggaccagggtcccctgggggtcacccctgacacagtctcccatccactgcagtcccctgagttggcactgcctgcctcccagatggtggactcactcaagacacccgagctcatataaaacctacccaaggggccctccagggcaggcaaagacattactgcacagtttggggaggtttttgttgtttttttgttgttgttgttgttgctttttttactgcccagtctttagagacccctccctgggagactgagatggttaattaatcaaaacaacgctattcacaagttttgaacttcctgttcggccactgtccagttgattcctgcacactcgattcacctctcagagtccttcgggttgaattatgtaagcctttttctaaataatcaaaggaacttgtggaagcatgccctggccagcccttagcaccccactggggaaggcaatgtaaaaagagactgaagagagtggagtgcttgtatttacctctggagcccttgggccactctgactaacaaaagaactcctcccaaaacaaacccttccccttaaaaaagggaaagaagagtggatcctcccagcccctctagggggtctacctagattgtggttcttaggcggaggagggaggaactgccccagggaacacaggatgtcactgcctcttgcctggccatcctttaatgtatctgatctgagtcctagctacaggcaaacaggtgtgggctccggaaattgtacactacaaggaatacatgccttttgttaaaaacaaagcaaaatgaaatgaaataaaatgaaggaataaataaaatatccaagcaatgtgtagagaagcaaaagcaaatccctccatttcctgtcttccctccagctccctctgcagagggagccgctgttgacctgttaaccacgtggtcatgcccttctgcagactccagatgcacagtcacgcacacacgcaggtggactattacacacatggttcagaggtttgattttttcactttctgtattatggacacttttccacgatgtacatacactgtagatcaacctcattggttttttgttttgttttgagacagggtctggctctgtcgtccaggctgtagtgcagtggtgtgatctcagctcactgcaacctctgcctcctgggctcaagtgatcctcccacctcagcctccagagtagctgggactacaagcatgccaccaagcccacccagctaggttctgtattttttgtagagatgggattttgctgtgttgcccaggttggtctcgatctcctgagtgaaagtgatccccgcggcaccccacccccctccatcccccaccacacttggccaacctcattgttttaattgttgaaacacattcagtattttgtatgtaccggagtagagtattgatgaggaaatcgcccatttccttccttgcacgtctgtgctcaatggtggcacattctctcctcagtctcagccagctctgctgctttaaatatcaccccccagatgtctgtctccagcctgacctctcctcccacctccaagacttgtaatcccaaccaacttctctgcctccccctggaggtctagcaggcatctccaacctgccaccttcctcattctccagctccattcccctccttgtcttccccatctcagcaaatgctatcaccagtagctcataccagctcataccagtcatcccacccatcagtaagcctgttggctctccctccaaacacatgtcctgaatccaaccattgcttcccacttcacctgctgcaactctagtccaagcaggatctttctcctgaaagatcaccaccaggttcttgtgttcactcctattttctacagtccagggaaagcattctaaaggtgaatccaggccaggcgtggtggtgcatgcctgtaatcccagctacacaggaaggtgaagcaggagactcgcttgaacccagcaggcagaggttgaagtgagcaaagatcgagccactgtactccagcctggggaacagacagagcgagactccgtctcaaaaaaaaaaaaagatgaatccattgcccttcccttcttaaaaccatgcaatggtttcccattagaaccagaacagaattcaaaccccttaccatggcccacaaggtcctataggatccaatccccgcccacctctcctctccagatggttgtataaaactgtggctagctctgcagatttctgaccattgaccgtagtatactcctggtcgtgtggcggtgaatgtggtttggtttaggcgtccggggattgcatctgtttttaggcctaatgtagggacagttcatgagtgtaagacgtcttgtgatgtgattattaagtcagtggggtcctccaggaagtgagcactcagatggacgtaggaatgcaagagtgtattggggccaggtgctgtggttcacgcctgtaatcccagcagtttgggaggccgaggtgggtggatcacaaggtcaagagatcgagaccagcttggccaacatggtgaaaccccctctctactaaaaatacaaaaattagctgggcatggtggtgtgctcctgtagtcccagctacttgggaggctgaggcaggagaatcgcttgaacccgggaggcagaggttgcagtgagccgagatcgcaccactgcactccagcctggcgacagagtgagactccgtctcaaaaaacaaaaaaaacaaaacaaaacaaaaaagagtgtattgggactacacgttgggtatggtgtgtgcttcctgggtgacgggggtaccaaaatctcagaaatcaccattaaagaacttatccatgtaaccaaaaaccacctattccccaaaaactgttaaaataaaagggtgtattgggggtagcagctgtgaaagaaaaagcaggagagagcgggatttatcagggagagtctcagacgatgatgcagaaccgtcttggctaatccaacggggagctctggagcaaatacaggccatcagtacagccccgttgggcagaaatgaccaggcctggtatcccagcatgcttagtcattgtcttggggctacccagacagagcatggccttggctcaaaaactggaggcctggtgggtgcagtggctcccatctgtaatcccagcactttaggaggccaaagcgtgaagactgtttgagccctggaatttcagaccagatcactcatgctattgtttgtgtgataactagccagagcccatccctttgtcttggcccatccctttgtttcctgtagggaatacttttagttaatctataatctatagaaataatgcttatcactggcttgctgtcaataaacatgtgagtcaagctctgaaggctgtgagtcccctgatctcccactccacactctatatttctgtgtgtgtgtctttaattcctctagtgccgccgggttagagtctccgcgactgagctggtctcggcaagcggtgcccaacatgggggctcacatccgggtcaaagggtcgccggagcgacagttggagaacgtgaaactaaactggaggacacccgagtactcttaagcaatccccgtggtgagtaagaagaggagctcagaagcatcagggtccttggaagcttttcacactgatgatgacgaggaaggaaagtataatgaagtaacagaagaggtgacagagcaggtttgtttgccagctaaagctaaagcagcaaaggaggaagaggttcatccctaccctcctgcatcccctccttattttgaagacagaaagtggcctgacctccagatctttcttttccagaggacactgggcaaaaagtagttgccccagtgactgttcaagcagcgcctcgaatgactgctcttagttctattcagacaggaattcagcaagctagaagagagggtgatatagaggcttggcagttccctgttagaatatatcccccagatcatcagggaaatattatagctacatttgagcctttttcttttaaattactcagagaatttaagcaagctattaatcaatatggaccaggttctccttttgtaatgggactgttaaagaatgttgctgtctgcaatcagatgatgccagtggggacagtaggattactacttaaactaggtaggtctagtttaaatttaaaaggagtgcaagtacagacaggagtcattgattcagattacaatgcagaaattcaaattgttatatctacttctgttccctggaaagcagagccaggagagcgtatagcacagctcctgattgtgccgtgagagtggacagggcgatggcaggttcgccgggtgtgaggcttcacagcggtccagggaccaagtcgagatggtgaaaacaagaccaagattggaaagccagcttcagaggagggaattacagcaaaaattgaaccattgacagaagagtctagcagtctcagagagaatgttctccaggattctgaaggcagagaattctgtgaatttggggataaattaaatgaaaaagatcagaacgcctttaaaaggagacctcaaaactgtgacaaatatgggcaaagctttgtttggagtacaagcctttttaggcatcgaagaacccatggtgagaaagcttatgaatgtggtaagtgtggaaaggcctttagtgtgagctcagccctggttctgcatcagagaaagcatgctcatttttagaagtctcttcttactgctcatttttaaactcatttttaaaaatttttggctgggcacagtggctcacacctgtaatcccagcactttgggaggccaaggcagaaggattgcctgagctcgggagttgaagaccagcctgggcaaaatagcaagaccccatctctattaaaaatagaaatcgggccgggcgcggtggctcacgcctgtaatcccagcactttgggaggccgaggcgggcggatcacgaggtcaggagatcgagaccatcccggctaaaaaaacggtgaaaccccatctctactaaaaatacaaaaaattagccgggtgtagtggcgggcgcctgtagtcccagctacttgggaggctgaggcaggagaatggcgtgaacccgggaggcggagcttgcagtgagccgagatcgtgccactgcactccagcctgggtgacagagcgagactccgtctcaaaaaaaaaaaaaaaaaaaaaaaaatagaaatcgccgggcgcggtggctcacgcctgtaatcccagcactttgggaggcagaggcgggcggatcacgaggtcaggagatcgagaccatcctggctaacacagtgaaaccccatctctactaaaaatacaaaaaattagccgggcgtagtggcgggcgcctgtagtcccagctacttgggaggctgaggcaggagaaaggcgtgaaccccgggaggcggagcttgcagtgagccgagattttgccactgcactccagcctgggtgacagagcaagactctgtctcaaaaaaaaaaaaaaaaaaaaaaatcaaggccgggcacagtggctcatgccagtaatcccagcactttgggaggctgaggctcatggatcacttgaggtcaggagtttgagaccagcctggccaacatgttaaaaccctgtctctactaaaaatacaaaaattagccaggcatggtggtgggcatctgtaatcccagctactcagaaggctgagacaggagaatcgcttgaatccaggaggtggaagttgcagtgagctgagatcacaccattgcactccagcctgggcaacagagcaagactccatctcaaaaaaaaaaaaaaagaaagaaatcaaaaagcagcaccgccccacccaaaaaaaaatccatgagtagttatttaataatctgtatctgatttctccaaaatcctaaagaggcctaagtctgttgttcatagtttctcattcatcatggctggcttccttgtgtgtttggaaattatgtatcatgaggctgtgctttgttgaacttaataagtgtaatctcaagggctaaactgggaatgttttcctccagacaggagtgactggtgagacagtcagctacaaaatggaaaaaaacaaatatgacaaaatgccaaggggcctaacaccacggaagcaataagggctgcaggaaatgaaaagagagatatctgaggtggtattaaaggtagtgaaagagatgggtcggtatgtgatgaagatccttttctttagaaaagaattcttctcacagtcacgtggtcacaggattgttactttagaatcccttccaacatgtctggaccacattagccaggaaaaagaactttaacatagaggacacaaacacagggcgtgcagtagcgccagaatctttgtataggaggctcagaggagcagcaagatcgaaacagacacccagggcggggcgcagtggctcacgcctgtaatcccaagcactttaggaggctgaggtgggtggatcacttgaggtcaggagtttgagaccagcctggccaacatggtgaaacactgtttctactaaaaatacaaaaattagctgggggtggtggtgggtgcctgtaatcccagctactcgagaggctgaggtgggagaatcacttgaacccaggaggtgaaggttgcagtgagcctgaatcgtggcactgcactccagcctgggcaacagaacaagactccgtctcaaaagaagaaagaaagaaaaagagagaaaaaaagaaagagagagagacagagaaagagaaagacccagaacgcttgccttacaactctatgcttaataatctgtatctggccaggcgggatggctcatgcctgcaaccccagcactttggaaggccaaggcaggtggatcatctgaggtcaggggttcgagaccagcctggctaacatggcaaaaccccatctcaactaaaaatacaaaaattagccgggcatggtgttgcacgcctgtaatcccagctacttgggaggctgaggcaggagaatcgcagaggtttcagtgagccaagatcatgccactgcactccagcctgggcaacagagactccatctcaaaaataattaattaattaattaattaataaaataatctgtatctgatcactccaaaaacctgagatggcctaagtctgtcattcatagtttctgctgattctcactcatgatggctggtgtgtttggaaattgtatttaatataccttgagttcgtacttagttgaacttaatatgtgtaatctcgagggctaaattagagatgttttcctccagacagcagtgactccccaaaccagatcaagtttggggaggtgtcttgtgggagatgttgatggagattacaagctaaagcacttccatgggtgcccccagcttatggtgtgtccataagctgcagagaaatcagcacccactttgtaaggccgaagtagacagattgcttgagcccaggagttgaagaccagcctggacaacatggcaaaactccgtctctaccaaaaaaaaatataaaaattagccatgtatagtggcacgtgcctgtagtcccagctcctcagaaggctaaggtgagaggattgcttgagcccaggaggtggaggttgcagtgagccaagatcacaccactgcactccagcctgggcaacagagcgagaccctgtgaggagaggaaaggagaggagaggggaggggaggagaggggacctctcccctccctattcaacttctcatcctgcaaagtgctcagaggaacacctgtgagagggtggatcccaagagaaaacatccaggttatccacatcccttgccatcattggcttcaacacaagtcaaggagaaactcaatactgaggttgaagtttttacaatttgcttcacctcctctctctgccatggtagttggagcatgagtgctttgtaaatttccgcctgaaggagaaaaacatccaaacagcaaaccagtgccaaaacttgcataccacggatgcctggctaatgcctcaggcaacttgctgggtttctgaactaggtttgcgccattggtccaggaagctggggagagatgtggctggctcattaatcctcacagatcagagagatcctgctggagccatacaaagtgcagatgtcttttgtgatctgtaaaacaagtcctcatggggaaggtaacttggatgcctgtgaaggctgggtccacgtcttcagaatctcacaggtgcaggtgggttcctgaagatcaccacctgtgtcagaaaaaaactctatccaaactgcatttttcctctactctcacaccacaacagtcaacacagaagaagacttctgtgaccaaatgtgtgggggtggacaccagctgggtgtcctgcaattcaatttcaacactatctacctggagatggcatcacatcccagggcttgagaactcagtctgcaagactatctcccccaatgctagtcacaagtctgagcctctggaacttctgagtcactggcttcaatttggggttcccatgaccccctctttgggtttgtttttttgtttgtttgctttttgtttttttgtttttgacggagtctcactctgtctcccaggctggagtgcagttgcgggatctcggctcactgcaacctccgcctcccgggttcaagcgattctcctgcctcagcctcctgagtagctgggattacaggtgtgagtcaccatgtccggctaatttttgtatttttagtagagacggggtttcaccatgttggccaggctggtctcgaacacctgacctcaagtaatccacccgccttggcctgccaaagtgctagaattacaggtatgaggcacgatgcccagcctgggtttgattaatatgttggaatggctcacagaactcaagaaaacacttacttatgtttagtggtttattataaaggattcacaagggatacagatgaagccatgcatagggtggagtttaggggaagcagagcttccatgctctcctgggtctcaccaccctccaggaacctccacgtattcagccatccagaacctctccaaacccagtcctcgtggcttttttatggaggcttcattacatgggcacgactgataaccgtgtagaaatgtgattggacaaaaatctcatgatctaaacccccggcaaggcctgtctgttcagacttttcttggcctctctctcagcattccttcctctagggcagggctgaccaatcttttgacttcctgggccacattggaacaagaagaattgtcttgggctacatataaaatactctagcactaatgatagctgatgatctttaaaaaaaaattgtgaaacaatctcataatgttttaagaaagtttatgaatttgtgttgggctgcattcaaagccatcctggacggtgggctgaacagtcttgctctagggtatggggcaggaccctctctggaatgaaggtctttggacccacatcagattagaatcctggttggacaggtgaaagaggaacaggagaagttcagaggagaggttctgtttcctgaggcctcaagtgccccaacattatcacaggactgtgggagttaggaacggggatctgcagatgcaaaccagtatgtatctatcgtaacaccacaccgcctatctccgcatggacaggtatggacaaggagagggtctgagactcagaaggtgggtttgtgggagccagaaaattgaacccaaacatcccttatggagaagcacttcatccattcaacaaaaatgtattaaggccgggtgcagtggctcatgcctgtaatcccagcactttggcaggccgaggcgggtggattacctgaggtcaggagttcgataccagcctggtcaacatggtgaaaccccatctatactaaaaatgcaaaaattagctgggcgtggtggcgcacccctgtaatcccagctacttaggaggctgaggagggagaattgcttgacctcaggaggcggaggctgccgtgagctgagatggcaccactgcacttcagcctgggcaacagagtgagaccccgtctcaaaaaaaaaaaatatatatattaagcactcttctgcggtgagcaggtctatgcaaacctacctccaaaggcccagggagctgagaggccaaagaaagaggctgacaaacacagtgatcagaaggaaacatttaatagggacttacgaacagaaaccatgtctcaggcagcctccagatgacatggtggatccctacaatgttataccccaagacccagggcttatataccatagggaatttgcataagggcaggatttatggtaagtatgtgtttcagtaatgttgaggctttcacttaagggtaagatttacagtaagttcatgaaagtagaagtctttggctggtcagagtggctcacgcctgtaatcccaacactgtgggaggctgatgagggtggatcactttgaggccagaagttcaacaccagcctggccaatatggtgaaactctgtctctactaaaaatataaaaattactcggaggctagatgcggtagctcatgtttgtaatcccagtgctttgggaggcccaggtggatgaatcatttgaggtcaggagttcgagaccagcctggccaacatggtaaaaccccatctctactaaaaatacaaaaattagccagtgtggtgacaagtgcctgtagtcccagctacttgggaggctgagggaggagaattgcttgaacccgggaggcagaggttgcagtcagctgagatcctgccattgcacttcagcccgggcgacaagagcaaaactctgtcttaaaaataaaataaaataaaataaaataaaataaaataaaataaaataaaataaaataaaataaaaattagccaggcatggtggtgcacacctgtaatcccagctacttgggaggctaaggcaggagaattgcttgaacctgggaggcagaagttgcagtgagctgagatggtgtcattgcactccagcctgggtgacaaagtgagactttgtctcaaaaaaaaaaaaaaaaaaaaaagatagatgaggtctgcaggattgatatcatgagatacaggtcataaagaccctgctgataaaataggatgtggtcaagaagtcagcccaggacaggtgcggtggctcatgcctgtaatcccaggactttgggaggccaaggcaggcagaccacaaggtcaggaggtcgagaccagcctgatcaacatggtgaaaccccgtctctactaaatatacaaaaattagctgggtgtggtggcacgtgcctgtatcccagctactcaggaggctgaggcaggagaattacttgaacctgggaggtggagattgcagtgagctgagactgtgccactgcactccagcctgggtgacagagtgagactctgtctcaaaaaaaaaaaaagaactcagcccaaaccagccaaaaccaagatggcaatgaaagtgacctctggtagtcctccctactcagtatacattaattataatacattagcatgctaaaagacactctcatcagcgccatgacagtttacaaatgccacagccacatccagaagttagcctatgtagtctattcctttatttatttattttagtttagtttagtttattgagacagggtcttgctctgtcacccaggctggagtgcagtggcacaatcttggctcaccacaacctctgcctccggcttctcctgcctcagctgcctgagtaactgggagtacaggagcacatcatcacgcccagctaatttttgtatttttagtagagacaggatttctccatgcttgccaggctgtccttgaactcctgacctcaagtgatctgccagccttggccttccaaagtgctgagattacaggcatgagccaccatgcctggcccagaagtttacctatatagtctaaaaaggggaggaaccctcattctggaaatcacccacccctttcctggaaactcatgaatcacctgcaacggaaattcagtgatgagtaactcagaggagcggttagaacttagggcttatatagaggccaggctcagtggctcatgcctgtaatcccagcactttgggaggccaaggcaggcagatcacctggggccaggagtttgagacaaacctgagcaacatggtgaaaccccatctctactaaaaatacaaaaattagccaggcgtggtggtgggcacctgtagtaatcacagcagctactcgggaggctgaggcacaaaaatcactggaaccggggaggcagaggttgcagtgagccgagatagcaccactgcactccagcctgggcagcagagtgagactctgtctcaaaaataaagcaaaagacggccgggcacggtggctcatgcctctaatcccagtacttcaggaggccgaaacgggtagatcacctgaggtcaggagttctagaccagcctggccaacatggtgaaaccccgcttctactaaaaatacaaaaattagccacgcgtggtggtgggcacctgtaatcccagctacttgagggggcgaagcaggagaattgcttgaatccgggagacagaggttgcagtgagccaagatggcaacactgcattccagcctgggggagaagagcaagactttgtctcaaaaaataaaaaaataaaaaaaataagacacatgtggagggaaaaaagaagaaaagaggccaggcacggtggctcacacctataatcccagcactttgggacgaccaggagggaggactgcttgagaccaggagctcgagaccagtgtaggcagcacagtgagacccctgtctctacaaaaaaaattggcagggcatggcggtgtgccagctactcaggagactgaggcaggaggatctcttgagcccaggaggttgaggctgcagtgagctatgattgtgccactgagaccctgtctcaaagaaaaaagaaatgttgtgtccggaatttattctttccggtgggttcctggtctcgctgacttcaagaatgaagctgtggacccttgcggtgattgttacagctcttaaagatggtttgtccagagtttattccttcagatgttcagatgtgtccggagtttcttccttccggtgggttcgtggtctcgctgacttcaggagtgaagccacagaccttcgcagtgagtgttacagctcttaaacgtggcgcgtccagaattgtttgttcctcccagtgggttcgtggtctcgctgacctcaggaatgaagccatagacccttgccgtgagtgttacaactcataaaggtagtgcaaacccagagtgagcagcagcaagatttattgtgaagagcgaaagaacaaagcttccacagcatggaaggggacccaagctggttgccactgctggcttgggtggccagcttttattcccttatttggccccgcccacatcctgctgattggtccattttacagagtgctgattggtgcatttacaatcctttaactagacacagagtgctaattggtgcgtttttacagagtgctgattggtgcatttataatcctttagctagacaagagtgctgattggtgcatttacaatcctttagctagacacagagcgctgattggtgcatttttagagagtgctgattggtgcatttacaatcctttagctagacagagtgctgattgatgagtttataatcctctagttagacagaaaagttctccaagtccccatccaacccagaagcccagccggcttcacctctcaatcccccctctaaacaagacaccccaattgctgttggaaattgggcaatgactgctctaggtacttcttgctggataggggtgaagaaggggccctgcagttgtagtgtcctccagaggggaactctttaggccagtgaaagggccagcgggtcggtccagaggtcctcggtagaagtttttagttgagcttatttggggttccatttgtaagaccatctgtagcttgatggcctcgatcctagaggaaacaaatttgacaaggaggttaaaaattacttgcccaaaggcgagtaatagcaagatggctgccacgggacctagaaaggggagaagccatgttgcccaactccagagattggtataagagtttgaaaggcattgtctgatttcagaagccttttcctgtaaacgccaggcagcatctcatactatccctgactggttagtgtaaaaacaacactcttcccctaagaaggtgcagagtcctcctttctcagcagtgaggcggtctaggcctcggcagttttggagagtcactgctgccacagagtctatttgggattgtagagtaaggatagatttcgttatctcttgcaaactgtctgagaaatcctttgagagtgtgtggtagtaggataatgaagtagataaactggctattctggttcctgtaacagtggccattcctaaccctgtaagtaggggtattagttgtatggctctgtgctgagggacttgagctttgaggggtactgatagggtctgatttcctggggcaatgttaatgttgggacttagaaagactaaggtgcaggtgcctctccagttagtggggaggcagatataggttgacattgcacataagaatataccttggctgggtagacagaactggttgtgtatgttaaaaaggtgtgtgagtttgttgttttcattttcccatactcctagagtacttgctaaggtagctccagtgagcggctggaaaggggtgttgggagcaaactgagtggctccctgtgttctattttcccattggagaaaaaattgttttgtgtctactaggagccattcaagagagtgattggaagaggggatgagaaggcattcactagtggtgggggcgctgccacagggggtccaggggtgaatggtcatgcaaggagtatgtttgccattacaaaacctggactgtttgttaagcagggaggaggtgatgatttttggaggcgctgagaagcagacaagccatctgaatggagctgtttgagtgactcagaagttactatgattagttggggcttgaagttgtagggtgtaattacactgatggggtagtaggtgccccaggggcaggcctgataacaggttgcgttggatgcataaaggggaaagttaagatggtattcatagtaacaagaccatgtatgggcttttcattgcttgtgtaataggtgaggttggaaatgtaagaacgtaaaaattggattgcacatcctgttagggtattcttggtcctatcagagatggggaagttggctaatgattgcatatttagaagtcggaaagggtcttttccttcataacaaggatggtaggttaaattggtaaagacccaattttttgagggaatgggagtggcaacataagcagaggtggatagagagatacaaagccaacagtcatttgccagggaaggattggactggtttaacagagactgggttaagttgagcgtcttatagaggtaattaggagctagtggaaggggaggggtgattgtatgaggtatccaaggaagcagaggggacagatagacaaagagtaaatgggaaggtaaagagggtgctctggaagacgagatcattttatccaggctgagttaaaggtaggagtaaattgctgtcagaaggaaggataatagaaagaaggttgatgtgattaagattttcatcctggcaggagctacagtatatagtcctatcctgaagagtatggttagtatgctgcttagtaatataatgaaatagtaaaaggattccatcaaaggggcaaggagaagtgttaaagataaagattacgtaggttttcatttatcttttttaaggaggaaggggtttttttcaggatcagtggtaggagcccttttagtctggatgtttccttccaaaacagcacatgcaagtcctccaacggttcgcaggtgtatcgaggctggtctggatgatcttgggactcctgagctgatggtccctcaggttcctcagagggtgtccaaaatttaactcggatgtggtgaatccaagattccattcctgccaccttaactgcagtgggggtagagaggattaccgagtatggtccttcccacaaagaatccatacatggggaggtaaaggggagagatttgaccaacactagatctcctgtattacaggtgtgagccaccatgcctggccagactgttaatagtagaagtgaagtagggagggagaggaaacaaatataatgtgtttctgttttgttttaattttttatttttgagacagattctcgctcggtcacccaggttggagtgcggtggcgcaatctcggctcactgcaacctctgcctcccgggttcaagcgattctcctacctcagcctcctgagtagctgggactacaggcaggtgccaccacacccggctaattttttgtatttttagttgagacggggtttcaccacgttagccaggatggtcttgatcgcctgatttcgtgatctgcccacctcggtctgggattacaggcatgagccactgcacccggtctgaatttttaaaacaagcatagagtactttctttcttttgtagatggagttttgttcttgtcgcccaggctggagtgcagtggtgcaatctcggctcactgcaacctccgcctcccaggttcaagtgattctcctgcctcaccctcccgagtaggacaagagtgcaactccgtctcaaataataataataaaatgaaaataaaagaaagcagtaaaaaagtcagctgctccttttcttccctatttagaaaaaataactaggaaggtgtcttaagatttaaactatttgaattttattttgataaattgttttatatgaatcacataatgtagtgttcatacaagccccaccagtatacccttcccccatgagacagactaatatgcaacagtccagtgggttcaccttgcccactgcctagacagagccagtttctcaagacaggggaattgcaatacagaaagagtaattcagcagggcacagtggctcacacctgtaatcccagcactttggcaggccaagatggatggatcacttggggtcaggaattcaagaccagtctggccaacatggtgaaaccctgtctctactaaaaatacaaaaattagccgggtgtggtggaacatacctgtgatcccagctactctcgaggccgaggcagaagaattgcttgtacccgggaagtagaggttgcagtgagccgaggtcatgccactgcactccggactgggtgacagagcaagactatctcaaaataaaataaaataaaaagttaaaatgataaaaatgataaaattaaaaattaaaataataaataaagaaagaagagaaagagtaattgactcagagccagtagtgagggagatcggagttttattttttatttttttccaagccaaactgtatccagctttattaaagatactttccataaacaatcatggtatttcaggcaggacatgggcagacaattgttaacagtatacaacaactttcaaactcccttcttcaatggactacgaaaaatcagaaagccgctataaaacccaaagaagtcttcatctcatgctctgaacagggaaagtttagagtgagggttgacatttcacatttagcatgttgtttaacaacttttcacaagccgactctgactttcaggaagtgaaatgaaaatggcagaatttatctgaagatccacaatctagaaatggaaccactgctcttttgacaggtgccatctcagtggcatcactggaaagtccagattgcctgacacactggtaaccaatgactaggggtcaggtcccaacagatgcctgggattaaaggagttaagtctatgctgaaagatggaaagggagaagaggacataaaaacaaatttgtttttccacaccacaaggcttttgtgccaaggtggccatgtgtgtcaaagtcagggaatccctcctcctgggagccaagaggaagtctctcaagactagaagggaaaggtgctttctccacatcaatccagctttggagacattctgttagtgacatatgcccctcccccaacaaacaatgaagtgttctgtgtgctaacaacatagctttaaaagaaaaataaaagtaaaacaaaattctgcatttttataaaacttgatttaaaaaatggtctttcaaactgtacagtcactggaagtacacagttatcaaaaatgcacacacttcacttggcctctccagcaccttcagctttctgggcctggtctgttttggcatctccactttctgcagggctattcccctccttaccagcatcagcttttccctttttccctttgggtaccttctctgccttctttgcaggggtctttttaggcttgggctctggctttggaggagcaggtttagcagacaaccttgcagaccttctctgtggttcgtccttcaccttggctttacctcctttagcatccccttcagcctttctcttgggcatggtggtggcggtgacggtggcgggatgtaggtgctgtacgcgggatgcggcggcgcgcgggctttggtcggtcccggggtcgttctcgcctcttcttcttcccagacttttattattactcaaatcagtctccccgagcattcagggatcagacctttttttttttttttttttttttctgatacggactctcgttttgtcgcccaggctggagtgcagtggtgcgatcttggctcactgcaacctccgtctcgcgggttcaagcgattctcctgcctcagcctcccgagtagctgggactacaggcaggcacaaccacgcccgtgtatttttagtagagacggggtttctttctttttttttttttttttttttttgagacggagtctcgctctgtcgcccaggctgcagtgcagtggcgcgatatcggcttgctgcaagctccgcctcccaggttcccgccagtctcctgcctcagcctcccgagtagctggcactacaggcgcccgccactaattttttgtatttttagtagagacggggtttcaccgtgttagccaggatggtctcgatctcctgacctcgtgatccgcccacctcggcctcccaaagtgctgggattacaggtgtgagccaccgcgcccgaccagagatggggtttcatcatattggccaggctagtctcaaactcctgaccttgtgatatgcctgccttggcctcccaaagtgctgagattacaggcgtgagccaccatgcccagctgggatcaaagtttttgaggataatttggtgggtgggggaagccagtgagccaggagtgctgactggttggattgcagatgaaaccatagggagttgaagctgtcttcttgtgctcagtcagttcctgggtgggggccacaagatcaggtgagctagtttatctatctgggtggtgccagctgatccatcaaggcagggtctgcaatgtttctgaagcacgggtcttaggagcagtttaggggcggtcagaatcttgtagcctccaactgcatgactcctaaaccttaatttctaaacttgtggctaatatgttagtcctataaaggcagtctagtccccacctctttcgttttgggaaagagctgttatcctctttgttttaaactataaactaagttccttccaaagtcagtacagcctatgcccaggaatgaacaagaacagcttggaggatacaagcaagatggagttggttaggtcagatctctttcaccgtctgagctacgattttgcaatgacagtttcaatattctccagagcatcggcacctgctgccactctaggcatttactggcttgtcatctgcctcctgcaccagagcgtaaacaccatgaaggcgagaactttgccttgttctctgttctattctccattcctaaaacagtgcctggcctggcatttaataggccctcagtaatgtttgttgaagaataaataaatcaaccttgatcttcagaggaatgacaagataaatttagagtgtgtagcttgaatcgtatttcaacacaaatcagaaaccagaagtattgctaccccagttgacactgtcaaggaaaaacttctcctttattaggttcagcacttagagtatacaaattaaattgacaaacgacaagttagcaagagaaaagatctttattcatgtaggtatagaagttcacagaaaaatgtgacccaaggaggcagttagaaattggggcttaataagggaaggacccctaaggaaaaacaaatgacttttagtaaaaataaatgggtcccaaagagaatagctggaagatatgatggttttgaaactgcctttgcccagattgtgacagagtgagaagtctagcctggctgactccatcttgcttcgagcctcacaggctggctgtcttcactcatccctgggcataggccaagctaaccacgggaggaattcagtctatagtttaactttgaagcaaagatgataatagtccctctctaaaactaacccccttcttgctcacggacagaaaaccacctttgaccacctttgcaaaactaatgaaagtccacaagattaggattatgggaggggcctgaattctgttaaaatgtaggtgcagggccaggcacagtggctcacgcctgtaatcccagcactttgggaggccgaggtgggtggatcacctgaggtcgggagttcgagaccagcctgaccaacatggaggaaccccatctctactaaaaatacaaaattagccgggcgtggtggcgcatgcctgtaatcccagctactcaggaggctgaggcaggagaattgcttgaacctgggaggtggaggttgcagtgagctgagatcacaccattgcatccagcctggggcaacaagagcgaaactccttctcaaaaaaaaaaaaaaaagtaggtgcaatttgtttgtttgtttaaggcagggtctcactctgtcacccaggctggagtgcagtggcaccatcatagcttactgttgcagccttggcctccccagctccaatgagcctcctctctcagcctccagagtagctgggactatgggtgcatgccaccatgtcccactaatttttaaaaatttttgtagaaggcagagcatggtggctcacatctgtaatcccagcactttgggaggccgaggcgggcagatcacttggggtcaggagatcgagaccatcctggctaacatggtgaaaccccatctctactaaaaatacaaaaaatttgccaggcgtggtggcgggcacctataatcccagctgctcggaaggctgaggcaggagaatggcatgaacctgggaggcggagactgcagtgagctgagatcgcaccactgcattccagcctgggcgatagagcgagactcagtctcaaaaaaaaaaaaaagaaagaaagtactcacagggtgggagcaggctgagcataagggctcaaaagccctgttacagaattttctggggtttaaataccctctagaggtttccattggttacttggtatacaccctaggtaaatgaagaggatgaaataaagttacaaaatcatgtactcggcatatgccctatgtaaatagagaagatatttcctgtcatagctgaagtgttcccatttgatttttttttttttttttttgagagagcgagactccgtctcaaaaaaaaaaaaaagaaaaagaaaaacaagaagcactggcaagacataagcccctgcttagggagttcggatctgaggacctggcaggagagggaagagcctctgtccagaaggagcccaaggacaccctgaggacaggaccgagagaggagccctggcactgggcctgggatggcgcctctcttgccaggagtccgtgcgtaggctccggggtatgaggtctgggactgtgtccaaacagggcagactaattgggaagtaacagaagcatctttgtctttgcggaacttaatttctgtggttaatagaataagaggcaggagcctgggatgttgattcttagccttgtttcttgtcgttgttatttttttaatcttgaggtttcacaaataatctcagagatattctaaagatcttaaacgaatggaaagtaagtttagtttgctttaaatatatattatacatatatgcatacatatatgcatatatatagtgtgtgtatattgtgtgtgtgtgtgtgtgtgtttacggtaaagccccgaactgcagccttcagatgttggaattctccagaccctcctacagagggcccccagcctctccagaacagcccctcctgaaccaagatgacatggaaacaccatgtcatcttggaaatggtttcttctctgaaactgagatgccctcggcctccctgggaatgctctctgtagtcgtcctcatctctggagccacaaagactaggtctattccctttattgcataatagtccttcagtaagtggagttcagatctcaagtctgctctcttcctacggggacttggggaggtgtgttcctgtgtccctcacatcctgcttccctaagaggggccctatgtgtccttgttacttagaaccaaggacccttccccagagtacgaacttcacactggacgtgattctctttcttttattatgtttttgaggcagcctctcgttctgttgcccagaccagagtgcaatggcgcaatcaccgctcactgcagcctcaacctcctgggctcaagtatttgtcctgcctcaggcttctgagcagctaggactataggtgcatgccaccatgcccggctaacattttaaactcttgtagacacaagatggggtctcactatgttgcctaggctggtctcaaactcctggactcaaaggatcctccctcagcttcccaaagtgctgagattacatgtgtgagcaaccacactctgagtgatccttttattcatttgtttgttttgttttactttttattattattattttttttttttttgagacagtctcgctctgtcacccaggctggagtgcagtggtgcgaactcggctcactacaagctccgcctcccgggttcacgccattctcctgcctcagcctcccgagtagctgggactacaggcacacgccaccacgcccggctaattttttgtgtttttagtagagacggggtttccctgtgttagccaggatggtctcgatctcctgaccttgtgatctgcccacctcgacctcccaaagtgctgggattacaggcgtgagccaccatgcccagcctatttttttattttttgagatggagtttcactcttgttgcccagcctggagtgcaatggcgtgatctcggctcactgcaacctccgcctcccaggttcaagcaattctcctgcctcagcctcccgagtagctgggattacaggtgcccaccaccacacctggctagtttttatttttagtagagacggggtttcaccatattggtcaggctggtcttgaactcctgacctcgtgatccacctgcctcggcctcccaaagtgctgggattacaggcatgagccaccgcgcccagcctcgttttgtcttctaagagacagggtctcgctctgtcacccaagccgtagtgcagtggcacgatcataacacattgcagcctctaactcctgggctcaagggatactcaccctcagctgtttgaatagctgggaccacaggcacacgccaccgctcctagctaatttttgttgctgttgttgagacaaggtcttgctgtgttgcctaggctggtctcaaatgcctgggctcaagcaatcctcacaccttggtttcccaaagtgctgggatttacaggcatgagccactgtgcccagccaaaactatcagctttgcttgcaaatgtatctggaatccaatcacttctcacacatccactgccacaacctacaagacctacagggccaccgtggtctctccctgggacaaggcaagagtctcctcatcggctgggcagtggctcatgcccataatcctggcactttgggaggccaagctggtgaatcgcttgaacccaagagttctagatcagcttggacaacaaagtgagacttctctctaccaaaaaaaataaataattagccaggcgtggtggtacatgcctgtagtcccagctactcaggaggctaagatgggaggatcacttgaaccctggaggctgaagctgcaatgagctgtgatcatgccactgcactccagcctcagtgacagagcaagaccctgtcttaaaaaaagaaaggctgggcgcggtggctcacgcctgtaatcccagtactttgggaggccgaggcagctggatcacgaagtcaggagttcaagaccagcctggccaagatgctgaaattccgtctctagtaagtatacaaaaattagctgggcttggtggcacgcacctgtaatcccagctacttcggaggctgaagcaggagaatcacttaaacctgggtgccagaggttgcaatgagccaagatcaagccactgcactccagcccgggcaacagagcaagacttcatctcaaaaaaaaaagaaaaagaaagaaagaaagaaagtctccttattgagcctccctgtttcagcacctcccacacccccgtggtagactgtcttgggttgtggggggtcctactatccaggcccgtgggtagcccctaccaccgactctgggcttgaccatgggacctgttttggccaatgagacagcagcaagcagaggccatctgcacttgcacactgggactggccctcttggatcatttgtttttgggctacagcttccatgtgagaagctaggctggaccacaggtgagcacactttctctataaagggctggatagtaagtattttcagccttgtgggccttgcagtctctgttgaaacgactggattttgccattgcagcttgagagctgccatatacaatatgtaaagaaacggagcctgggcaacataggagactccgtgtttacaaaaaagttaaaaaaaaaatttagctggccatggtggtacacacctgtggtcccagccacttgggaggctgagatgggaggatcacttgagcctgggaggttgaggctgcagtgagccatgactggcagcactgcactccagcctggccaacagagcaagacctgtctcaaaaaagaaaggaaatgagtgtgtctgtgttcccacaaaactttatttataaaaacagaatttggaccctaggccatagcttgtcaatccctgggctagacagactactgaatgatgagaagccatgtggagagaccctgcagagtcagaggctctagtaggttgaataatgtcctcccacaaaacttcatgtttatccgcagcctgtgactatgacttcggctgccaaaacacagctccttagactgggcaatttacaaatagtagacatttatttctcacaggtctggaggctgggaaacacaagatcaaggcgtccacagatttggtatcaagtaaaggcctgctttctgcccctgctccatagatgctgtgccctcacatggcagaagagaaaggcagctccctccaacctcttttatgagaaccttaatcccattcatgaaggcagggctcaatcacctaccaaaggccccacctttttttgtttgtttgttttgagacagagtctcgctctgtcacccaggctggagtgcactggcatgatctcagctcactacaaactccaccacctgggttcaagtggtcctgcctcagcctcctgagtagctggaattacaggcacctgccaccgcgcccggctaatttttatatttttcgtagagatggggtttcaccatgttggtggtaaggctgctctcgaactcccgatctcaggtgatctgcccgcctcagcctcccaaagtgctggaattataggtgtgagcctccatgctcagcctgtcagtttcatccagtctcctacctttgcttttgatatcagtaccttaaggagactcattcagccagttagaaatctacccacttgcttttctgttcaaaatgcgtaagagaaatcttcatttctctcctagccccaagaattacctaagaggctctgagaaatgctgtgctgaaatccattctcttctcagcatttccctgaccaccaggaaacaagacaagcaaacaaaaaccccatttagtcagagaattccagtgcaggaggtgtggggactttacttccaaggacttcacttcatgggaactgtaacgtgtttgtgtgaaatcagaaagtctcttgtttttgaaacagagtttctctcgtcacccaggctggagtgcagtggcgctatctcagctcactgcaccctccacctcttgggttcaagcaattctcctgcctcagcctcccgagtagctgggattacagacacccaccatcacacccagctaatttttgtattttcagtagagacagcgtttcaccatgttggccaggctggtctcgaactcccaacctcaagtgatctgccctcctcggcctcccaaagtgtgggattacaggcttgagccaccgggcccagccgaaaatcagaaagtttctacccctctgcttaggaaatgccagaaaacatcaacctgagtatggggttggggacattttatcattggaactccaatgctgacacagtgtaactggcatttctgactgcaagctgcctctcctgactgcaaacctgttctagagagaacacagaatccggcagacacaaaagcttcctgagtgatgtttcgcaaatcctgaagctgctacagctaaattctaggtagttgtggtatagataagcaaatcaagacaaggttccttggactaacggtggtgttgtagcattttactggaatccgaggactaggggaatgaacaatcttcatcttggaggagcacaatgctgaggttgggggcgaggactggggaccaggctgcgttagttggtcctctggcacctcagccagcagctgctgcctccctgccccttggaaagtggagacgatcagatggagtgtgctcatggacgtgcttacaagattaaatgagttacatatacaagcatcctggtgtctggcaagtaacgaggcctcagcaacattattttttttatttatttattttgacacagagtctcactgtgtcgcccaggctggagtgcagtgtggcacaatctcagctcactgcaacctctgcctcctggactcaagcaattttcctgcctcagcctcccgagcagctgagattacacacatgtgccaccacgcccagctaatttttgtatttttgtagagatggggttttgccatgttggccaggctggtctcaaactactgacctcaggtgatctgcctgcctcgccctcccaaagtgctgggattacaggcatgagccactgtgcccggcccagcaactttattggtctgcgatagatgcagggagaattttctcattatcttgtggtgtgcctgaaggcgtggtgaaaccctgctccccacgcctgaatcacgccagatcactaccttctgaagaacgtggctcctcattttccatctggaactcagcaattgttacctgacctctcctcctctcaagacaagggccttcccaggggccggcactcctgcctccaagtgatgctgtgacaaccttaagaaactcagcggccgggcgcgatggctcatgcctgtaatcccagcactttggaaggccaaggagggcggatcgcctgaggtcaggagttcaagaccagcctgaccaacatggagaaaccctgtctctactaaaaatacaaaattagctgggcgtggtggcacatgcctgtaatcccagctacgagggagggtgaggcaggagaatcgcttgaacctggtgggtggaggctgcggtgaaccgagatggcgccactgcactccagcctgggcaacaagagtgaaactccatctcaaaaaaaaaaaaaaagaacctcggcaacaaccttaagaattttgtgaaaaagagggagggaacagagacacgtgaaaagaaaactggctggataacttcctgcagatactatttagggatattagtgccttctaggtgtccattctagcttgaaacagtaattcccagactgccgacctccccctgagactattatcacatccatcccaaagataaaggcgctggggccctgagggaggccatgctgagctctttgatgccaaatagagatgctttcctctgatgcctgctgagacagactttccagaagttgttctccctcggctgtcacttgggtgccccttcatgacctctgcccaggggaactctgctcccagcttccccagctcccctgggccttcttgcttaatcacctcccctttactcctctcatttggacaccctgaggaatgccaacctagcatgacttgccagcacatatactaaaaaaaaattggaatgatacagagaagatcagcatgggccccgcgcgaggacgtcatgcaaatctgtgaagtgttctgtacttataatttttttatatatatttaaaaataaaatacggctgggcacggtggctcacacctataatctcagcactttgggaggctgaggcgggaggatcaagaggtcaggagatcaagaccatcatagctaatacggtgagaccccatctctactaaaaatacaaaagcttagccgggcgtggtggcatgcggctgtaatcccagctaatccggaggctgaggcaggagaatcgcttgaacccgggaggcaaaggttgcagtgagccaagactgtgcccctacactccagcctgggtgacagagagagactctgtatcaaaaataaaataaaataatataaaataggctgggcgaggtggctcatgcctgtaatctcatcactttgggaggccgaggcaggtggatcacgaggtcaggagtttgagaccagcctggccaacatggtaaaaccctgcctctactaaaaatacaaaaaaaattggctgggcgtggtagtgggtgcctgtaatcccagctactcaggaggctgaggcaggaggatcgcttgaatccaggaggcagaggttgcagtgagtcgagatcgcatcagtgcactccagcctgggcaaaaaaaaatgagactccttctaaaaataaaaaaaaaaaaatcattttaaaaagcaagggaatagaccaggtgcggtggctcacacttgtaatcccagcactttgggaggctgaagcaggtggatcacgaggtcaggagatcgagaccattctggctaacatggtgaaaccccatctctaccaaaaatacaaaaaattagctgggtgtggtggcgggcacctctagtcccagctactcgggaggctgaggcaagagaatggtgtgaaccggagaggcggaacttaaagtgagctgagatcagccactgcactccagcctgtgcgacagagtgagactccgtctcaaaaaaaaaaaaaaaaaaaaaaaaaagcaagggaataataaaacacaaaatttagaatagtggctacctctggggtcaaagaacatacaggggacctaaatgacattactaatgttccatttcttttttttatttttttgagaaggaatcttgctctgtcgcccggctggagtgtaatggcacactcttggctcattgcaacctccgcctcccgggttcaaatgattctcctgcctcagcctcccgagcagctgggagtacaggcatgtaccaccacacccggctaatctttgtatttttggtagagatggggtttcaccatgttggccaggctggtcttgaactcctgacctcaggtcatccacccgccttaacctcccaaagtgctgggattacaggcatgagccaccgcacccggcctccatttcttttttcttttttttttttaactttccatttcttttctttttttaactcttgttgcccaggctggagtgcaatggcatgatcttggctcactgcaacctctgcctcttgggttcaagcaattctcttgccttagcctcctgagtagctgggattacaggcatgtgccaccacacctggctaattttttgtatttttagtcgagatggggtttcaccatgttggccaggctggtctcaaactcctgacctcaggtgatccacccccctcagcctcccaaagtgatgggattataggggtgagccaccatgtccggccccatttcttcctttgagacaggtctttatctcccaggctggagtgcactggtacaatcatagctcattgtaatcttaacctcctgggctcaagtgacactcccacccgagtctcccaagcagctgggataggactacaggcatgtgccacatctgcctaattttttagtttttacagagactggggtctcctccatgttgcccaggctgttctgctgttctggaactcctgggctcaagcaatcctcctgcctcagcctccctaagtgctgggagtactgatgtgagccactaagcctggactctagggttccatttctttctttctttctttttttttttttttttttttggagacggtgtctcgctctgtcatccaggctggagtgcagtggcgtgatctcggctcactgcaagctccgcctcccgggttcaagtggttctcctgcctcagcctcctgagtaactgggactacaggcgcctgccaccaagcccagctgatttttatatttttagtagagacggggtttcaccatgttggtcaggctagtcttggaactcctgacctcgtcatccgcccgcctcggcctcccaaagtgctgggatgacaggcgtgagccaccgcgcccagcatggtgttccatttcttaagcgggatgtgggtacacagagatttatatacgctttatgtagtctctggtgtacgtgaaatactgagtgatgaataccaaaacctcatgatctgttatgaggagggaccatccagctacatccccttctgcactcatctggtatcttacctccccagagctccttatccaaccctgaagttccctatctggctggagaccctctttcacaaagatccctttctcaagctgaccagtgatttttacacacgtatcacagggagaatcagtaatccaagcgagttacaggtcgtagcagattcactctcccttgatcccggccacctgcagacaccatgcatgtgttacctacagtgcttcaaggtgtggtattctgatagctttggacagttattccccacctgcccaccaccaataaaacttctcaacaagcttacagcaagtgagaaataataactaaatgcaatgccgttgtgctgactacaagcaaatgtgaaccccacagcctgctaacaaagcctaaggagctatggaaacagggagggcatttggcagcctgtgaattttgaaaaagatttcaggacatctctagtaatcattaacattttagctacaatgtgaggtcgaagtgctggctcagaatgtggcgctgcagcctccaagaatcttgcaacggcagcagtccgggatcatgttcggcctctgatttcctgctagatttactggttctggccacagcagagtatctttatctctctaaccatttttatgtaaaataagattgtttggagccctttcagggccacgccttagaattgctctgagagtaccaagtgcctgatttcttagagtccttaccagtaggagatgttggctgttgatttagctgctgagtcatggggctggggatagtggttttcagtagccaaaaacgttagtgtgttgctggtgaaatcacaaactctgcttgcaaaattttactctttttttttttctttttgctgaatttaatcctaaagttcttgcttcttactcactggaaagcaaatactatggtctcaataggccttaatttttaaccaacgccatggaaacctgtctgtagctaagaggataaaaatgctaggggttaaggaagaaaagcaggttttgcagctgaccagaagaaataattaaattcaagtacatatttgaacacctctttacaaggaaatgaggaaaatcagatgttttagttctcttacagaccagcagtaatgttgaaaaatataaaagtagccgtaacagaaaacgaagtgatcatctcagccctcccttggagtggggggatatattgcggagctgagttttaatggctatcagttcttgatcagaaaagtgaaatcactccaactccttccgtattccacggaatatgacccgtcttgaactttgagaaattccccgggtctgtgtgaaattccagttccaaataattcacatgaatggttcacaagaatccaggtaggtttgatctagttccctagatgggaatgagagggatgtaaaatttgagaggcaacatgacatggactagagagagaatgaattaacactggggaagcacgtgggggcgcgccggacacctagaaggcactcaaaaagtatgaggtagaattaaaggaaagtgaaccttcctttggctgtctcggcctgattctcaccgcagcaaggagaaagggacagggtcaccttggcgggtgccaggcggagcccggccagacgggcgcggctggagggcagcgcgcaggcgcaggcggcgcacgtggccccggacacgcagcgctgcggcggggccagcgccccaaccccggagtggggccgaggcgcgcagcctctcaacgactcgacgccaacggggtctctcggatcgcggcgcgaggcaggaggggcggggcaggagggccgcggcaggcccgggccgccaaagttgtcagcaaggtcgagggccggacgtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctaggtaatgattggggaagggctgagcaacgggcaggcggcgcagggcttttctgggcttgtggggctcttttccctccgagggaggcggcgcgcccgcaggcccagcgtggcggggtcgggggcacgtgcaagccgcctccctgggtgggaactggcgcccccgctcaccccgaggcccggggcgggggcgcaatgccaggcgcacgtgctgggcccccgatttctttggaggggaaagtgcagatcaacacgtgattaccgactgcggggccgagtcactgtcagggaaggtcgggagctgcacacgcgagctgcttagcacagcgggagttgggagtggaagttgcttttccatcgtagccaagtgtaaggtttttgggatagacgcagacttagcggcggtggccactcaggccaggcccttcctaaaatggaggagggcggcgatagtggagatggccacgaggctgcggccccctcccccaccggtagcccccgcctctcgcccgcgctcgcggcccgcgcttctgcctagtaagcggtgactcatttaactccgagaaggcacctcttgaggaacctacagcagagccgttagatcattggcaagtcctccaggcgacctcgcccaagttgggcaagagcggctccccggctggccaccaaaaatcgggcctgatctgatttggtttttttttttttttgagttttgctattgttgcccaggctggagtgcaattgcgcgatctcggatctcggttcaccgcaacctcggcctcctgggttcaagcgattctcctacctcagcctcccgagtagctgggattacaggcatgcgccaccacgcccggctaattttgttttttttttgttgttgttgttgttttagtagaggcggtgtttcaccatgttggccaggctggtcttgagctcccgacctcaggtgatccgcccgcctcggcctcccaaagtgctgggattacaggcgtgagccaccgcgctaggccaagaaggatgtattttaagaaagcttcctgttcaatgttcccctgctctgtgcgcttctctgggcggtagggtccattgcttcacttgcctttcaggcccacccgggccctgactgctccattcatttaccgtgtccctaattcggggttccatccaggcagctaaaaaagctgtgaatggtccgggcgcggtggctcacgcctgtaatccgagcactttgggatgccgaggtgggcctcctcaggatcacctgaggtcgggagttagagaccagcctgaccaacgtggtgaaaccccgtctctactgaaaatacaaaaatcgaccaggcgcggtggctcacgcctgtaatcctagcactttgggaggccgaggtgggtggctcacgaggtcaggagatcgagaccatcctactctactaaaccccatctctactaaaaatacaaaaaattagccgggtgtggtggtgggcgcctgtagtcccagctactctggaggcggagcctgcagtgagtcgagatcgtgtcactgcactctagcctgggcgaaagagcgcgactccgtctcaaaaaaaaaaaaaaatcacctgggcgtaatggcaggcgcctgtaatcccacctactcgggaggctgagacaggaggctgaggttgcagtgagccaaaatggcgccattgcactccagtctgggcgacaacagcgaaactccgtctcaaaaaataaaaaaaaaatcacactttattttcacatcctaagacgtttgtctttttttttttttctgagacggagtctctctgtcgcccaggctggagtgtagtggcgcgatctcgactcactgcaagctccacctcccgggttcacaccattcttctgcctcagcctcctctcctgacctcgtgatccaccctcctcggcctcccaaagtgctgggattacaggcgtgagccaccgcgcccggccaagactttctttcgtcttaagtcactaaaatgaaaacaaaagtactgaggcaccctaataaaattgcctttaaaagtatgactgaaatactcaaagtataccacagtggtggcctggagatggggcagggggatattgactggaaatggcctgagataactttttgcagtgatggaaatgttactcgggtatataatttgccaaaacgcaaaattaaatctaaaaatatgtttaaacaaatttgcctttttggaacctagtaaaaagtaagtacctttttttggctaatgaataaaactccattgttacatagacaacaaagccacagaagtgacttcagtaaataattttgaaagttaaaaacctgccacttgccacctcaggacattccagagaagatgttggaggggagcccaggtagataatggctttaaacactaagttcctctcacccacctcagttctataagttgttcagttagtttctttggagagcgccaaggaaaaaagtaagaatgggtttttctttgaggaattggtatttgttgttcattgctggaaattcttgtatttttttttttaaggtggtgttaaaggaagccccttcccttgaagtatcctggtgttcaaagaatctttcctctatttacaaattataaaaccccgttgggaagaaataattagatgtcattattggctggtcctggtggcttacccctataatcatcctagcatgctttgggaggccaaggcaggggaggatcgcttgagcccaggagtttgagagcagcctgggcagcatagtgagaccgccatctcttaaaaaagtaactaaaataaaataaagatgttatcattaatgacataacaacactgaagacccaagtactgtgaaattggaaagtcccaggaagtggcagtagccaagatcacacggtccaaggacttcattgttcctgacttccaaactcagaatttctgatcaaatacctactaagtgaatattaatctgaagaattatgtccaaacttcattcactattttgttttaattctgctacaagcaaggttttcccctggtcccgccaccctctttttggccctaggtggttttgcttgtgaccttcatgtctgttcttggttcctttccattcccatgccagccctcattgttcactcatgacaatagccagtttcagacagctcctgggccactctgcgtcgagcaacacattcatctttctatttggatttgattctccctgggcacacacgtttgtgggctttttctctctctttttttttttttcttttttcttacagaacaagacctcaattgctagggtttaacccatttatgccagaggttgcaaatctttttttgtgaaaaatcagaccttggcaatgacttgagcagtcggataaaagtaactcccacgcccttagcgttccagtaatggaatactaggcataaaaaggttaaggccttccgcagctaggccctaactacttaattaggagaattctcactgctttccagcaggcttttccccccaccctagccagctttcctacatccagtatttagtccagtgctgattctctctagtccacgaacctcggaagtgattccttgaatgagtgaggaaatgcagcattatggcttatggaaaacatgaactgtgtgtttcttctacagaagttcaccatgtctattctcaagatccatgccagggagatctttgactctcgcgggaatcccactgttgaggttgatctcttcacctcaaaaggtatgtgccacctccttggtttccatggttccttccaccgtgcttcattttaaaaattttctacaaatgctggagccttaggaaaaaaaaaatctgttaaagcttttctttctgtctgcacatgctagtaggttgtgattcctgactgtgagggttggggaatttttaggcatggagccagtgtcttgctgtttctcggcttatttttttctttttctttttctttttttttttttttttttttttgagatggagtcttgctctgtcacccaggctggagtgcagtggcatgatttcagcttactgcaacctctgcctcccaggttcaagcaattcttctgtctcagcctcccaagtagctgggactacaggtgtgcaccaccacacctggctaatttttgcatttttgggagagacgggggtttcaccatattggtcaggctggtctcgaactcctgacctcactcaggtgatctgcccgcctctgcctcccaaagtgccggcattataggtgtgagccaccccgcctgatcctgccagctccttggcttaaaaccacataagttggctcctaagtcagtgaagtaaggaagtaaggtgataccacaagaccttgtccctaaaggggcccatcactagttgttggctgacagcttgctgtgaccaaatgcaggatacagtgtgataggatggtatctcttgataaggggagggatagcaggtgtgaatatagcacctttatctctgtgactagaaatcagtcttcagcaaggatcaaggacagtttttacctgtaggctttggaatagtctggaggctctcatttttacctggctgtcaatccctataggaggagttttcttatgaaaaattagagaattgtgaaactccttcctttaagaagaaaatccagtgcctttgtagctctgtgttacctccagcacatggcgcgatggacagagtgggtgaggttggcaaaggagcttcaggcagaatcactcagcggtgctaaactcacagagaactgccagtcggagctgagtcaccatctgtgagtcacaggcctagcagtggaaccccagcccttcccttccccttgcacctcccctccccctcaggaagaaaggatccttgaggcctgacttcgttgggcaaaagaatgcctgagttggctgcttgctgtgtgggctctcaagcactgtggggtttctcactggctttatggggaaccctgagggttctcacaggatgccaagaattcccttcatccagtaagagtggtttgcttagtcaatgggtggaactttctacttggatattaatgaactttaagcaacaaaagaccccagatgctagaagattgttgggagttggacattttgaaattgaaatgaatggaactttctcttgtgtgtcttaatccttttcaaaaaacatgaaatgatggacttgctcagaacctttcatctctctctctccctgtctcatcaacttttttagagcagttttaggttcacagcagaagcaggcggaaggtgcagaggtacataaacccatgagtacccactgcctctgcacatgcgcagcccccccattgtcagcatccccactagagtggtcaacatgcgtgaacacgttatcatcaccaaaagtctgtagactccaagcctcttgttttcatcttgtctttgcctgatccagtgtagggtggatatgtagggagccagggcagctttcaagaaggaagtatgacctgttgatagcgcacactgcagtgcagcagggaacactgctgggtcctttgctagaaatatcttgttggtttctctgcaacatcttccttgacaccatctgttcttttgcctccaccaaagattgcccttgttacaggtataggtttcaccagatggctggtttcagtatctgcaagattacttggttcagttcttacatttattaaactgcgcattttattatctttattccttccccccacatccatcctgtttgccagtttccagttgggcatagaacccctaaaatagcatttagcattgtccaaactgaaacaaatgagctagatactcctcctgagccagttaaattaccctaattttatgcttaacatcaatatagtacctgtctgggcatggtggctcatgcctgtaatcccagcattttgggaggccgaggtgggcagatcacctgagatcaggagttcaagaccagcctggccaacatggtgaaaccccatctttactaaaaataaaaaaactagccgggcgtggtggcaggctgctgtagtcccagttgctggggagcctgatgcaggagaatcgcttgaacccaggaggtggagattgcagtgagccaagatcacgccatacactctagcctgggggatagagcgagattctgtctcaaaagaaaaaaaaagtaccagaacgtcttcaatgccctgtgtggctcgcattggatttctcttgggcagtgctgctggagtaatccacagggcaccaatgcgagcttgtgagggatgcatatttgcctgggtcagaatctacattttaacaagacctccaggtggcatgtaggctctgctgtagaacactttctttctgctagaggaattagtcatctttgcagtaagttctgcagtacaggatcataaacatgtgaaaggcatgaagaacagcccagagcgtttaattcacacagctggtaggaggaagaaacagctccctaatgacaaatgcatctgtgggcgggaggggacttgggattgtgctggaactggatttctgaattgctactacatcttttttcctctcatccaggtctcttcagagctgctgtgcccagtggtgcttcaactggtatctatgaggccctagagctccgggacaatgataagactcgctatatggggaagggtaagccttagaacccacagcccatggcctccctgcttccagccccattcctggccttgcccagtcctgtcctctctgggtggcacttgcacttgcaggtttatggcaggtaaacctgctgtgacccatgatgttgatggaagcagtgcaccaccttgtggacaggaaagttggtgtgtggattccggggttcccgagcctgcatgctctgggtcgagagttccaatgcttgcttctattgcagtttgttcccaatctgcgaaatactccttcacggttaggacaggaacccaagcatgagaacagggcctgttaactaaagaaaagtttccccatctcccaggagggttctgtgggccctccagagatcatcagcctcttcacgggctagaaaggatccagggaaggtctaaccaatgacctgccctgaatggtgagctgcaggtgtgtcatttagtgtgattttcctgttgactgactcataggagccctgctctgtggcagagctagcctctggctgtattcaaattgacttagtgtgtgtgcaacattgacctttctagagatagaacatgtggccaaattacagaaaagcacatagggctagatcacgcattctcagtggggcacccggaaaactccaaaaaggctgcagggaggggacaatgatgaaatcaggttgtgaaacactgggctggtgtcgcagtggtggtgctgggtgttcagtcccgctttaatgctgtaagaagcactctacacacacgaacatgttaccatttgaccgttgtttaatggcgtacgtggggacttagccggagcaggatgatgctgtgccttgatggtaatgagtgctcagtaagtaagcatttgtggaagattgaacgcatggcccctgaaatgctctcctctgctttcctgccccctcactgtctctcactcgcagtccttaatcaccggttctcttctgagtctctctcatttttccttcttcatcctctgctgggcaggcgtctccagacccattaagtatattaatgagttcctggcaccagccctgtgcactcaggtaactgattgaacagcctttagtctgcagttggcgtttccagtgcatggtcttgcaaactaacctccagtcagatcgttctgagccagctgctgttttgtgtggctctaaccctctggggtcctaggtaggagcactcagactgggccggaaagtcctccgattctggggggaaaggggagagggggaagaggtcccacagaaggtcccttggtgggcttccgcgtcggcctcaacagtggttctctctaacaatgctgctcaagcctgttttaaagttaatgtcagtaatttgatttgattgttccttccaggtgtctcaaaggctgttgagcacatcaataaaactattgcgcctgccctggttagcaaggtaggacctgcctcctgataactaatgtgtctaatgccaccagagcgtctcccaggcccaggggctttcctgtttatggaagagcttattctgagagctgtagaagcctattggattccctgtcacgcacgagaacaatccatgcatgacataattctaacctgcccgctgcctcaccccacttttgggagcagatggaattgcatcagaagaatgagacacttcgagccctgaggtttcttcccccctgcaactctctggacctttgaagaaattaagatccagattttaagagtggctctcaggggtgtttgtggtagtgtccatggtgactaatttctcatgaactttggaattatttactataattctactgactttaacagtggagttcctgttaagtaaaatctggaaatctcagtatgtcaaacataaaagagctgctggaggtgaagtagggctggggacccagcaacccacccgactctgcaggttttatctcatttaccctcccttcggcccgtccctccgtaattcctgtggcgctcatcagatgggactggtttgaaaacccctgtctaaaaacactccgggccaggtgcagtggctcacacctgtaatcccagcactttgggaagctgaggtgtgtggatcacttgaggtcaggagttggagaccagtctagccaacatggtgaaaccctatctctactaaaagtacaaaaattggccgggcatggtggtgcacgcctgtagtcccagctacttgggagtctgagacatgagaatcgcttgaagctgggaggcagaggttgcagtgagcagagattgtgccactgcactccagcctgggcaacagagtgagactctgtctcaaaaaataaaaataacaaagctctctaggcccagtccaagcccagccacagcctccgtctattcttgaatctagtccctctcctccatgaattcattctgtacacgagggaaaaggaggagttcctttgttgtctctgtccctgactcgttggtttaggcctggcttttgtggcactctgtaattactccctgcccgaccagcccccagacaaaatgtcttgttaccgttctgtctgcaccaccccctgccagtctcccggacacctccacacataccttgttctctgtcccttcatacccctgcatagtgtgactcacacgatgagcaggatcccctgacttttttttaaccccctagagaaacataccaaactgttagtgagaattgacctctgaagctgtgtgcttgggtaactgcctgcctgttgcagtgatgccttgacaaagctgtgaaagacaccaaattgctcatacagcatgatgggatcagagttgattttctttgcatatttttttatatcaagcacatcatagataaaaataatgccttgttattaatatattagtttaaaatggaatgctgatttttggctgggtgcagtggctaacgcctgtaattccaacactttaggaggactttaggaggctgaggtgggcagatcccttgaggccaggagtttgagaccagcctgggcaacatggcaaagcccatctctataaaaaaaaaatataaaaattagccaggcatgatggtgcatgcctatagtcccagctgagtttggaggatcatttgagcccacgaggtggaggttgcagtgagctgagatcgtgacactgcattcctgccttggcaacagaatgagactctgtcttaaaaaataaaaattaaaaaattaaaaagtaatactgatttttattggattactttgagccagttctcagtacgtcagttttgttactttatagtctcatcaaaaattcattttgatccatcattagacgctttgctaaatgatttcggactacctgcagaaatcatgcctcccatcagaggatgaagatttgccatctttgcagttagccaagagtgagcagcagagcctgcctttcaagggctcagcctgcttgagtgaacagtgagctttgcttatttattgcctatgaaagccatgttcctgggtagcagtggtctacatagcacatacctgacagttctcttgggtgtaaagtcactttgggctccctgggtagactattaaccttttgttacaaaagcattgtctgagagtgccatctctgttgcattgttgggtgaatgcctgataaccatcaaagcaagcagaaggcagttttttgtctccccactgatttttgtcctccactttttttgcttataaaacaaacatcacagaattgattttgatattacacagttccaaagtcagattccatggtaggggagcaaaggctatgcagataagagtggccccaacccctcattctcccctctccctcgtagaaactgaacgtcacagaacaagagaagattgacaaactgatgatcgagatggatggaacagaaaataaatgtgagtggcctgaggtggcgtctttactggggaagatcatgaagtctcctgaagattttaaaacctttcaggaagaggcccatgatcttagtgatgagctacatgagcctgtggtctcttcccatttctttgctttactcttaagaaatcacacttttggccaggtgcggtggctcacgcctgtaatcccaacactttaggaggctgaggcaggtggatcacgaggtcaggagatcgagaccatcctggccaacgtggtgaaaccccgtctccactaaaaaatacaaaaaattagccaggcctggtggtgggcgcctgtagtcccagcaggagaatggtcccgggcggagcttgcagtaagccaagatcctgccgctgcactgcagcctgggcaatagagtgagactctgtctcaaaaaaaaagaaaaaaaaaaattttttttgaatatcaggtgcaaaaccaggtgacaatagcctgtcagtttggttactcagaagagctttgctccttataatgaattcagcaattcctactgttggctggagttgggctctgtcttagaggggaaaagcagtggtgagtccacatagaatgctatttgtatttctagtaacagtgaaatggaggtgtgatgggggaggagatggtgcagaatacaaccctcagggcagtacagcaggagaaaagctggtgaatcagaaatgacttcattccactcggttctcttctgttctagctaagtttggtgcgaacgccattctgggggtgtcccttgccgtctgcaaagctggtgccgttgagaagggggtccccctgtaccgccacatcgctgacttggctggcaactctgaagtcatcctgccagtcccggtgagtggtttattggaacttcccaagcaaggagttgggggtttcagcttgctgttggggacccgagacctcctatgccttgatatcctaacacatgtgactctcccagcacagctctgccccttgttaagtgtgaccttgagcaggtaactcaacttgcctgtgccccaggtcctttatctgcaatggaggctcggggaggaaatgacagcagtactttccttgctaggctgtgagcattacctgacatagtcacaagtgtttctcctggtgatgatgaatttgcagttatcaaaatagacctggcgtgaactggttgcagtagcgcacacctgtagtcccagctaatcaagaggctgaggcaggaggatcacttaaacccaagagtttgagaccagcctctaggcaagaccagtatagtgaaaccctgtctctaaaaacatgagtcagagacctggtgagcatttcacagcaccctggcccctctggtgctcctcaagaagcaagtcttgggctcatctgtgagctagattgggatggtaggaccagaggggcttactgccctgtggggctctctggacccagtgccatgcttctctgctctgctctccccaggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggtaaaggcgctagggaaccgcccccccacccagccctgcagcgccagctccctctgttggggggtcgtccacacctgccactgtggaaatctattctttccacctgtagtttgtaaagatcaagacccttcaaacggttttaaggaggaaaaggggagcttcattttattttacttatttttttctttttttttttttttttgagatggagtctctgtcgcccaggctggagtgcagtggcgcaatctcggctcactacaacttccgcctcctgggctcaagtgatacctactagtttggggagccaagtgtctgtccgtctgtcctgctggcagggcagcttagccatggacagcagaccctgagcctgagctctcaacggcacagcctggcgggaggatcctgccatcccgggctgcctccactgggctttctcttggaccccgcttctgctctatttaaggcctgtgccttgggacagctgatctcagctgcttactgtaactgtatcttggccaggacagctgttcctgggcactaaatttgggagcatttgtcagtgagaagggctgctttcttggaaagagagctgaatttcccattttgtatgcaccaagaactctgacccatggtttcttgccccaaagcagaaaaaaagtaactgatgtcagaactactggttggggcctgaacacctgttgatctttgtgttacagtccctgtgtagcagctgttgaagggaagttttctctgtacctacctgttttccaaacctgttgtcaccatctcttcccaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccaggtgagtgttccccgagtgccatctccctttcctgccactgacctgcagcagggcagctggagcatctggctggctggtgatggctgcaaggaggggatggggagggagtgtctgaacttccagctcccgtaggggattcaccactgggtttgcccccagttgtgcatacacagggcttcacagaggttcttgtgtagctaaggagctcgggtgccagcagcgacattgcataataagttgttcacagtcaggagcagaggcagtctgtgctccattagacaggtgagggaaccaagccttcagaatcagaacagccacttggtactgagatgtatcatgcttcctgtgagctgggaatattcattttaggctgtgtgtgtgcacaggatagagactgtgaccacctttctacaggagaggaagctgatggctggctgaataatctgcccgagagcacacagcaaatggtggggcaagaattcagaccaggaaatctgactccagagtctgtgtgtttaaccactaccctaaataacttggtcaaggttgagccaagacccaaactcaggtcttctcacttctgagtctgtggctccattctgattttcagtggcactaaactcaaacaaccctagacaaaaagtgtcctcttcttacaggtcttaaacaaaatttttgaggctgggcatatggtggctcacgcctggaatcctagcacttggagaggctgaaacggcatcacttgagcccaggagtttgagatcagcctagggaacatagcaagactccattgctacaaaaaaataaaataaaataagtagctgggtaggttggcatacccctatagtcccagcgactcaggaagctgaggtgggaggatcatttgatcccaggatttcacagctgcacttagctatgattgcacccctgcactcaagcctgggtgacagagtgagattttttttgttttagatctatagatacccaggattgtgggtgacttttgtcccctgctgcaggagtaggctggggcacattgtttcaaggatcagttggggagctgtccccatcctatgcttttgggcattgtgaggccaggcgagcagcaagtcaagggggaagcaaggctgggcattgcggtggagcacactgggaggatcacactgatgaagcgtgtccctcctttccttagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtaagtgtcttcccaggcgagcagctttcccgcagctacggcttgtgaatcagaaaagggcccttttgttctggtgatggggaatcctgctggccagaatgtaggactcgctggaattttaacaggttttgtgtttgaactcaggagccttttaaattaaacaattggggcctgtaatcccaacattttgggaggccaaggcaggaggatcacttgagctcgggagctcaagaccagcctgggcaacatagcaagtagttgtattctgtgaagagctctgtcagagaacactaatctttctcccatcaagggaggctgaacccagtgtttcaactatgacaggagggctaagaaggtcctgggggtggaagagttcaggggagggtgagggttctcctctgtgctcttgacaaagcccaggcatggagggctttagccattaacagcccctccactgctttcctgctggcaccgaggggtaatggcattgggggttatggaaccagaaaatgggatcatgccatctgggttgttccttggcttccaggtgcaagctggcccaggccaatggttggggcgtcatggtgtctcatcgttcgggggagactgaagataccttcatcgctgacctggttgtggggctgtgcactgggcaggtaagaatgagcgtctcctcctttcttctctgacctcaacttcctaggaagacccaaaaccagtgaggctccatgtctgtccccgttttgctcatgtcccctgagtcagtgctcttgtttctgaggctgaacagaatgggggcatgagcgccctgcctgtatgttgtggcccccactttcctagcatcagatcctctagaaattctctctctgacaccacaccctctccctgccagaaatgcctgcaaagcttgtccgctgtaagcaaatggcctttcttttctcctagatcaagactggtgccccttgccgatctgagcgcttggccaagtacaaccagctcctcaggtaaggagggctcctgagaacaaggggcctgtggttcactaggtgggggcctgcactcagtgtaggcactgccctcccccaggagctcctggctctgggaacatgtacaggtgcaggtgcacagtgcagacagccaggccctgagcaggcttaggtcaggacagagttaggcctagactccccctacccacccactgcagcgccaccagaggcaggagcctgttccacacagtgctgccctcttctggtgagaaagaatgggaccccctttgacagctgatgcatgactttcttagagctttcagagagctccttcatatgatctgtttcagcgcatttaacccctgtttgtggatgtggagccagggctgggagggaggaagaaaaggccgaagggcacatggctgggtttccacttgtgagcgctgtggggctgttctggtctccctttcctgtctgtgtccttgggaagcccctgaacaccaggagacttgtccccccgcccgccaccccgctaagttctcccatattaccccttcattcaaactgtatcctggaaattttcaaacatatacaaaaaagcaggtgaacagtagacgcagggcttttttgttgttttgtttgtttgagacagggtcttgccatgtcactcaggctggagtgcagtggggcagtcatagctcactgcagcctcaaactcccattctttttttgctggggaattttatttttatttttttgagagggatctcactctgtcgcccaggctggagtgcagtggctcagtcttggctcactgcaacctctgcctcccagattcaagcaattctcctgtctgagcctcccgagtagctgggattacaggtgcccaccaccatgcctggctaattgttttgtatttttaatagagacggggtttcaccatattggtcaagctgacctcgggtgatcctcccactgtgcctggccccaaaatgtgttggcctttttttttttttttttttttaacatcaagatccaaacagctcacacattttgtcttttaataaggtcactctccttttctccccatgccatttatttgttgtcccttcaatattttttaaaaaacaaaagcattagaatttttatattccaagaaatggcaatgctgacattttactttgctcctctgcaacactgacggggagaggagaggaagagaaggggcggtgggtggagggcacctagcatggtgagttgggatgaggagaactaaatacttttctatatctggcttctcagagaagcacaagtttagagggtttaaagaaggtggacaaactggagagttctgtgttctcaacttcccaggagtggggctgtgtctttgaccacatctaggatgggaaaacttaaaacttgaggtctgacttttcttttttcctccccatctctttacctttctccttcccaagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 38173 - DNA, 29429 bp, Homo sapiens
cgcgcgcacagagcgagctcttgcagcctccccgcccctcccgcaacgctcgaccccaggattcccccggctcgcctgcccgccatggccgacaaggaaggtgagggtgccggggccgacccaggagggcagtgggtgcctgggctgagccgcggcctcgacatggcctaacagtgagggcaggcccgagtttgccgagtgcagtccccggtactgaaggcgtgaagagggaactccccgcggggcgtgctaacggctcgccagttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcggagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatggttaggctgtaggagtcatgcaggtggctttgcagaggattactcggtttccgtttgtttgctaacttaaatttgtttttaaaaattttagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccaggtgacatgactctcccgaacgttattttgatgtattttcagtgtagatttctcatattgattttcttttttccgctcttcagtcacccggagaaggcatgtgatcaaaacctcttggtgacattttttctaggccacaaagtaaggcaaaataacaaaatgattttgtaacttacctgacaagagaaaacatattggcgtttttttctcaatactgaattaaatagctgtagctgatgataatacctgtaataatagtggctgtaccaaataatagtacaaaacttgtcaactttcaaaaagtattatggccaggagcagtggctcacacttggaatccgagcactttgggaggcccaggcaggagacttacttgaggccaggagttggagaccagccctgggaataccctcgtctctactgccccccacacaaaaaaagaaaaaagtattacaatgagtctagtccttacaacaaaaattttttgtttttctttttgagacggtgtctcactctgttgtccaggctggagtgcagtggcgcgagctcgactcactgcaacctctgcctcccagattcgagcgattctcctgcctaagccctcccaagtagctgggattacaggcacctgccaccacgcctggctaaatttttttgtatttttagtagagacggggttttaccatgtgggacaggctggtctccaaccccctgacctctggtgatccgcccgcctctgcctcccaaagtgccgggattacaggcgtgagccactgcacctggcctcaacaaaacttaatttgaattctcgtagtatgtcatggtacctgccttcaaggagcacattgtctagttgaagtggcagatataaactaataattatagttatatatggtgacagcagttgtagagagataattagggtacctagaaaacacctgaaggtggaatggctttcttataaggggtttgggcatagtgagggctaaaagattaatcctatgtttcttacgtgtaggtagcttatctctagtagaggggataaaatagcttgcatttattggggctgtatttggtgctacatatcggggatccaaattagttataattagcataaaagtggtacagataaaattatcagaggaaggaaaatttgcctcaatttgcctcatttcttaggaagaaatgacaatgcaaaaaacaaagaggagggtaaatttagatgatattaacatagttttaacaagaccattgtgccatttggaataatggattttctggtacaaaagtaagttttctgaattacattcaaaagcgattgtatgctaagtaaattccttcaaaacttggatctttaaaagttaagataattgcaaaatgttattagactatgatgtagctcaacaaatgatagaaatttggcagaaattatactagtaacttaagaatgaggctgctacctttacagtggcataaggaaaaatagggaaatgtgtcctagggatgttacacaaaaccatagtaaaaacctagaaattgggagttagaagctgctttgtgtgttttttgttttctggttttttttttttttttttttttgtttttgtttttttttttgagacggagtctcctctcttgcccaggctggagtgcagtcacgtgatctccgctgactgcaagctccgcctcccgggttcacgccattttcctgcctcagcttcccaagtagctgggactacaggtgccggccactacccctggctaattttttgtatttttagtagagccggggtttcaccgtgttagccaggatggtctcaatctcctgacctcatgatccacccgcctcggccttccaaagtgctgggattacaggcgtgagccaccgcgcccggcctagaagcttctttatcatgaccaggagttcccacatgcaattgatcatcagaattgcttggggaattcaggataattggaatcatttctgtcaagagttttcagtggtaattcaaaccatttaggaacttatgggctggtcatggtggctcacacgtgtaatcccagcactttgggaggctgaggcaggcagattgcttgaggccaggagttccagaccagcctgggcaacatggtgaaaagcccgtctctactaaaattacaaatattatccgggcatggtggtgcgtacctgttagtcccagctcctcagtgggggctgaggcaggaggatcacctgagccttgggaggtcaaggctgcattgagctgtgatcctgctactgcactccagcctgagctagggattgccaccctgtctcaaagaaaaagaacttgtggcagagtacttaatgagaagtgtactggaatggtgattccacatttactatagtcatatgctaaattgtgcttattggactagtggatcacaaatattggccatcccatacctactaaacattctagaacccctacttttcagaaacttcccaagtaatataatagaatgactagctaggtttcgaaagcaagaattaaagacttaattccccaaggctgaaatctgtactgtcatcttagtagttttctgcattagcaaatctagataaataatgtgagaattgttttttgttgttgttgttgttttgagacggaggacggagtttcactcttgttactcatactggagtgcagtggcatgatctgagctcactgcaacctccgcctcctgggttcaatcgattctcctgccccagcctcccaagtagctgggattacaggcacccgccaccacgcccagctaattttttgtatttttagtagagatggggtttcaccatgttgtccaggctggtcttgaactcctgacctcaggtaatccacccgcttcggcctcccaaagtgctgggattacaggcgtgagctagtgcacctggctgaaaattgtttttgagacaggatcttgctttgttgcccagactgtgttgcagtggcacgatcagagttccctgcagccttgacctcctgggccaaggaatcctcctgcctcagcctctggaatagttggggctacaggcacacgctaccatacctggctaatttttgaaaaatttttttgctatgttgtccagactgttctttaacttctgggctccagtgatcctcccactttgacctcccaaagtgctgggattacagacatgagccaccgtgcctggccctgtttttgttttttaagatgaggattacttacaagcaagcagccctgatgcagtgtttacttttgtgtgtgttctttttctggtgtttacccagatccgtttcccccctttaaaaagaaagaaaaaccacggttgtagttctgtaacactgtcctctccttcattctttttctggttcttgtctaaccttctacatacaggtaattccaattttctgttcatatctctcttcatttcttttcagtgtaatgtagaagctctcagagctttgcctgtgacatctgtgcagaagaattcctattgatatctttagacctcacttctccagagcttttcctgatttttcttctgcctgcccgtgtcttccctggtatatcttactggcttccccagtttgacatgttgtaaatggaattattccttacgtgaaggccttaccccaactttctctcctgttgttcctatttcttttcatcataattggctttagtttgacattttctctttctccattttataggcagtcaatttataaaccccaatgaattctggttgtgtagcatctttcccatctaggccaggggttctcaaaattttatatgcatcataatcagctggaggtactgtgaaacagttagttgtgccccaccttctagagtttctgattcaatgggtctggagtagatgtgagaatttgcgtttctaacaagttcccagatgatgtggatgcccttgacccagtatggagtacagaatgccttaagacggcattcagaacactaaatagtcagttttaatcggccttctctcccactgtgctttcccatatcagaagtcagatttggacttcagcatacttgttacttagtagctgtgtgatcttaggcaaattgtttaattttctttcttttatttatttttttcttttttgagacaggaagtagtctttctctgtcacccaggctggagtgcagtaacacgatctctgctcactgcagcctccgcctttcgggttcaagcgattcttgtgcctcagcctcccaagtagctgggattagccagccgccggttttttttgttttgtttgttttttgagacagagtcttgctctttcgcccaggctggagtgcagtggcaccgtcttggctcactgcaacctctgcctcctgggttcaagcagttctcctgtcgcagcctcctgagtagctaggactacaggcaccgccaccacacccggctaatttttgtatttttagtagagaccgggtttcatcatgttggtcaggctggtctcgaattcctgacctcaattaatccaccctcttcggcctcccaaagtgctgggattacaggtgtgagccaccatgcctggcccagctgcaggttttttgaggtcaggaatcatgtcttaattgtctttgtacttccatcgcgtttggagcgatgtgtccattgataggcggttagtaaatgtttgaaaaattggtttatgttatttactcttctttcccttttttcattcttttcaatttctttgcaccctttccccttctttcctttttaatgaaagttttagtaagcaaaattattagcatacccaacaatggtttgctttccctccaacctgttggtagtgagtgagtagttaattcacattttattccataaaacgttttactttttctccagagtaattaagtagaaaatatggctcttggccaggcacggtggctcttgcctgtaatctctgcacgttgggaggctgaggtgggtggataatttgaggccaggcgttcgagaccagcctggccaacatggtgaaatcccgtctctactaaaaatacgaaaatcagccaggcatggtggcaggttcttgtagtcccagctactcgggaggctgaggcatgagaatcgcttgaatccgagagccagaggttgcagtgagccaagatcgcaccactccattctagcctgggcgaaagagtgagactctatttataaaaaaagaaagaaagaaaagacccttaatgactttttcccctctcttaaaacctggttgtattagtgactttgacatacatgtatattgttgacttcgccgtctcctgatgttactaatttgaacagtgactatatattgccgttacagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggaggtaggaatcttaaaggtgaaagaagtaaagatgtgtgggtcatatctgttatgtgcactttgataaagtaaactctgactttagaaacaatatttaaggttgagggaaagcctgagtttgcaatggtaggtatttatatttatattagagttttaggtatcagaagaaatacttaacacatccttggttctgtaccttcacaataaacttttctcagctggtgctggtggggaggatttctgcaattgaaagaagcaaaaatatatattattgctgtacattcttgattttttatttttttactcagtctcgctctattgcctaggttggagtgtagtggcacgatcttctctcactgcaacctccgcctcccgggttcaagcgattcttctgcctcatcctcctgagtagctgggattacaggcgcccgccaccacgcctagttaatttttgtatttttagtggagacagggtttcaccaagttggccaggctggtcttgaactcctgacctcaggtgatccacccacctcagcctctcagagtgctggaattacaggcgtgagccactgcacccatccatattgctatacattcttaacacgggagataactacccctaaggaggtgaaaattggtttgtgtatgtgagtaggtgtaaataatcttactggttgattgtttaaagcacagatatgcacagaggacataggatatctatggtattaaaatttcatgggactggtggggagggaatagttcttaaaagagttcttagaggagcaatagtaaaaaaaaaaaaaaggttgagaaacactaacttaaattaccctttctaggtttaaagtggtagaaatgacttaaccatggcactctctatgtgtatagaaactaagttccaatgagttgtttaattatatcctgtttttaggccataacctaagggtttaactgctcatgaaatgcttaaacgctttcctttttttttttttggagatggagtctcgctctgctgcccaggctggagtgcagtggcgcgatctcagttcactgcaacctccacctcccaggttcaagcgattctcctgcctcagcctcccaagcagctgggactacaggcatgcaccaccacgcctggctaattttttgtatttttagtagagacagggtttcatcatgttggtcaggctggtctcgaactccggacctcaaatgatcctcctgccttttgttcttgttactgaggcacaaatactctgattggtagtgtgataaattgtaaaactacatatatgtgtgtgtatatatttatattgtgtgtgtaaaattatatgtgtaattttacacaatataaatgttatatttatatataaacatacgtatatatgtatgtatatgtaaaactacatgcgtgtatatattgtgtgtaaaatatagttatatataattttagataatataaatgtattatatttatatataaatatataaattatatatgtaaaactacatgtgtatatatttatattgtgtgtaatatatataatttatatatacatataaattttatatatataaaatatatgtaattttacacacacacaatataaatgtatacacacacatatatgtggttttacatatatatgtaattttacacacaatgtaaaaaacgcaccccttctcccatataataaacctttccctggccgggtgcggtgagtcactcctgtaatcccagcactttgggaggctgagaccagtggatcacttgaggtcaggagttcaagaccagcctggccaacatagtgaaaccctgtctctactaaaaatacaaaattagccatgtgcagtggcacgcacctgtaatcccagctactcaggaggctgaggcaagagcatcacttgaacccgggaggcagagattgcagtgagccgagatctcaccattgcactccagcctgggcaaaaaaaaaaagggaaactccgtctcaaaaacaaaacaaaagaaaaacctttcccctggatatcacttaaatggatgtattgtgatgtattgttttctgaaggatttatcctgtgtattggatcactcattcaacaaatatgttgagtaattttgtatgccaggtatagaatatgcaatataggttcataatttgcttttatggcctaatatatctggggcatgtatctttgttagtagatggagacctgcctccttttgatggctgtatagtagaccataattaactattccttactgatagacatttagatggtttctaattttttgacttcaaaagcatagttttgctatagaaatactttctaagtagaatgttgtatcaaagggcaggaccgttttttaatataattgatactgctaagttgcactccagaaaaagatttgaagtcccacaacagcgtatgtatttatgtctgtttctccatgcctttgccaacactggactcagtagagttcattctcaagtttacattgctttttttatttgtgatgttgagcttacatctcctgtttatttatgttttttgcccgtatttccttttgagttacctcttcatataaggtaaattataccttctccacccaataaataggtgcagatcattttcttgtttaacttaaaatcttaagtcctgttattggttagaagctgtaagttgcttttttaatggagccttgctctgtcacccagactggagtgcactggcatgatcttagctgactgcagcctccttatgggctcaaacgatcctcccacctatgcctcccaagtagctctggctacagacatacaccaccatacctggatttttattttatttatttattttttttgagtcggagtctggctctgtcgcccaggctgtagtgcagtggcgcaatctctgctcactgcaacctccgtctcccagattcaagctattctcctgattcagcctcccaagtagctgggattacaggcgcccaccaccacacccagataacttaattttttttttttttaagagatggcatgtcactatgttgctcaggctgatctggaactctggcctcaatcttcccacctcagacctcccattcaatgatttcataaagtatgtgttcatctattgttgtcttctgggacttttatgtttgggccattaaaacttttgtcattctggtatttggtatggaatcagaatccagcctttttttcctaaatgattgagtttttgttgttattttgaggcggagtcttgctttgtcacccaggctggagtgcagtcacacaatccccgcttactgcaacctctgcctcctgggctcaagcagtcctcctgcctcagcgtcctgagtagctgggattgcaggcatgcgccaccatgcccagctgatttccattgtattttttgtagagagtaggtctcaccacgttgcccaggctggtctgaaaactcctgggctcttgcaattcacccactttggcttcccaaagttctgggcttataggcatgagccactatactcagccaaaaaaatttttttattcagtcaaccattgatggacacttgggttgatttccgtatctttggtattgtgaataatgctacagtgaacatacaagtgcacgtgtcttttttgtagaacaatttcttttcttttgggtatattcccggtaatgggattgctgggttgaatggtagttctatttttagttcctttttttttttttttgagatggagtgtcactgttgttgctggagtaaagtggcgctatctcaactcactgcactctccgcctcccaggttcaagcagttcttctgcctcagcttcccgagtatctgggattacagtcatgcgccaccatgcccagctaattttgtatttttagtagagatggggtttctccatgttggtcaggctggtctcgaactcccaacctcaggtgatccacctgcgtcagcctcccaaagtgctgggattacaggcgtgaccaccatgcctggccctgtttttagttatttgagaaatctccacagactgcttttcacagttgttgaactaatttgcattcccaccagcagtgtctaagtgttcccttttctctgcagcctcaccatgttatttttcaactttttaataatagccattctgactggtgtgagaggcatctatctgttttgatttgcatttttctgatgattggtgatgttgatcttttttttttcacattcgttgtctgcttatatgtgttttgagaagtgtctgttcatgtcctttgcccacttttttttttttttttttttttttttttttttttttgagacagtcttgctctatcaccaggctggagtgcagtgtggcaatctcggctcactgcaacttccgcctcttgggttcaagcgattctcctgcctcagcctcccaagtagctgggactacaggtctgtgccaccacacccagctaatttttgtggttgtagtagagatgaggttttactatgttggccaggatgatctccatctcctgacattgcgatctgctagccttggcctcccagagtgctgggattacaggcttgagccaccgcgcccgggtttttttgtttttttggggttttgttttatttttttaacaaacagtctctctctgtcgtccaggctgagtgcagtggtgcgatctcactgcagcctccgcctcctgggttcaagtgattctcctgcctcagcctcctgagtagctgggattacaggtacccgccaccacaccagctaatttttgttgttgttgttgttgttgttgctttttgagacagaatttcactcttgttacccaggctggagtgcaatggtgcaatctcggctcactgcaacctccacctcccaggttcaagcaattctcctgtctcagcctcccgagtagctgggattacaggcatgcaccaccacacccggctaattttgtattttttgtagagatggggtttcactacgttggccaggttggtctcgaactcctgacctcgtgatccacctgcctcagcctcccaaagtgctgggattataggcgtgagccaccatgcccagcctagttttgttttttaaggaagtgatatctcagcccaggcgcagtggctggcgactgtaattccagcacttgggaggccgaggcttatggatcacgaagtcaggagttcaagaccagcttggccaacgtggtgaaaccccatctctactaaaaatacaaaaattagctgggcgtggtggtgtgtgcctgtagtcccagctacttggaaggctgatgcagtagaatcgcttgaacccaggaggcggaggttgcagtgagccgagatcgtgctactactgcactccagcctgggtgacgagcaagactcgtctcaaaaaaacataaaaataaataaaaattaaaaagtgatgtctctagtctttagtccaaatttataataaattattatatattttactcaagctggtagattcttagttgtaaggttcatggactcaaaaagtggctcagtggtaaaaatcactatggtggttaccttgtttgaggacatagtattgactgggaagacacagttcataccttctggtaagatgggaatgttttatattttgacctggtgcatacatatataaaaattcatcaagctacgacgatttgtgcacctttactatatcatgttatacctcacgtttgttttaataatatttatatggagagaagccaacaaaataggaaagcaagttgatacttcagcctttcttttctacttcagattggccttttcgcataacagcttcaacacctatttatttattttgtattatattactatatatgtattttttcagacagggtcttactctgttgcccaggctggagtgcagtggtgtgatcacagctcactgcagccgcagcctcccaagcagctaggacttataggcatgtgccaccacagtcagcccctgaaatattttttttttttgagacagagtctcgctttatcgcccaggctggagtgtagtggcatgatctccgcttactgcaagctctgcctcccaggttcacgccattctcctgcctcaggctcccgagtagctgggactacaggcgcctgccaccatgcccagctaattttctgtatttttagtagtgacggggtttcacggtgttagccaggatggtctcaatctcctgacctcgtgatccgcctgcctcggcctctcaaagtgctgcgattacaggcttgagccaccacgcctggccttgaaatgttttttaaatgcaattttccatttctttttttaacctgtcaattttttttttttcttttttgagatggagtctcgctctgttgcccaggctggtatgcagtggcgcgatctcggcccactgcaagctccgcctcctgggttcatgccattctcctgcctcagcctcccaagtagctgggactacaggcgcccgccaccacgcccggctaattttttttgtatttttattagagacggggttttaccgtgttagccagcatagtcttgatctcctgaaccctgtcaaatttaacagtgagggatgtgtgcaactttgataacactgatgttaataagttctgataacccagtaacattgggccggcccaattttcaattttgaatacgctaagttcttactactgtggttttctttatggtttaggaggcctacgtttaatatctactcaatactgaaataaccaatgttatgtagtggttaccccttgctctgtgggctctgtgccaactgtggcttctcctcctttgttattggtgcctcttttctggcagctatgcttctttttttgtttgtttgtttgttttttgagacagagtctcactctgtcgcccagactggagtgtagtcgtgcaatcttggttcagtgcaacctctgcctcccgggttcaagcaattctcttgcctcagtctcctgagcagctgggactacaggcacgtgccaccatgcccagctaatttttgtatttttagtagagatgaggtttcaccatattggccatgctgatctcaaactcctgaccttgtgatccacccgtctcggcctcccaaagtgctgggattacaggtgtgagccaccgtgcccagccacttttttgggggtggtggtcattggcctttgcagttgtatatgtgcatatctcagagatatgatgggggttcagttcccaatcactgcagtaaagcaaatatataaagcaaaccacacaaattttttgtatgtttacactatactatagtctcctaaacgtgcaatagcattatgtctaaaaaacaatgtacataccttaatttgaaaatacttcattgctaaaaaaaataataataataatgcagacacagaggcaccaactgaacacatgttgggaaaatgccactaatagacttagtgcagggttgctgtaaccttcaattggggaaaaaaacttatgtgtgacgcacaataaaacgagctatgcctgtacttagactgaagtttcttgaggtacgtaccatatatgccttgttttttcatagattgtagatgcttgtgggctggagttatggaaaaaattagggattttttctcctttagaatctatcttgaatttttatttttaggtttttagcctgtgtgaaacattttgcttttcaaaagttattttgaagttgaaagttatctaatacgccagccataccacccatgtatatctttgctttctgaaaagatgtttgtccttcaaagaataacactaggcccggcccagtggctctctcctgtaatcccagcactttgggaggctgaagcgggtagattatctgatgtcaggagttcaagaccagtctggccaacatgatgaaaccccgtctctactaaaaatgcaaaaattagctgggcgtcatggcacatggctgcagtcccagctactcagggggctgaggcaggagaatcgcttgaacccaggaggcagaggttgcagtgagccgagatcgtgccattacactccagtctgggtgacagagcaagaccctgtctttaaaaaaaaaaaaaaaaagcactatatagcaatgcaattgacagaatatttttatttatttttaagttactctcacaacttctttgctttgtggataaggtatttgatgctcagagaaactgaaggccttccctgaatcaccaaactaagtaagtgacagagccacttaggggcctgggtctgactcttactttggaacttttgcaaccgtaccatgctgccttctattattctttgatcattaactacctttatttatatattgctttgccaagatttacataatcacacattatattgttatatatactataatggtacttgagagaactctctaagtgcacatagtagtcatgtgtgaataaaaaatgttttcatctagttgttgcctacctggtttatttcaaccagggacttttgttggcatgtgtaagtgggtgtagcaaaatggaactggctgctgtggctctgtttttcctcactgaaataaaagaaacactgtaaggagaagataaacggcatgatggtatttcagaacattcatcccaagctagagcttcatacaagcaatgcaagaagggcactttagtgtttagcacactgtgtacttaatattcattatagtagtagcattggttttatttattcagcatacttatttacactttgaaatttgaaaactttattttttttttttttgagacggagtcttgctctgtgacccaggctggagtgcagtggcacgatctcggctcactgcaacctccgcctcccaggttcaagcaattctgtctcagcctccccagtagctggggactacaggcgcctgccacgacgcccagctaatttttgtatttttagtagagacggggttttaccatatcggtcaggctggtctcgaactcctgacctcaggtgatctgcccgcttcagcctcccaaagtgctgggattacaggcgtgagccactgcgcctggctgaaaactttattaagatctgtttttgaagtatgtgggcgaaggattacccaggtgccgaggcaagagactgaaggcacaaactgtttcagtataataaagaaaatagttagaataagaatagttaaaatacaaagtagatatagagatgatcatggacattatcaatcattagtataaacattattaatcatcaacttttaatattactctttgttgtattactaatataaccaaggaataaccggcaggtataggatgaggtgctgaagggacattgtgagaagtgacctagaaggcaagaggtgagccctctgtcacgcccgcataagggccacttgagggctccttggcaagcggtaacaccattgcctgggaaggtacccattacttagcagactgtgaaagggagcctcccttcccttggagtcagggaacactctgctccaccaaccagcttcttgtgggagattggatattatccaggcctgcccacagtcatccggaggcctaaacccctccttgtggtgctgtgcttcagtggtcatgctccttgtccactttcatgttcctcccgtactcctgattcctctttgaagttgctagaggatagcagtagaaaaaatagtgaaagtcttaaagtctttgatccttctgataagtgcatagaagaaaacgctgacgtatgctgccttacctctctgcttcagctgcctgaaagggaagggcccctgtcccatgatcatgtgacttgcttgaccttatcaatcacttggacgactcatcctccttacctcgcccccttgtcttgtatgcaataaatatcagcgcacccagccatttggggccactgccggtctctgcgtcttggtggtagtggtcccccaggctcaggtgttttctctttatctcttttgtcttgtgtctttatttcttatgatctctcatctccgcacacggggagaacacccgctaagccccgtagggctggaccctacatcagtagaattctagttttccttaatttcagatagtaatataatacagccatccctcagaatccgtggggaattgtttccaagacctcctttggataccaaaattcacagatgctgaagtctctgatacagcatggcataatgtttacacataacctatgcagatcttctcatatactttaaaatgtctctagattacctataatacctaatataatgtaaatgttatataaatagactatattgttcggggataatgatgagggggaaatctgtacatgttcaatacatatgcaatgtttttctgaatattttcaattaatggctagttgaattcatggataaagaacccactgatatggagagctgactgtatttcttattagttatttaactacctggagtcacgggggtaggaaagcactttatagtgctagcaaatgtatagattacatctagtattatgccagtttgttgctaaggaaaaaaaatcctttcctgtgttcttatactctgggtaacctctagagtagctcttgttttgtcctcatttgcaattaatttattcacagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccaggtatgtgcccttttctattcaaatacaaatgagtcactatagaaatacatggttccactcactgtgagtttaattgcatgttactctgtgtaatttaacatcttgtgatttgtattgatatgtgtatatttttcttcattttgcctccatgaaaaaataatgcttttttacatagaacaaaatactggtgctgtttaagcattatctatttgatcataacggttcctatatcatttataaatgttaagagctttagacatcttgaccaaaattccattatgctcagtaggcccagagagccagtggactgggtagtcttgatgtgtctgtcactttgcagatccttctggagagtgcaacccagacttgcgtctccgtggacatcagaaggaaggctatgggctttcttggaacccaaatctcagtgggcacttacttagtgcttcagatgaccatgtgtgtatccttcccattttgaagcaaatctgggctagttaccagttggtttcttttttggggtgtgtggggaggtgagaatcttccttttatataatggttaattttacatttaagaccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatgtgagtagaatccattcagagtttctaaatatcttgtctaagttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacataatttctctaggtttttttgaattgcagagatattttacttacagtattttttttttcttaaaaaattgattactcttgcttttctttttgtacatagactgttgccttgtgggatctgagaaatctgaaacttaagttgcattcctttgagtcacataaggatgaaatattccaggtaagagaaactaatgctactattttgtttgttttaagaaaaacctgctgggcgcggtcgctcacgcctgtaatcccagcactttgggaggctgaagcgggcggatcacaaggtcaggagatcgagaccatcctggctaacacggtgaaaccctgtctctactaaaaatataaaaaattagccgggcatggtggcggatgcccgtagtcccagctactcgggaggctgaggcaggagaatggcatgaaacccgggaggcagaggttgcagtgagccgagattgtgccactgcactctagcctgggcgacagaacgagagtccgtctcaaaaaaaaagaaaaaagaaaaacctggatgtatgagtgggcacacatgtgctttatgccgttgctaaaaatagaaatctatatgcctatgctactttctgtgggaattgttttttctttgttatttctatactttctcaaactggttattgaccacttacattcttcagatattaagaaaactaggccaggtatggtagcttatgcctgtaatcccagcactttaggaggctgagatgggtggattgcttgaggccaggagtttgagaccagcctggccaaccctgtctattttttaataaaaatttacaaagaaaggaaaactagtgcctgattattttttcagccttgtttctgacacttagtgatctcttcccttcttccaatatattcttcatccttcattacttgccacatgtgttgatttctcaacccaagcctcaacctctggctccatattttctacctcatcagtttaaacccatttatgcctagtgttccattattggaacgctaagcatgtgggagtttatatcctgctcaaggttatcgcccaggtctgattgcaaaaattaaaaaaagaaataatcactgcactatgttcaaagcttgttgctacggcactatgaaagattacgttatgtagcctttgctatcaaggagcccccaatttttttatttttttttaattaatttttttgagacggcattttgctcttgttggccaggctggagtgcaatggtgcaatctcggctcactgcaacctccacttcccaggctaaagggattctcctgcctcagcctcccaaagtgctgggattacaggcgtaagccaccacgcccagccgagcccaaaattttatagtgagggagggcttgtttagaaattactataataaaagattttgtcaagtgttatgaacctgagggtggtaaagattaattctggtgtgtgaaggtggcgtctgaactgggctttaggtgagccatactcctacatacttagtctcttattttctacttttcagcccaccttggtgaacattttatccttaccctatctctttgctttgcttgtgacggtattcttgcctggacagaatccaaattcttccttaattgctggtcactaatgccctctttttctgtaccttaaggctaggtagcacttttaccatatttggtagcaaactctgattgttggatatatagtagtaaattttttgtctgactctttaataaaattattgcatggagtcatttttaatcagacttatatgtaatacagaactcatagtaaatacttggggacatagttattgtatatgtcatctgtactttagttcttaggtcagaattggattgcatttgggtagaggccagaattagcaaataagaatagacaagatgtaggccgggcacgatggcccatgcctgtaatctcagcgctttgggaggccgaggcgggtggatcatgaggtcaggagtttgagaccaccctgaccaacatggtgaaacctcgtctctaataaaaatacaaaaattagccaggcatggtggtgcacgcctgtaatcccagctacttaagaggctgaggcaggagaatcgcttgaacatgggaggaggagattgcagtgaactgagatcaccccacaagaacagacaagatgtgatgtttccaaagataaaatgatgctgggcacatggcacacacctccagctacgcaggaggttgaggcagcgagatcccttgagcccaagagttcaagtccagcctagaagcaatatagcgaggcctcatctctttttttttttgataccagcctaaccccatctctacacaaatacaaaaattagctggccgtggtggcggacacctgtaatcccagctacctgggaggctaaggtgggagagtcgcttgaacctgggaggtggaggtttcagtgagctgagatcctgccattgtactccagcctgggtgacagagcaagacttccgtctcaagaaaaagtgtgccaaaggggtgctgtgggaatggaacaaaagcttatatcctgggtctagaaatgtctagtaatgggttgtttttgtaaacattttttttttgtttttctttttgtttgtttttgagagagtctgtcacccaggctggagtgcagtggcacgatctcagctccaacctctgcttcctgggttcaagcaatcctcctgcctcagcctcccgagtagctgggattacaggcgcctgccaccacacccagctaatttttgtatttttagtagagacagtgtttcaccatgttggttaggctgatcttgaactcctgacctcatgtgatccacccgcctcccaaagtgctgggattacaggtgtgagccaaccgcgcctgcccataaaataaattctttagctcttaattttaactgtaacgtgtataataccttgacttcctcttcccttttatttacaaaatttttaaattgttaaatattttgtgaattttttccctttattttctaattcatggctttgctcttttcttcattcctatgtgtaggttcagtggtcacctcacaatgagactattttagcttccagtggtactgatcgcagactgaatgtctgggatttaaggtaattcttgtattcattcctctctctacataattatttcctttatttacactttgcaaaggtagttactaagggtaaatctgttttaacttttaaaattatgcttttgtactagtaaaattggagaggaacaatccccagaagatgcagaagacgggccaccagagttgttggtatgttaaaagcattggacagtactgaaatagtctgtaatttaatgtcctctatctgcatttcacctctttgttttcttccctctttcagtttattcatggtggtcatactgccaagatatctgatttctcctggaatcccaatgaaccttgggtgatttgttctgtatcagaagacaatatcatgcaagtgtggcaaatggtaagggtttagtaatttattttggggaggtgaaataagtgagacatagaatcaatttacatttgtatattttatgattacagctaccatctctgttcattttactcccaggtgtgattttaagacttgtctatacattatcattttcagctgcctgctcttgactgtatttggtcataccactggtattttaaactctgctaaacaaaactgaccctctctcccacttctccttttccctctcctccttctttctttctttttgtatgactccaacattttcctagctaaccagacttgaaaactcaagaattttccatgtctgtttacttctagttctagttcacttccagatttcataccatctatctgcggtgtttctcccatcttatcatcttacaagtacaaatttacatacccaaaggaggtatatcatatcacagcatcaaatactactatttctccatgaaagctgtctagatttcaaaaatgttccctatctctatctcaaagaatgtgaacaccctccttaaattttctctttttttttttttgagatggtctctcactttttcacccaggctggagtgcaatggtgcaatctcggctcactgcaacttccacctcccaggttcgatcgattctcctgcctcagccttctgagtagctgggactataggtgcgtaccaccatgcctggctaatttttttgtattttcagtagagacggtttcactatgttggccaggctggtctcaaactcctgaccttgtgatccgcccacctcgacctcccggagtgctgggattgcaggcatgagccaccgcgcctggcctcttaaattttcaaagcacttcaatttaataaaaataactgtggtgtctcatacattaatatttttaaaatagttatattcggccgagcacgttggctcacgcctgtaatcccagtactctgggaggccgaggcgggtggatcacgaggtcaggagatcgagaccatcctggctaacacagtgaaaccccatctgtactaaaaatacaaaaaaaaattagccgggcgtggtggcgggcgcctgtagtcccagctcctcaggaggctgaggcaggaaaatggcgtgaacacgggaggcggagcttgcattgagccaagattgcgtcactgcactctggcctgggcgacagagcgagactccgtctcaattaaaatatatatatgtatatattccggagataggtggtggttatggttaatgcagtgtgagtgtacttaatgccactgaactgtacacttaaaatggctaagctgataaattttatgttgtatggagtttgcgacaatttggaggtggaagacagtttcttgctctgttgttcaggctacagtgcagtggtgcgattacagctcactgcagcctccaattcccgggctcaagacatcctcctacctcagcctccctagtaactgggaccacaggtgtgcatcaccagccctggttaatttttaaaattttttgtagagatggggtttgccatgttggccagtctggtcttgaacttgtgagctcaagcgatttgcccacctcccagagtgctgggagtacatgtgtgaggctgcccacccgccccccacttttttttgtttttaaagaagtgcgtaacttggtggttgtctggtaaaggaaaagaattcagaagaaacttggtgtctctcagagtagatctagtaccaggaattaagttccagggaatagtttttgactcatcatgaggagagggaggatgttttcatcagtactttcttactttttatttctttattttttttttaattttttttttttctgagacagagtctcactgcctcacccaggctggagttcagtagagcaatctcagctcactgcaacctctgcctcccaggttcaagcaattctcctgcctcagcctgctgattagctaggattacaggcatgcaccaccatgcccggctagtttttttgttgttgttttttatttagtagagacggggtttcaccatgttggtcagggtggtctcgatctcctgacctcatgatccgccctctttggcctcccaaagtactggaattacagacgtgagccaccgtgcccggcatttttatttttgagacggagttttgttcttattttccagcctggagtgcaatggtgcgatcttggctctctgcaacctccgcctcctgggttcaagcgattctcctgcctcagcctcccgagtagctgagattacaggcatgcgccaccacgcctggctaaatttttgtaattttttttagtagagactgggtttctccatgttggtcaggctggcctcgaactcctgacctcaggtgatctgcctgcctcggcctcccaaagtgctggaattacaggcgtgagccaccgcgcctggcgtaatagcactattaattgaagacagaaataaaataagtttgtgacctgccagactaacagattgtactacatccatactttttttttcttttacctccaaataccatcacaacattcatactttgtaacattacttatcaaaaagaaggatgggccaggtgcggtggctcacgcctgtactcccagcactttgggaggccgaggcgggtggatcacaagatcaggagattgagaccatcctggctaacatggtgaaaccccgactctactaaaaatacaaaaaattagccgggcgtggtggcgggcgcctgtagtcccagctactcgggaggctgaggcaggagaatggcgtgaacccgggaggcaggacttgcagtgagccgagatcgtgccactgcactctagcctgggtgacagggcgagactctgtctcaaaaaaaataataaaaataaatttaaaaagtatgattaggggctgtgctcagtggctcacacctgtaatccaaatactttgggaggccaaagccggaggatcacttgagcccagaagttctagactagcctgggcaataaagtgagaccgtgtctctaccaaaaaaaaattagccaggcttggtggtacgtgcctgtgatcccagctacttgggaggccgaggcaggaggataccttgaatccagcgggtagaggctgctgtgagacatggtggcatgtgcctttagtccctgctctttgggaggccgtgacagaaggatcccttgaggccaggagtttgaggctacagtgggctgtgatcacaccactgcactccagcctagatgacatagcgagaccctgtctctaaaggaagaaaagaaagaagtacggttagggttataagatattcatgacatgctgttaaaggggaagcgcagactgaagaatagcataatggtattcctcatattaaaattttgtgtatctagtctatatttagaaagctgattactggccaggtgtggtggctcacgcctgtaattccaacactttgggaggccgaggtgggcagatcacctgaggtcagtagtttgagaccagcctggtcaacatagtgaaaccccatctctactaaaaaataaatacaaaaattagccaggcatggtgacgggcgcctgtaatcccagctacttgggaggctgaggcaggagacttgtttgaacccaggaggcggaggagttgcggtgagccaagatcgcaccattgcactcgaacatgggcaacaagagcaaaactccatctcaaaaaaaaaaaaaaaagaaaaagaaaagctgtttgctaaaatgtgcttggtacctagttcttggtttctttagacctttctgtattataatttttttacaaaaaagatgtgtaacttgaaaacagaaaattcacctcactctctttgtaataaatcccttcaatattaatacagaaacttaatagctgggcgtgatggcacgtacctgtagtcccagttccttgggaggctgaagtgggaggctagcgtgatcccaggaggcagaggttgcagtgagctaagatggcgccactgcactccagcctgggtgacagagcgagaccctgtctcaaaaaaaaaatactgaagaattcaaggttaaactagatccctgcaaggccatcacctccattccaagttgttactttatttggtgtttttagcattgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggtgggtagcatgcccagagacttgatggaaactctgcagcccctccccaccttgccgtatgcatctcttccatgtggttcctcagttgtatcctttatttaaaaaaaaaaacaaaacaaaaaacaaacaaaaaacagtaatagtaaaaagctttcttgggttctgtgagtcattccatcaaattatcagacctgaggaggcagtagtgggaaccctgaaatttgtagtcaagtgggatagaagtgtgcaggtagcctgggaccagggaattgcaactggcttctgaagtaaggacagtcttctccaaagctaacttcagatagtgtcagaataggattgagttgtacacccagttggtgtcctaagaaagggtaccccacatttggtgttagaagtaacgtcagaaagcatcacacaattgtatgtattcttttctctggggtcagatcacaagctctttgaaggtaagactatcctgtcctctgcagtacctatcatagtgatatgtgcatggtaggtgctaagagcagtaaattttgctcctgtgaaagtggttcctgtattttaagattatgccgttggatacaggtattctgtcaagcagtagaagtagagtttattctatacaagaacagtttttctcttcaatatatagagattcggaacatattgttttggaagttttaagtgtgcagttcagcagtcttcagtgtatttacagttgtgcaaccatcaaccacagtcaatttgagaacattttcatcatctgaaaaagaaaccctgtacccattagccatcatttcctatttttctcatagtcccccagccctaggcagccaccaagctatggatttgcctgttttggacccctgttttttttagacgaagtcttgccccccaggctggagtgcagtggtgtgatcttggctcactgcaacctccgcctcctgggttcaagcgattctcctgccttagcctcccaaatagctgggattacaggcgcctgtcaccacgcctggctaatttttatatttttagtagagacagcgtttcaccatgttggccaggctggtctcgaactcctgacctcaggtgatacgcctgccttggcctcccaaaatgctgggattacaggcgtgtgccaccacacctggcctggacaccttatataaataaaatcctaaagtatgtgacagcttttttttttttttttttttttttttttttttttttttttggcacacagtcttgctttgccacccaggctggagtgcagtggtgcaatcttggctcactacaaccaccacctcccaggttcaatcaattcttatgcctcagcctcccaagtagctgggaccacaggggtgcacccccacacatggctgatttttgtatttgtagtagagatgcagtttcgccttgttggtcaggctagtctcaaactcatgacctcaagtgatctgtctgcctcagcctcccaagtgctgggattacaggtatgagccaccacacctggcctgactggcttttttatgccaaataatattccatcatatggattggatataccgtgtatccattttagtagttgatggatatttgggttgtttttactttttggctattattaataatgtctggttaggctgggcacaatggcttactcctataatcctagcactttgagaggccgaggtgggcagatcacctgagatcaggagttcgagaccagcctggccaacatggtgaaaccccatctctattaaaaatacaaaaattagccaggcgtagtggcatgtgcctgtaatcctagctactctggaggctgaggcaggagaattgcttgaacctgggaggcataggttgcagtgagccgagatggtgccactgcactccagcctgggagacagagcaaggctccatctcaaaaggaaagaaaaataataatgcctggttaaagaactcaagaatgttggctatcaagacaaatagtatccacactgcagttttgtgggaatgtcctaatcaggcgtctggggatcagctgcttatttttattggaacatgatcatgctaattaatatttcattacccattataggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacat

SEQ ID NO: 38174 - DNA, 22554 bp, Homo sapiens
agcgcacgtcggcagtcggctccctcgttgaccgaatcaccgacctctctccccagctgtatttccaaaatgtcgctttctaacaagctgacgctggacaagctggacgttaaagggaagcgggtcgttatgaggtaattctgcacgtttgcccgcgtgctctctgtgctctgtcgcaaacctctttggccggagccgacttgttctctcgtctgctctaagttcttttagcttttggctgggccccaggggtcctaggcttggagggcgaggctgctcacgggtttggtggtttctagccgcattttccccagcccagaaagcacccgaagtcacccttcggggatggatcccactgaggaagggctgagattgccgctgggacccattttgtcctttttcctattggtgaaatgcagttccgttgcctccagctcccagtcggcgagatgggacttaatgcttatcctgcaaatctctaggcttcaaggaagggaccttgaaaggtcattttactttcccttcccccacgctcctagaccgtcgcagccaaatgagaaacggcccacatctcacaggttcctgcacaaaaggatatttttccaagaggatgttgatttaacttcaggagtagacccccccgccccccgccactaaagaattggggtgggagggtagggcggggcgaactggaggaggccctgcagagcttacgtaacaggcgtctgctgccctgcagcgcggtatcgttggactcttgggcacaggatttgcatcaggattgtgacatactaggtaatggtagagcagggtgtggctgctcatacttgctggcctccaatctcatccccacgtgtggctagaaaagtagaattttaaaattgggggaagtttcctcgtgcactttgggtctcttactctgcgcatgtggatctctagtcacttgccaacacggtttctctcttatctgccagaattgttggtagagtgggcagcttttacatttatcctttttgtcacgtgtgatatatttgtgcataccaggagcaaggtgcaggaggatgagtcggtatgtaactgatggacttgactgttcatataccttaacaggatccaagagtggtgtttttgaggggtcataaaggtttctgttgatagcattttgcaaccttgacctttttgggaagtggttgattgatgggtaggtatttatttggctggtgtaatctagccccttttccaatttgggctggttcaaatgagggcttgtgttggatattaacagacacgtaagtcagtaggagatctccctttactctaactttaaacatatgaggacacgtttgagttagggaactgtatgggtaccctaaaaggacatgtagctctcctcttctctctaatttcactttggtcaatatttttgcaggtaaccgctgccctgctgtggagatagaagaacccaataatttatgtccatgaaaaatacctggtttccacatttccccaaatgacataggcctttgtaatctggacaaagtaggagtcacagccatgttagtactagaggagtgccctttctggccctcatacaatcctaaaaaaaggggatagaccctgtaaaaaacaggacaggtggacattggcatgcaactagcttttaggttttaattagttccttgcatctcccctgtgttcgacgctgattcttccagatgcatggaccaactaacagacaaggagtgggacattatgctgataaccttcctgtaattgcagtcttgggctttatttcctctctctctagggaaactggcttgaggaagctagctgggggcgggattggaggagctgcttaacttttctccctctggacctaataaagtttcatttagcacacgctaacccaaagccttgaaatgattggctagtcctgttttgctgatggaaaatgacctgttcagggttactgaactaccaagttggtggcagagctaggagtagaatttaggtctccttggctatcaactagatcctctgaatattcgagacaatgaccaaggatacgttgaaatagaactttctcccgtaacctggataccttctacttatttaggctgaggacaggaagttacatggttccctgattattaatgtatttcttttgaacagagagtcacattgtaggcctacttttttggaggtgcttaggcagccatgtggtgtcagctcaattcctttttgtttcaacgtggtggttgctggcggtgtttccggaatggggcttcctgagtagtggctgcctcatttgtcgtctttgtcctgcagaagtgaactatggtatttgctgactcttctggtccactggtttggattgccaagggaaattgatttgttgaggtaacatgggatagccagaaacctctgacttgttaattaccaggttccatcttagttttttaggactccgcagttgactttacagcctctttgaatacacttctgcttatttttgtggtaatttcctttctttctctcataggttgccagtcatcctttgcctgcttgtaaagcacttcctttttgcttgctcctgcctttttttttaaaccttactggttttctccaacttgtaacttgtaaagaaactgctttgatgtagtgggaagagaaacaggaaaaaattgagagcagagaaaaagtcactaagacacccacaatatcccagttttccatctggggcagtgaagcattgatggacatggttcctttgagagtttttaatggaactggacctgggacctgagatttcaggtgatagagacttgatattcttattccagctaaatcagtatattttttaatgttttattttgaaataaagattcatgggaggttacaaagttagagaggtcttgtgttcaacccattttcccccaatggatgcatcttacctaattatagaacaatatcaaaagtaggaaattgacattggtataaagtgtgtatggttctatgccattttattacgtgcgtagatttgtgtaaccgccaccacaatcaagatacagaactattagatcaccaccaagatctccttcatgctacctctttataataataaccaccccccttcctgactcctggtaactactgatctgtccactgtttctaaaattttgtcacttcaaaaatactatacagattgaatcacatggtatataaccttttgggattaacttttttcacttagcataatgtcctcaaaatttatccacattgtcacatgtatcaaaagttcatacctgtgtattgctgagtagtattccatggtgtggttgtattatagtttgtttaactatcattgaaggatattagggttgtttctgatttggggctattacaaatacagctgctgtgaacatttgtatacaagtcttggtatggacatacgctgtcatttttcatgggtaaacacctaggagtggaattgctgggccacgtccttttgaggtatccccagactgttttccaaggtggctgcagcatttcacatttctaccagcagtatttgagtaatcagtttctctgcttcattaccagctattttagttatttttcgttctgatggatatgtagtaataactgactttgtgcctgaagcaaagctcaggggtgttataaggaaacgaaaaaaaaaaaaaagaaaattgtgcatattttatgtaaaatggaacaagtagaatctgtaggcaagagcagttcctgtgttggagtcctctgaggagaagctaaaagcagagctgttgtgagtgtaggagataaggggaggtaatccagagggcattgaggagagagtatcaaccaagtctaattcattagtaagctgacaccatggcagcttggatagatgagacagtttcttaggtgtctctgtccaaagatattcctccctgtaagggttgggggtagagagtagcactgcaagaagtggcttgtgcccatccttttgccattagtccttttgagcataggccttctgggaggttgcatgggggaaaatgacccatggtaatgggatattctctcttctttggaatgtactttaaggctggcaggctccttgttcaggatatttaaagaagacagagaatcaagtggcctgaaacaaagtagagtgtatttctttcatcagaggcttactgcctttaattttgaagactttaaaacatgttttactatagaattatttttcctcagcctacctttggaaaggctgttcttcagtgaggtagattggagttcaggcctagtggatataggaaattggtggtcttctcagtatgtctgtaggagtttgtaattgccttagccttagagaggaaggggtatttaaaaaggcagaggaaaaagatggaggcttataatcaaggatagcagcagtcttcttgattaggtcatacttcactgtagtccctttgcaagtgatgttagctgtttttagtagtggttgatttacttgtcaaatcacagaattacattttggagaaacatataacaacaacacttttatggcatttactgtgtgtcaggtacacttctaagcactttacaaattgctgacttactaattctctcagtaactacgaggtagatactgtcatcccgatgagaaaaaaatcacttaaaaataatcatggcaggcacaactcttaaaccttaaaaatagctgccatacattattgttttcattcacattgaagtaggctgaggttccaaggagttcagaataattggttcttaagaatgataacatagtaatctgttgggtaagagatactgcagtacattattttcttgtgtcgtcttgattacttcccttctaatttgcctgtttgtcaggtgggctggggcacatgtcccaccctctcttctcaggctttttgaaagaggctgtcttatgttgtgtgtattgcttgaaggacccctagtcttaaggccccaggctttctccaaaaagaatgattttctcttagtgtgttttatttttattttaatttttttctcgagtcatgttagtttcacgaggacccagaaatagtatcaagggaattaggatcaagatgcattccttattattcctcacccctctagctgctacccggatactattgtgccaggcccagacagatatctttttaggtggaactagctttagcttcccagatcttcagggctagttcctgtgatttaagttaggttttttttttaaaattctttttaaagtatgaatacatacctaaaagggcacaaatcacaagttcaaagaattaccacaaaatgagcacatttgtatggtcactgaggttaagagatagaacattaccagaaccccaaagcctctggtgtcgttatcccagtcaccactcccgccatcctccccatgactaaccactattttgacttttaatgccactgattatttttaagatgagatttgaatttctgacttatttaactggttcattaaaaatgcatctcctagtctttgatggaacagtaagttgatcatggtcttgcatctttcttttttagagtcgacttcaatgttcctatgaagaacaaccagataacaaacaaccagaggtaaggtccctgctaatccttgggctgggtttaagatgtgtgtaggtacacaggatgaaatgtttttcctttcatattgtattatggaactgtagcaacttaaaacaaatgattttggctttctatcaacccactctctgatctgctttcttatttatgagaatatacaaatataagcaaaatcttaagaaagtgattccccttcccttgttttttgaaaattagaagaatttggagttcattttctttttttgagatagggtctcactctgtcacccagactggagtgtagtggtgtgatcacggttcactgcagccttaaccttctgggctcaagcagtcctctggcctcagcttcccgaggagctggaacaacaggtgcacaccactacacctggttaaattaaaaaaaaatttttttttgtagagatggggtctcactatgttgcctaggctgttctcaaactcctggactcaagtgatcctcctgccttggcttcctaaagtgctgggaccacaggtgtaagcccccatacctggcagagttattcatttttaaagaatataaaagttggctgggtgcggtggctcacatctgtaatcccagcactttggaaggccgaggcaggaggattgcttgaggccagtagttcgagaacagcctggccaatatagtaagacaccatctctataaaacacacacaaaaaatataaaaatttaaggttacttggcttctcttgcaaaatgaagaactatgtaagagaaggattttaaaagtaccagtagttactaaggttatatgtagttttacaagcccccattcaaatggctcagataagtcaatttttgagaattttcatttgtttttgcttccaaaaaaacaaacaggaaagacttcagaagtacgttttcagtcagtttagctgctccagtgtcttggatcctagattcagaaacaaattttaagtgagagtactgctcttgcttttgactagattataaaaggtctttatttttgtctttactttctttttaatttttttaatttttaatttttgtagattttatatatatatatatatgggttacatgagatattttgataaaagcatgcaatacataatcacatcaggttaaatggggtatccatcaagaaggtttttatttaatttttttttttttttgagacagggcctcgttctgtcgcccaggctggagtgcagtggcacgatcttggctcactgcaatctctgcctcctgggctcaagcgatcctcccatctcagcctcccagggagctgagaccacaggcgtgggccaccacacctggctactttttcatattttttttgtagagacagcgttttgcccttttgcccaagctggccttgagctcctggaccccgcccaccttggcctcccaaagtgctgggaatacaggcatgagtcactgtgctccgcctattttaaattttaaatgaagggtttgtgttggcaaggtgctttctaatgatctagaccagtggtatctaatagaaatacaatgtgagccaaattgtgttaattaaattaaagggacatttaacttttttggtactaagtcttcaagatctggcatgtgtttttatactacagcacatctcaatttgatctagttatatatctggtactcaacagacacacatgactaaatgactgtcgtaatggacagtgcaggtctagcccagaacattttcaggtattggtcctagaatagagcctgtcattttgccaagcacatccctgctgtaccatagtggcagggtctttgtataaggcagatctgatcccgcttgatcttcattattgtgcaacacacagaaacgattggaaatatgcctatcaagttattttaagagtaaagaaacatgtttggaaatcttttcatttccggaaatccatggagttgattaacaaaatgaagcattagaaataataaaacttgctgataagggatagtcctgaaaactaattggttccattgcacaaactttgtacctgatacagatttttaaatttgatataaaggagttcttatatctgctaaatattaataacataagatattttaaaagtataacttttttaatcattccattctttgctcagatgtcatcatatcagactttccctggccatcctgtctaaaaatctcctctaccattgttccccggtcatttttgtcctcaaaagtaggggaacaaaaatggggaacaatggtttgttttttttctgtatctcaccatctgatatattacatgtacgcacacacacatacatgtttattgtctctctccattagaatttcacttccatgagaacagagagtttttaaaaaagttttctgtttcattctcagaacctggaatgatgcctggcacaaaagaagcattcaataaatatttgatgaataaataaatgcttttcttgatcaattttaatttcttataaactggcaaaatggcaagttagtagcaggtttataacaaaacttttaaatgtttaaagggagttaattttttgattaatttataatgtaatgaatgtgatacattatggaaaccaagctctagacagtgcaattattttttcctacataaaaaagtgacttaggatctattaataggtgcagaaaagttactacatgttttttatttttccccaaatttcctttgatggtttcaagatttgagaattttatgtattttccatagtcatataagaagtgttttcaggggtccccaagatcacccacatatctcatgatgatttgctaggactcagagttgttctcatggctaaagtttattacagtgaaagaatgcatgacaagattaggaagaggaaaagacatgggggagtctagagaaatccatgggcttccagtttcctgtgaggggacacatcaagtgttttcctttcttcagcagtgaaaaatgcagtaattgtctgcagtgtttctgcctggagaagcatgctagagactcagatcccaagatttttgttgggaactggtaacatagggatcctctgcctagcaactaccaaaattacaaacttctgctgggtgtggtggctcacgcctgtattcccagcagtttgggaggctgaggcctgcagataacttgagcccaggagttcaagaccagcctggacaacatggtaaaacccctacaaaaaatacaaaaattagctgggcatggtggtgcattcctgtagttccagctacttgggaggctgaggtaggaagatgacctaagcccctggggaggttgaagctgcagtgagctgagattgtgcctctccactccagcctgttgggtgacagagtgagaccctgtctcaacaaaaaaaggaaaagaaaaaaaaaattctagacttctagagtggggcaggtgttcagcataaatcaccatgtttgtatagacggtctaggaagagtgaatagcccttgttggtcttgtcagttaactttgaaagccaagttcccagataccagccaggatctaatcttgcagacaggtccttctgtagatagtagcctcaggcctgctgtgttaactcttgtctgtgaaaggggcagatacataatgagattgtacaatcctaggtggagggttggcattgcatttaacttcttaaggaccaccattgaattactgatagtagatttgaaggaacttggagaagaaaaggagctttatgctttatgaggttatcaataagctagttcccactaatttctaggagtaacttcattctgtttgttgtctctctttggttgcaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaagtaagtgccaggctctggtgctggtagactttgtggcgggggaagttgtcaagcacgttgttactggtttttaactttcatactgctcaagtgtcttcatctcttcctcttctcagggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggtaggacctgtgattttgacattattgggggtgagggcctgagtctgtaagagactgtggttgaagaatagagaaagctcatttattttaacttagacaccttttattgaagcatacaatgccgacacagcttgatgggttatctcaaagtaaacacacttgtgtaaccaccacccaggtcaaggaatagaatattaccagcatcccagaagccctccttcatgttcaggtggtgtttaaatatgtttgaaaaatatgtgaacacctttgaggtgaaagagtattcagtgaatatgatggtcatgatgatgtcaccttggatttaaggcattttcttaagatgtgtaaagtatgttcctttaaatctctctttaagatagaggtacaggtatcgacttatttcataaagaaactaagtctcaaaaaaaaaaaaacttaagtttctgaaaggcagtcatacgattaaagttagaggcagtggtgctgttggtctttagagctcagcccattcaatcagcaaactttttctataaatggccagatagttaatattttaggctttctgtgttgtgcagtcacttccatctgcatatagtctctgttggaactactcacctctgccgatgttgtgcaaaagcagccatagataactcaccaaacagattactgtgaactgacaaccagaattcaaatattcaatgataaaactggctctttgcagatgattttgaatttgcccattgactagaaaggaagctgaaggcattttttagtactttccactattctggtctttagtatctcggagaacaagatgctctgagtctagtgtctcagtctcctttggcttctcacatttattaaggtcattgggagtgcctgctttcaagcagtttctttttttagcaccaaagatgctggtcttgccttatcctgcttttggcatggtcttgctgcagtattaggagtcaaatgctgacctaaaatttggtgtccttttaatctggaactcatgatgcatgaactctagggcttagaagtggcaggaggcaaagggcatattgaagcaaaactttttatttaggaaatgatgagctgactatgtagtctatgacttttttagtaaactgacttgacattcactatctaatggcttttaatacctgaaatttcaggagtcagtcccaagttcaaaatggattaaaaaaacagtgaggctgggtgcggtgcctcatgcctgtaatcccagcgctttgggaggccgaggtgggtggatcacaaggtcaggagttcgagacctgcctggccaacatggtgaaaccctgtttctactaaaaatacaaaaaagtcgggcatggtggcaagtgcctgtaattccagctactccggaggctgaggcaggagaattgcttgaacccaggatgtggaggttgcagtgagccaagtttgcagcactgcattccagcctgggcaacagagcaagactctgtctcaaaaaaaccacaaaaacaaagtgaggatatgaggacataaacattttccctttatccaaagtgcccacattgatcttttaagggccttctctttcttctagttatttgcagatcagtaaatgagaaatgggttctgattgatattatttccatggcaccttttttcatgaagagctttcaatttaccctgtttttccttaaatatctttttaaagagacagggtcttgttctgttgcccatggtggagtgcagtggcatgacattaattattgcagcctcaaacttgagggctgaagtgatcctcctgcctcatccttgtagggagctaggactacaggcacataccaccatgtccaactgacctttacttttttttttttttcctggtagagacggggtcttgctatgttgcccaggctcatctcgaactcctgggcttaagtgatcctcccatattggcctcccaaagtgttgggattataggtgtgagctactgcccctggcctccttaaatagttcgtaaatggaggggttattatgcctttttgatagaagggaaaatttcagagcaacttcccaaaggtgacacaatgaattagtgtcagagctggacatagaactcaggtctccttacatttgagcattgttatcattactacatgtgtcatcttccaatcactagtggcagatgttattgtagtctacagagcttatgggagtgccacaatcttcaattttagcattagtgcctctgcaattctttggatctttagggaaaagccccattttttatggcagtccccttcacctccttgatacataggagcataggagtgggcagtgacttaaaatgaacatctgctttgtgctatgtactcttctgtgtcctgtcccctttcatctggcttgcttcctgtgcctctttgcttaatctcctgccagagactctctggtttgcttatcctcccatcttgctttctgtcccctttggggtatgccttgatggcaagctgacattttaaagctctatgtttaacttctacattttcttcctctctttttgtagaagtatatttcttgttttctcagatgcctagcttccagagaaggtcataaaatacctttttgtcaatgtgaagtgtttctgaggttcttttctgttgtcatgtttccatctgccttctctgtcccagcttgcccttgttgcttttatgaggaatatgtgtgagagccccttgcacttcgcagaaaggccttggtagccagcagcttgagtcaagtatgatactatcacaaggagaatgtttaaaatgaggaactaagtcaaggagagggaaggataatcagaaccttgagctgaaggctggggagaggctagtggggtgtggttaacttcatgtgattagaggtaaagccatcgttcaggaatattaggtttgcaatttgagggaagttaagggagagcagaaacatgcagaaatgaccaaagtatctggaatatttggaagaaagaacacatcctactgctggttgtaaaaaatcgctgtcccacctactcagggtctttagagatgttcaagaggactcttggtgtatgaaatgcttttatagttgtctttggagccatcacattttctgtttttgtttttctctataggttaaagccgagccagccaaaatagaagctttccgagcttcactttccaagctaggggatgtctatgtcaatgatgcttttggcactgctcacagagcccacaggtaccaagaaccttgtagactaccacactgagaacagtattcctatttacttgagtagcccaagctctgggttgtttttggagagttttgtattatactgtaatcctttcagcttctctaattggaactgccactatggctcttgttgagtagctctcatccaaagaggaaataaaggtaaaaaaatgttggtaattgtagggctttttgtggagtttcaggaagaggttgctctttctcaccttagatattttgtacagagttatccttttatgaacgttataagatcagactctcatgctgtcagtaggaagcaaattgaggaatcctcttctgctatcatcaaccggccaattacttactgtgatttgccctttggcctgcctgaagagtgttaactgggtatcttaaattctacctaagttcattacttttttactctttccctttgaccttgcactattagttaaaaatcttatcttgtacctaagtgttttttgttgcaatgtagggatgaaaaccatgatttcttgcagtccagaagtagaaatattttagtgataaggagctggcctctaggactaggaggaatgatagggattgactagaatctgaatgtctttgatcttttctagctccatggtaggagtcaatctgccacagaaggctggtgggtttttgatgaagaaggagctgaactactttgcaaaggccttggagagcccagagcgacccttcctggccatcctgggcgggtatgaagaactctttaagatcatgctttaagtattgtttgcctggtagtaggccataacttgggtggtttattgtcatatagctcagtcacactgggtaactgaggagaatttaataaaggaactacaggctgggcatggtggctcacacctgtaatcccagcacattgggagggcccaggcaggaagattgcttgagcccaggagtttgagatgggcccagacaacaaagtgagatctcatgtctacaaaaaaaaattagctgggcggtggtggtatgcacctgtggtcccagttaccagagaggctgaggtgggaggatcacttgagcctgggaggtagaggctgcagtgcactgtgatcacgccactgcactccagcctgggtgacagagcaagaccgtttctaaataaataaataaataaataaataaacaaacaaacgaacgaactacatacagaggtgtgggtagggttcagggaaaccacaaagggacagtacagtaatttggggctaccaacaggcatcaccatttctatgcctgaagggacaaagggaggggaatggttatcagaattcagagaggaaagttggtgtggagagagctatctgatgggaactgtagcctttggtcaaaggacacaagatctggtagggagggggagccagggcaataaatattctgatctcctttcagtctcctgctgctgcaccccctcccaccctcaatttggctgaaacccaaatggaagccagagcgcaagaaagctccttgatgtagtccatgcaggtcctcctcctgtgatgcaacagggtagagaaggatagaagatggctctgcagggaagaatgggaaagatccaccataggtgctcatttagcaattttgaagtgcttgagccttataacctggcagggtataactatataacctggcagggtataaccatataatctggcagggtataaccatataatctggcagggtataaccatataacctggcagggtataactatgaaaacctcttcatatgtgtttaatatataatttagacctcatttctccagattacatacctattttatcttttctcctatagggaaaggcagcaagtagataatgattttccaatgggttagttaaaaatagaaatttcagaattgagggttgagaggaggataaattttaggtgagagagctagcactgcttggataagacaatttcctgtgacttggtgtggtgatctaggtagcagtctctttatggctggaggcccattacccttctatgagcagggttttttcccccaggggagtgaacatactatctcctgatgaaaattgactctggagttgggtgtcaatttcaggtagcatagttgcttatactgtttggctctgtgtctccacccaaatctcatctcgaattatccccacgtgttgtgggagggacctggtgattggatcaagggggcggttcaccccatactgttcttgtgatagtgttgtttggcagttccaccctcgctcgcctctctcttgccaccatgtaagatgtgacttgcttcccctttgccttccgccacgattgtaaatttcctgaggcctctccagccatgcggaactgtgagtcaatttaacctttctttataaattaccaagtctcaggtagtcctttatagcattgtgaaaatgggctaatacagttgctttctaggctttatgagcccagtttcagagtcttaaaaataactcaggtagatacaggttgttgtgtcttgttcttggaaaaaggtatctattcctgggctttgttcttcaactttctgtagacctggaatatgggagtgagtgccacctagtgctaccttatggttaggtttttaggttcagactgaaatagctgttacggggaattggatgtgagatttttttgccacctttcttgtagtgtagtttccctaggccattaacagtttttgggaaaacttttatattttattaaacaaactttattgtaagaaacactcatatgtatggaagttgagagaatagtgtagtaaactcccaggtatccattaccctgtttcaacaattaattgacagttttgctaatcttgtttcttttatgtcctaactctgttttgtcaggaatgtacacacacacacacacacatatatatacacacacacacgtatatattcctgacaaagtgaatacaagtgaaataaatatgtgtatatatgtgtgtgtgtgtgtgtacatatatagatattttagatatatagacatatctatatatctagatctagatctatatatagatttttttttttctgatacagggtctcactctgctgcccaggctgaagtgcagtggcatgatcacagctcactgcagctttgaccttccaggctcaagcgatcctcccacctcagcctccctagtacctgggactacaggcatgcatcaccatgcctggctaatttttgaatctttttgtagagacagggtctcactgtgttgcccaggctggtctcgaactctggggctcaggcgatctgcctgccttggtctcccaaagtgttgagattacaggcgtgagcttgtgccctgctgtcaggaatgtttttaagttagccttagacatcatatactttcacttacataggttgagtatcttttatctgaaatgcttgggaccataaatgttttggatttcagatttatttttggattttggaatatttgcatggtacttaccagttgagcatcctaatctgaaaatatgaaatctgaaatgttccaatgatatttcctttgagctcaaacagttttgatcttggaggattttagatttttggattagggatactcaacctgtaatactcctgtatacatcttgtaactgctaagcagatttcttttaaataatcaccatattatacctaacaaatttagcagttttgttactatcatccaatacccaatctgtattcagatgttcttgatcatctcagaagtgtctttttacagttggtttgtttgaataaggattcaaatgaagtccatgcattgcctttggctgttaggtatctcttgtaataatctcctatttattactttcattctgttgatttgttgaagaaacaggcatttgagctgtaagctattctttagaagaaattgaactcctttctaactgctttcttccctttgtgtgtgtatgtgtgtgtgtgtgtgtgtgtgtatttaaaacaatctatctttacccttggtggtaaccaatctttacaactgaaataaatagtaaatagtttcttgccatctgttcacccacatcactgttgtttcatacctccttttcacaaatcctagcatagggtttctcactggataggcattatcttgtttattgaatgaagaaggaaacagacacaaggtggtttgtccacgtaagtgggatttagttatatgggaatgtttatggaaggcaggctattactttgtttctctttagtttggatcttttttgtctcatagggagatgcaagatacatgtgtatttatcttatttccatgtactagaaaataagatcccaaagggtagggatctttctgttgcctttgccctgtgatgtttctcaaagacctagaatagtgcttggcacagagtaggtgcccagtaaatgtgttgaattgggtgacccaataaaaataaatgccataaagaaaatgtcccaggctgggcatggtggcttaggcatgtaaccctagtgctttggaaggccaaggcaggaggatcacttgagcttaggagtttgaaactagcctgggcaacatagtgagaccttgtctctacaaaaaaatttaaaaagaaaaattatccaggggtagtgttgtacgcctgtggtcgcagctacttgagaggctgaggcaagaggattgcttgagcctaggagttccaggttacagtgagctatgattgtaccactgcactccagcctcggcaacagagtgagactttgtgttgaaaagagagagagaaaaaaatgtcccagcaactgagcatagggtatgactttaggaatatatatttttgttcagtatatatttatttagtatacagtccagtcaatccctgctctaaggttaggataattctgagtggctctgggatcccacaattagcaatcgtgcttagatacaattagcaatcttgatgctctgaatttgtgtgtgtgtgtgtgtgtgtgtgtgtgtgtgtgtgtgtgtgttggggaatgtgcaaaatagatgtggaacccatagtttccttagacaagagtaggtcttctgagccctgcttaaaaaaagaatatggatttaaatctgttgtccatcagcttctaggtagaattaaaaaaaaatgtattgatggtaagtggggtgaggaatttttaaaaagatacactgatgtctggagccataccttaaaaggatttcttagaaatggattgagtttttgggttggagaaacatagggcaaagttaggcagtacttttgtcactttgagactttctctgttcctgtgccttgaaatagaaactcagtttctatgtaataccacttctctagtccattcttctttaagtgatgattcttgctttctcttgtagagctaaagttgcagacaagatccagctcatcaataatatgctggacaaagtcaatgagatgattattggtggtggaatggcttttaccttccttaaggtgctcaacaacatggaggtaggaaacaaatgccaagtggatgtgaaatagctctccatgataatagcaggttgtataaatgtaaaaagaaaacagtcttttgacatgagccctgaaaattcccatttttatttattttggcaagtctttcgtctttgcattgttcctttatattgtattgtgtctggttcctgtctgctttgtgaggcagtcttgttcttagtatagatgctgacctccatcattttggctcccctgtgtagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatggtgagtcacttgagtgggttggtagtgtgagtgaacagaaactctgtggtgtcatttattcattgattcagccaatcaacaagcattttaaaacaatctctataggagatctgtcagagagggctctgcatgttgcagtgagtccctcatggaagaatccatgggagaaaagcagtgctattggattactggccttcagtaatgcagtaatgtgttgcaaaactttgttgttgttgtttttttttttttttttgagacagagtctcgctgtgtcaccaggctggagtgcagtggcatgatctcggctcactgcaacctctgcctcccaggttcaagtgattctcctgcctaaccctccccagtagctgggactacaggtgtgcaccaccatgcccagctaatttttgtatttttcatagagacggggtttcaccatgttggtcaggatgatctcaatctcttgacctcatgatccacctgctgcggcctcccaaagtgctgggattacaggcgtgagccactgtgcccggcccatttttagttttatctgttttttcttcatctgtttaatgtgtattaagtacttactgcgtactggagatagtgtcatgtactttcatggtttgggttgttttggattatgttgctatctagaaagctatataagaaaactttctcatatgaaaaaattaagtatactgattacaagcagggagaaatgtaagtgtatattaaagactaatatagttgattttagggtgctccaaatatcattttgattgctgtataaaattgtatcatgtttttacatgctagtttgcttatttttcttttcaggcattcacgtattatttagttcagtgtttctcaaagtatgttcctaagaccagcagtatcagtatcatttttggaacttgttaaaaatgcaagttcttgggtcccaccccagacctaccgaatcaggaactgagggtggggccaaacagtctgtttgaataagccctcctggtgattctcatgcatggcaaagtttgagtactactgatctagtttactgtcattcccaacactattgacatctgttgttttgtgggggactgttgaattgtaaggttgtttaaagcatccttggccactagatgccagtagcaccctcccaagttgcaacaacaatatttctagacattgccacatgcctatctattatgaaggggcagaactgacctggttgagaaccattgatctagttttcactaacataaatagtgtggctaagaatgtctttattaaataacttttgaggttttccgttagacttgatcttccatacagtagaatttttgagtataaagggcatgaacaggtttataaagactgaagggtactatttgtttctagaagaaactttggtgtgcagccctgagttctggtcttggtggaggtggtgtttaagtagcttttcttgatagctcatcttctctttcacctctacccctcagggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtaagcggtcctatacaaagctaatacccatataagctggcagaattctgatcagaggaaggtggaatggagaacttcttctatgtctctttattctgggtaaatgttaagaggtaaacaggtaggtaatttacagaggagcctcttggtaagatagagttgggggtttatcagctaccttttgggttggggagcacactgccttacagttttggtgccaatcccttttttttcttttctctcttttccctttttacctggctttcattcaacaggtggtggagacactgccacttgctgtgccaaatggaacacggaggataaagtcagccatgtgagcactgggggtggtgccagtttggagctcctggaaggtgagggtcttctgttttttggcttgtttgggataagggtggactgtgcagtgagaggtgggtagaatggagtggagaaagttagaaggtagtgttgtcattagcagtcattactacctgggcagtacagaggaacttcagataaagctcctggcatccactgaggcggggagggacagatagaaacttggtctgagagttatggtctagtagacctggaatccacaatgtaaaagttggccagctcctggccatatatcctaaaaaagagctggcatgttattgggaagataaagtgggggaaatctggcttactgggccctatagtaatgctgtctatgtatgtgtgctctctcaaaaacaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgt

SEQ ID NO: 38175 - DNA, 3880 bp, Homo sapiens; identical to SEQ ID NO: 37743

SEQ ID NO: 38176 - DNA, 26664 bp, Homo sapiens; identical to SEQ ID NO: 36165

SEQ ID NO: 38177 - DNA, 95789 bp, Homo sapiens; identical to SEQ ID NO: 35713

SEQ ID NO: 38178 - DNA, 181196 bp, Homo sapiens
gcgggagagacggaggtagagggaggacacagagccgcgccgcccgcaccacagaccttcgcctcgccccgccggttcctcaccctcggggagcaacatgggtaagtcatccttcctccgccgtcatcgcctgacatttttttctttctcggcgtgctgcagggtgggaagcatttctcgcgcaaagttgccggatttctccagtccccgggtgtgagacggtggctgttcctccggggagagtcggcgcacgcggaacgcacgccgggtgccggggctgggagggtcccgagcgcgggctggggtggggtcggccgcgggccggaccgccgcccggctccccggcacctcgcagcctcgcctcccctcctccattcttcctgccggtgcccgggcaccacggagcctgcctcgcgggctcgcatctgcagctccatccccgtttctccagaggccgcccgcttccttttcccccgcgtgtactgagctcgaggctcgggtccgaccactaccacttcgtgtaacttccttctctgtcagtgcgacctttccccgtcgtggagactcctcatcccgggcggggaagtggaagcaagtagtttgtgagggagatcttacaacctgcacggaaattattttccaagggggagagcggacagcctcataggttgaaaggatgacttgtcagaggccacgaggaacgtgaggcaggatagagccgctagctgttgaattagtgctgggtgactacagtgtgcaatattcccgtgcccagcctattttctggattccttcgtccgtcttctgtagcaggaaactgcgccctgtaacgttgttaccgaacttacatggtagttattctttcccagcttcctcctgtctaatctgcataatctgattttagttcctttgtatttatagttaatctgaagagattggtttggatgagagatttaagagcaaatatgttttataaaacgatatatacatttgacctaatttttttacatcatctattgcttaactgttacattcagtaatcacagaaacgtctgatgaatgctgtcatgtaattaagagctcaaagtttcttttaatagtagcgacttgtactaagttccccagtttgcttccactcctgtctgtcataatttcctctttttaaaatttgctcccttggcatctgtcagctgggacttttcccaccccttctgtgcgagttatttaaagcttgagatgaatgtggtcctttcatctgttaatacagtgctcaacacgttcagagttaggtggtgcaactcagaatcttcaagaagtatctaaacctgggaatggtgtccatagagttttctggaacagcaaatgcttcaggctttgatcccgacctttggccatatatctggaagaggccagggttgacggaggaggtggtatgaatcaaaaaaggtctagggctctgaattttattttcagttgttttttctttttaacgtgagtactcgatatgctgaacaaatttctgtaaaaattgggtggcccatttatgcgtgtctgcctttctcttaaagtagatttttaaataggtattatatcagattattggacaagctgtatatttccgtcgaacatacacacgtttatgtgtgttccctttgaacatacacagataaaatacactttgaaataaaattcctttgaacatacatacacagataagtgtgtgtatgttcaaaggaaatatacagtatgtccaataaccctatctgatattggactgtaagttcaagtttggcttgcaaaatatattttcccatgtttccaggtgagccttaaacaatccatttaacattttagcttacatgttaaatccgtactttttcagtggaaaaaatccaattccgttacaacactggtgaataaaaatacctaaaagaaattatctacttaaaaataatcttcaaaatcttgagtgctattgcttgatttttaaaaagggccaaatagaaacctatctctcattttgaagccatctctgatactctttggttaatctgtctcttcataagcactgtttgtaccttgttagaagctttttagcacttacgtaatctaccatataataaagttgtttatgtgtgtgctgtgcatttaatcatgagtcccagaagatgaaaagtgtcttattattttttgtgttccccacagtgcttttcaaatagaaattcagtaaatctttggcaaattgttgaacttaaagccacctattattttcaacttttgaacctgaagatatagtcttcatctgaacaaacatttgggttggtacatattatctagttgggggataagcagaaacagaaaggtataattgtaccatgcctcccagtacactgtaggttggttttgagtcaacctcaggcaatctgtttccttctaaactctcttcaatggtaaggcagtttcatgtatgatcagtaggtacatatgataatttaaaattgaaaccttggggaacagttttatatctgggccaaggaagttagtataacaattcatgtacacataagaaggtagaaggtatactggttaatgatgaggggagggagaagtgctttttaatttgtctcaagaaataaataaggttgatttttaaagatagtctcagccgggcgcgcactttgggaggccgaggcgggcggatcacctgaggtcaggagttggagaccagcctgactaacatggtaaaaccctgtctctactaaaaatacaaaaaaacaattagccgggtgtggtggcgggcgcctgtaatcccagctgtttgggaggctgaggcaggagaatcacttgaacccgggaggcggagtttgcagtgagccgagatcatgccattgcactccagcctgggcaacaagagggaaactctgtctcaaaaaaaatatatatatatattctcatggcaataatttcctacacaagagagtgaaagaaaagtcctatataactttatggccatagctactattttatgtatatgtcatatttcagattcaacatacatttagtgtttgttggatatcaactgtgcagtgtactgtactacagtgtactgggaggacaaagataaaaagatattcatgtttcacatttataatcttagcaggaacaatatgacacatacacaaattataatagaagtaaaagtataagttatataaaagacctttacatatattatagattcagagaatggagagaacgttttagagaaatggtgttatttgaaccaaaggtgggttaaacttcttaaaggtagaaatgagactgttaatcagaatggagttggtctggggttggaagagaaatgacataaatgaagatagataggaaacattttatgaatttccaggatatgattaaacagcattgtttggctagagcaaaaggtaaggaaatagtgggtaacagacatgaaaaagtagtacagtaatagctaatgaccagataatgtaggatctaaaatgccaagctgaagaattttaatctgacttacctattgagagaccactaaacatttttatgtagttaagtgatggatcacatctgtggtataggaaaatttgtcagttgagtgcaggatcgattagatgagaaactacagaacacttcagaagattgttgttggagtttggacgaaaatgtttaatggcttgaaccaggttatggcaacgggaatagaatattgcaaataaagaataggatttacttggcaacccattgagtatggaattgagagtcacaggttttagcctgggtgataatgaggatacgagaatctcctgatacatattcagttaacaggaagaggaaacttagatactcaattttggacctattgcattagactttttggtctgtcctttagtctctgctccttgataacaaggacgttgtcatattaggatttgaatacatttctaacactagtgtctggcacatagtagctacatagaaaaattgtgttgactgactgaaactagataaaaaatagttgacaaacatttattttaactttcgagagtacaatttgaattagagatctggaagttatccacaaatatcctgaggtgatatttgaagttagatcagaggacaagagtcaacaaagaaaaagaggaaaattgttcatggtaagaatcttgaggaatggggttccttaagttttccgtagttagggaaaaaggaatggtatgatttcacactgaaaaacacagaagtcagagtgaaagactagaattggtatatggttggttttaagaaagagtgaatagttaataaggtctgttttttcagaacagtcaggagggtgatagggactgagaacaggctctaagtgctttggttaggatattacccagtatatttttctaaaaagccactttaagaggtttagtagatatggaggtcagttgtaaaggctaagtgaataataagtggaaacagttcactaggtatagtcatgctgtatttctcaccttgtttaaagatctgtgagaaaacatagatttttaaaaatatttttaactcactctgcatgacagatattacattttagaaaatattttaaaattttaaatgtattttaatttacaaattaaaaaaattattttaatgttacattttacatggaaggacatgtgctgttttcatgtctaaggataatttttaatttcaccatagtgcctcacatttctctgacatttcatttttaatgtctttgtgacttagtatagtacaatttttatttttataatgtctgtcatgcagagtgagtctagaatgattttataattttgcatggcattttgcctaaacaatactctttactgatgaatggttttatcacttttactcttagactttgtgaatttgagacttctttagattataggtatgcttctaattatatttttaattcctggagttgtagttttctctgtagataggtatcaaacttatagtcattttattttgcctgtatttccaagtccaggaatggttttcatagctaaataataaatactaattttgcctgatctttgcaagtctaggcagggtgataaaatatttttgaaagctggtaattactaaaatttatgatttcaaaaaagcatagatgctagcttggtaaatttaaaaatttttcttatgttggcattatatctgttttgtatatgtcttttttcatatgggagaaaggttgaattcactatccttggtagtcatattctgaagtctgtactactactatttgaaaaattataatagccttaactctttttaagaaccaaaatgattttgctttcatagtggaatcttggaatttctaggtgactttggggaaatagtgtggatgctctccagaaattcctgattgaacctgagattgaacatagcaattctggagttattggtggcactaacaacagccatcagaattacctaaattttaatatccagtcatgaacatcaggaggaatgaaggaggaagattcagtcctttgggaacctgatgtaattttagatagccaaatgtttggataactgataaggaaaaagtttaatttaaaatacatgttgatgttgagttcagtttgccagtattttgttgaggatttttctatttatgtttattaaggatattagcttgtagtttcttttcttgtagtatcattgtctggctttggtatcagggtaatgctggcctcattaaatgagtttggaagtatttcccttcattgtttggaaagagtttgaggaggattggtattagttccttttttaaaataatttcaacttttagtttaggttcagagggtacatgtgcatgttttttacatgggcatgttatgtgacactttggagtatgaataatcccatcacccaggggtttggagtatgaataatcccatcacccaggtagtgtgcatggtacccagtgggtagtttttcagcccttgcctccctccatttgtccccctctagtagtccccagtatctgttgttcccatctttatgtccatatgtacacccagtgcttagcttccgcttataaatgagaacatgtggtatttggatttcttgtttctatgttaatttgcttaggatagtggcctccagctccatccatgttgctgcaaaggacatgatttcattcttttttgtgggtgcatagtattccatggtatatatgtgtcacattttctttatccaatccactattgataggcacctgggttgttttcatgtctttgttattgtgaatagtgctgcgatgaagatccaagagcatgtgcctttttggtagcatgatttatttttctctggaaatatacccagtaatgggatggctgggtcaaatggtagttctgttttaagttcgtcgagaagtctccaaattgcgttccacagtgtctgaactaatttatatttccactaacagtgtaaaaacattctcttttctccacagccttacagcatctgttttttgtttgtttgtttttactttttaataatagccattctgactggtgtgaaatggtgtctcattgtggtttgatttgcagtctcatcacattaagaggatcatacgtcatgatcaagtgggatttatccctgggatgcaagaatggttgaacatacacaaatcaataaatgtgatacaccacgttaacagaatgaagaacaaaaatcatacgatcatctcagttgatgcagaaaaagcatttgacaaaattcaacatactttcatttttaaaactctcaacaaatttggtgtagaatgaatatgcctaaacatagtaaaggtcctatatgacaagcccatagctaacatcatacttaatggtgaaaatctgaaaagtttatctcagattgagaaaaaaaacaaggatgcccactcttgccactgctatttaagatagtactagaagtcctagcagagcaaatagacaagaaaaagaaattaaaaagcattcaaattggagagtaaaatgatctgtttaaagatagcatggtcttatacatagaaagccttaaagactccttgaaaaaaaagacaaaaactattagtcctaataaatgaattcagtaaagtttcaggatacaaaatcagcatagaaaaatcagaagcatttctatacactaacagcaaactttctgaggatgtaatcaagaaaacaatcctatttacagtagctgcaaaaatataaaatatttaggaatagatttaaccaagaaggtgaaagatctctatgctgaaaactgtaagacattgatgaaagaatttgaaaaattaacagatatcccatattcataaattggaagaattaatattgttacaatgttcatagtactgaaagtgatctacagattcaatgtaatccctatcaaaattccagtgaaacttttcacagaaatagcaaaacaattctaaaatttgtatggaaccacaaaagatctgaatagccagaataatcttgagcaagaagaacaaggccaggggcatcacactacatgcttcaagtcatgttacaaagctgtagtgatcaaaacagtatggtactggcataaaagcagacacatagatcaatggaacagaatagagaggccagaaataaacccaagaatttacagtcaattgatcttcaaaaaaaaaaaaaaaaaaaaaagccaaggaaacacaatggggacaggacaatctcttcaataaacactgttgttaaaactagatacccacatactgaagaatgacattggatccttattcatcccatatacaaaaatcagctcaaaatgggtcagagatttaaacaaaagatttgaatttgaaaagcataagatgcgcgcaagaaaatactggagagaagctccataagattggtgttggcaatgattttttgtttatggcaccaaaagcacaggcaacaaaagcaaaaataaacaaatgggacttcatcaaattaataagtttctctgtagcaaaggaaacaacaaaatgaaaaggcagcttacataatgaggggaaatatttgcaagccgtatatccgattaggggttaacacgtaaaaataatcaggaactcatacaactcagtagctaaaataaaataaaaatacaggttgaggatccctaattcaaaatctgaaatgcttcaaaatctgaaactttttgaatgctgacatgacactcaaaggaaatgcacattgcagcatttggatttttggtttcagatttttggattagggatgttaaaccagttagtatcatgcatgtattccaaaatctgaataatttcaaaatctgaaacacttctggtctaaagcattttgcataagggatactcaatctgtatttacctagatgtaaataataaatgaatatattagaataggttattgtctcagtccattttgtgctgctatgacagaatactgcagactgggtaatatataaagaacagaaatttattctatcagagttctggagtctggtaactacaagatcaaagtgcctgcaggtttggtctttggtttcaagatgaggcctagttgctgtgtcctccaaagaggagaaaccttgtgccctcacacaacagaaaagcaaaagagaaaatccactctggtaagctctttttataatgccattaatctatttatgagggcagagccatcataacctaaacacctcccattaccttccagtactgttgtgtttaagtttcaacatgagttttggaggggacaaaaacattcaaaccatatagttataaagactatttcagttataaaagcctgtgattccttgaaactgaagtttgaaatatactccatatcattggtatcttaaatataacctctatataacttgtttttctttagtgttcaaatggtaatgtatacttgaggtagcaacttaagggtttgaaccaactttagctttgtctgaataaatgacctaaaaaaacatttctcaagctggctaagatatggatgctggattcaaattgcaggtgaaataattctctcagtgcttctatttatatagcttttgtaactagaagcatttcaggagttaaaaccaaggactaggttagtgataaatggaagtggttaaattgagctcttagctatgattggctgtacagttgaccgttgaataacatggatttgaacagcgcagttccacttccatgtggatttttttttttcaataaaagctataccaagtgagttgcctctcctgcctccccttttacctcctccacctctgccacacctgagacagctagatgaacccctcctcttctcagcctactcaagagtgactataataaggatgaagacctttatgatgacccacttcccatgtaatgaacagtaaatacattttctcttccttccattttcttttctctagcttaccttattgtaacaatatggtatttgatgcatatggtatatgatgcatataacatacataatatgtgttaattgactgtttatgttattggtaaggcttctggtcagcattaggctattaaggttttagggagttaaaagttatgtgtggatttttgactgagtgagagggggattggtacccctagtgcctgcattgttcaagggtcaacagtacttgttaattccaaagtcctttttgttcacaaaatgactttaggtacttattggtactgaaatatatttattaatatctgggctacatctttgtatttagcagattagtagacatctctactaattaaactcattgagttcaaaataaaactcattttataatttttaataatgataattagaggggtgctggtaaatgtttaactaaacgcctttctccaaaatagccctgatttgtgatggctgtcaatttcctgtggtgtaaatactccccccatggctcatttcaagccgctaaaatagtgtcactgaatgcagagttgagaagagataagaggtagcacatcattatataccatatccaccatacagacataatctcattagcacatataatagtaaaatgtaaagtaagtagtgatggttttgagtgttaattcttctgttttagtataactcatttatgtatatataattatgttttaataactgcctcataaaaatcctgaaaatttaataattatatctcatggggtagtatagggggctgtataccattgagttcataattaccatttattaagaatgattgatgtgagttatgctacactttacatatttttaaaactgaattttaatcctttcaacaattctatgaagtaggtgacactgtctccattttactaaatcaaagaattaaataatttatccaaggggacaactaacactccaacatcctgatttagagcaatggttttcaaacttcagcttgcatagaatcacttgaagagcttgtttttaaaaaatactgggcccaccttcagaagttctggttcaatagatgtggggtgggctgagaatttgcattgtcaagaccttcccaggtgatgccacactgggaacagcaccaccatcaagcataggctgacaagctttttccataaaggaccagatgataaatatttcaggctttgtaggccatgaggcggaatcaaagatactacatattgggttagtgtgtaagtaattgtggtttcagactctgcattttaaataattattactaggcgcaaacacatctttattaatcaaaataggaacattaaaatcaacacatttttgccaatgggaagtaagtttattcctgtagcattaaaatccatgcttcgggatttatcaaacacttggaaagcattttctgcatcctgctggttgtggaagcattttccctcctaaaagttgtcgagatgcttgaagaagtggtagtcagttggtgagaggtcaagtgaatatggcaggtgaggcaaaacttcatagctcggttcgttcaacttttgaagcgttggttgtgcgatctgtggtcggacgttgtcatggagaagaattgggccctttctgttgaccagtgccagctgcagacagtacagttttcagtgcatctcatcaatttgctgagcatacttctcagatttaatggtttcaccgggattcagaaagctgtagtggatcagcagcagaccaccagacagtgaccatgacctttttttggtgcaagtttggctttgggaagtgctttggagcttcttggtccaatcactgaactggtcatctccagttgtataaaatccacttttcagttgccatataaaatccacttcttgttgcacgtcacaatctgatcgagaaatggttcattgttgttgcgtaggatgagagaagacaacgctttaaaacaacgatttttttctgattttcgctgagctcataaggcacccacctatcgagctttttcacctttccaatttgctgcaaatgctgaactaccagagaatggtcgacattgagttcttcggcaacttctcgtgtagttgtaagaggatcagctttgatgattgctctcaattggtcattgtcgacttctcatcttccactaccctcctcatctaggctctcgtctcctttgcaaaacttcttgagccaccactgcactgtatgttcattagcagttcctgggccaagtgcattgttgatgttgctagttgtctccgctgctttacgacccattttgaactcagaaataagaaaatcactcgtaaagagaactgtgcattaaaatgatgtataacataaccacatttatttaagaatgtattcgagcatctaacagcaaatttcaacaatgcaaaaactgcagttatgttgcgccagcctaatagaaaagggaaaaatatatatgagagaacataaatgtccatcattttttttactacatttgaaatatgataacattaattgaacacaatttattgtgattaaaaaatgaaaagactggagttctttttttttaatttatattttttattttaaagttcttttgggataacatttcacttattaagattcaaagttatcctcttatcagaatttattgtagatgttcatctgttaatgcagacctgtaatgcagttttacaaatttcatctttgaggcatttttttccccacacaaataagtactgccaattgtatatgatcttaatgagcatattcattgtatggaaggcactaatagaattctctcagtacagctgtaattgttggcaaaaagcattgttttgttttgttttttttcccaagacttttcttgatatttgctatttagtatgcaattacattgcagattaaccacttccaatttaaggttaggtgggagctcctcaattgcatggttaaatggattttgaaatatagaaatttcctttgcacttgcagtgaggtctgaaaagcactgcaggaactatagtttgaacttgcaaaatatatctattgcaaatttgtgtatggagggagatctttttattttaacatttgacaacacaggaagtatataaagccattattacttgtaattggaacagtgttgtcaaaatgactttattgcagtattttctcacgtaagcactgctttgccttgacttttaagtcagattcattaggaaactgtcaaatttgcagcaaattttaatttccaaagctatagtagtggttaaaggcatttctttttgttcagaaaatttcgtttgtgacctcgagctcaaaaaaatcacaataaaactctgtaaccactaagccattagacttctgtgtcataaggcaagtccagattttgtttccatttctgatcaaaatttacagaacttatgatggttaaatctgtgagaataaatgaagttcactggtgacattactggttcagtgatacatgataaattaatgttttccctactggttcaatgatacatgataaattgttttccctattgatgaataatagagtgaagtaccatagctttaaatagctatgctttcacaaactttgtaaatttgttcaactaaacctttttctggtcttcatttatttttgtcaccatcagttgcaacacatcttaacggattccacttcaggttatactgaattggtgctttctcaacttgggaaatattcttgcttattattattttatggagactcttcatagactctaactcttccgtgatttcaagcttggaattgacttcttgagaaaaaactaagcagtatcattaatatctgccagctcatcaagagccaaagaaaacctctacaagtcttttgccttgttttttagttgaatgttagtattgctcccagtgtcctcatctccagtagttattctcactgaaaggttaaacaagtttattttctctggaaacattggtggctacagccaaatacaatttaattaactccccatgggtaactggatttccttgcttggataataaatgagatacccggaagcttaatttgtttgcagctgtgtgtgtgtgtgtgtgtgtgtgtgtgtgtgtctgtgtggaaattctgctgtgatgagatactttgttttatattttcctgatttctctgatgataacttcctttgtcttgcgaatgtgatgagtgcttagtctggtagtatcgatgtatattgtatagtacaatggtttgccatctaactcgataacaaaacaattcacatactactttaaatgccttaaaagtgtgacatgcttctcttattttgacaggaagatcaaatgtggtataacagtatactatggtttttgaagcacttgacaagtcataactgtcactgcaatttgtagtgcatccagcaactgtgtaaagtgaatcattctgttacaacccctcaactctgctatcataatgcaaacacagctataggcaatgcacaaaggaatgagttgtgttccaataaaattttatgggcactgaaatttaaattttatataatttgcatttcatgaaatatgtttttcccttaattttattcaaccatttatagaagtaaaagccattatttttgcattacttttactttcaccattacataaaagtatgtatgggctgtggactgtacaaaaattttacgtaggcaatgggctgtagtttgccaattcttgctatagagtagtgctgcactacttcacctttccacaagactttttctctctatgaattccctatctaagtgaatgataccaccattcatccgtgcaactgttcctaaaatctggagtcattcttttaatatcattgggttccctaagttttagcaactctactactttgaattaaacctcccacctctttactgtaaacatgtaagtttaggcccttattacctcttcttgagactacactacccttttaacagatgttctttcccctggcatccctcttcttgaccagtttttacatgctgctagagtactgtctgagttcatttgggctgctgtaacagaatactatatattgggtggcatataaacaacagatttttttttcccacagttctggtgactgggaagttcaagatcaaggtgctggcagattcagtgtctggtcaaggcctgcctcctggtttataggtcatcttttctatgtaacctcacacggtagaaggagtgaggaagctctctggaggttgagtttataagggcactaattccattcacaagggctccactctaatgacctaatcacctctcaaaggccctaccacctaatatcatccacattgggagtaggatttcaacatatgaatttttaggggacacaaacattccatctataacaagtactctttctaaaatgtaaatctgattgttttactccttagacatattttgtaacggttttccattacctagagcagggttcccaaactcaaatgtaactgattaaaggtaattaaatggtgatttttttttacatacccttttttttttttgcatattgagtaaaagagaatattttttatttccatgaagatggctttctcttatttttcttaaagtatgtctttctttttgtctttcattttgttactttgaataaaaaagaacagcttagaaatacatttctctgctataacaaagacagcagcaaaaacatgatgaatggcatctaacactggacatcattctaaggatacagaaggaaatgctgggactatggcaactagagcatttgcccaacctggaaagggattccctgtgcaacctcaatgagttttgccctaagaatgtgggcccaaggaagtcacatttttgacttttcaaaagaagtcagaaaccagatttttaagtctgaaatcttcagatggctggttttggaaatggaaaaatattgtgagatctggaacctcaaatgatgatattatggttctctctctacttggctagattagggaactgaggatcagtaagacctgtcaagagacaggtctgagttcatgcctttagttaggggcagtgtcaggcctagaatgttgatctctcaactcctatactagtgttctttttattataccagactagctccaatttgttactgaaaaaaagcaagcgcacacatacataacacacacacaaacatgaagaagctaatactaaggattcatccaagtaagtgagttgatggaaaactgttgtccctttcggacatttccactaacagaatccagacactaatcacctcattcctgtagtactgagatactagactttctgctccccagtcctttctatatactatgaccagattaacatttttaaaaagacactacatcaattgtattactttcttatacaagaatctaatattgcttcaattgcctatcatatcaagtctaaaccatgctgagctttcaagatccatggaactttgctacctcttatttctcattactctctggaacacatcttcctttcactgtcccctatattcttcgtcataacaccagtatatctttgattctgttattatattatttcttctagaatagcctgttttcttctgtcttcttagtcatttttcatagtctaactcattaagacggcttctgagttctactgacctctcatttctgtggtacctactactacttagatttcaaatctcattcagtgatgtagttctattcactcagtgtttcatatttctttttggcatttggtaaatacttgtttgtagatgttacaaagtcactacagatttaggtcatgctactactcttaacaacagtatcctatagtgataataggaatttttataatagagtttgtcaggcagcagcctgtgggccaaatataccatgtagatggattttgttaaggagattttagaaattggaattaactgttaacacttaagaaatttctgatgaaaatacgctttctagccaagtggtggcttacgcctgtaatctcagcactttgggaggccaaggcggatgtgtcacttgaggccaggagttcaagaccagagtggccaacacggctactaaaagtacaaaaattagcctttagtccaaccaagttactcaggaggctgaggcatgagaatcacgtgaacccgggaggtggagattgtagtgagccaagatagagccaccgcattccaacctgggcgacagagcaaggctccatctcaaaaaaataaaaaatgtacaataccctaggctgcattcccattaaacagtcatctgtagttgtcttttaggcagggtatgaggtccccctagttttcattacttcttattatcttatatccttcaaatttcactcattaaaactcctgtttatctggttcctggaggtatctgaattgctaaagatttaattatgttcaaaattactgtaaagttgaatttatattactttttgaaaattaatattttaaaattaagaagttaattgtgaaaatttaatcataaaagtagtcaagagcacagttaactacttatgatctatatagtcactaatcatggttaaactgaatttttaattaatcagaatgatataagaaatcatagagatatggaatagattctctgctctcccatgaactgtgtatagccttcagcaagttgcttaagctcttttatatcctcattttatatatacccttaagatattatcattgtcattgattaagaaccacagaatagattccaaatgaaggaaatggggggcctattttataaggaaataatacaaattttaatatggaaactttcaagctcagttacctcataaggacttcactagcctaaaccaagatctgttggattttttctttccttatttttggccttgcagcattaaataaattttctaggaaaaatggcattccattttaaaaagtcatcatagtataataatagggccactaggccgggcgcggtggctcacgcctgtaatcccagcactttgggaggccaaggcgggtggatcatgaggtcaggagatcgagatcatcctggctgacatagtgaaaccccgtctctactaaaaatacaaaaaaaattagctgggcatggtggtgggcacctgtagtcccagctacttgggaggctgaggcaggagaatggcatgtacccaggaggcagagcttgcagtgagccgagatcgcaccactgcactccagcctgggcgacagagcaagactctgtcttaaaaacaaacaaacaaacaaacaaaaataataataatagggccactatattttttctaaggaacattattatgtcttagcattttataatatatgagttctataacatttaaaataactatatgcaaaagaattacataaatgatatataattttaaaattttaagataattacatttaaaaaatttttaaatgatataaaaaagtatataatttcagataactagtaaatgattgttggaatttttttttcatatggaaaaaaacaggaattgaactttttttttgtgacccagaataattttttttgagatgcaaattatttatatatacttacatgtatacatatattgcataatttatatttttgacattataaaatattttctgaactttaagttctgtactttaagtcctggggtacatgtgcacaacgtacaggtttgttacataagtatatatgtgccatgttggtttgctgtacccatcaactcatcatttacattaggtatttctcctaatgctatcccttcccctgtccccaccccatgacaggcccccgtgtgtgatgttccctgccctgtgtccaagtgttctcattgttcagttcccacctatgagtgagaacttgcggtgtttggttttctgtccttgtgatagtttgctcagaatgatggtttccagcttcatccatatccctgcaaagggcatgaactcatcctcttttatggctgcatagtaatccatggtgtatatgtgccacattttcttaatctagtctatcattggtggacatttgggttcgttcccagtctttgctattgtgaatagtgccgcaataaacatacatgtgcatgtgtctttatagtagcataatttatagtcctttgggtatatacccagtaatgggattgctgggtcaaatgatatttctagttctagatccttgaggaatcgccacactgttttccacaatggttgaactagtttacagtcccaccaacagtgtaaaagcattcttatttctccacatcctctccagcatctgttatttcctgactttttaatgatcgccattctaactggtgtgagatggtatctcattgtggcattgatttgcgtttctctgatgactagtgatgatgagcattttttcatgtgtctgttggctgcataaatgtcttcttttgagaagtgtctgttcatatcctttgcccactttttgatggggttgtttgtttttttcttgtaaatttgtttaagttctttgtagattctggatattagccctttgtcagatgggtagattgcaaaaattttctcccattctgtaggttgcctgttcactctgatggtagtttcttttgctttgctgaagctctttagtttaattagatcccatttgtcaattttggcttttgttgccattgcttttggtgttttagtcatgaagtccttgcccatgcctatgtcctgaatggtattgtctcggttttcttctagagtttttatggttttaggtctaacatttaagtctttaatccatcttgaattaatttttgtataaggtgtaaggaagggatccagtttcagctttctacatatggctagccagttttcccagcaccgtttattaaatagggaatcctttccccatttcttgtttttctgaggtttgtcaaagatcagatggttgtagatgtgtggtgttatttctgaggcctctgttctgttccattggtctatatctctgttttggtaccagtaccatgctgttttggttactgtagccttgtagtatagtttgaagtcaggtagcatgatgcctccagctttgttctttttgcataggattgtcttggcaatgtgggctcttttttggttttatatgaacttgaaagtagttttttccaattctgtgaagaaagtcattggtagcttgatggggggatggcattgaatctataaattactttgggcagtatggccattttcatgatattgatttgtcctatccatgagcatagaatgttcttccatttttttgtgtcctcttttattttgttgagcagcggtttgtagttctccttgaagaggtcgttcacatcccttgtaagttggattcctaggtattttattctctttgaagcaattgtgaatgggagttcactcatgatttggctgtttgtctgttattggtgtataggaatgcttgtgatttttgcacattgattttgtatcctgagactttgctgaagttgcttaccagcttaaggagattttgggctgagatgatggggttttctaaatatacaatcatgtcatctgcaaacagggacaatttgacttcctcttttcctaattgaataccctttatttctttctcttgcctgactgccctggcgagaacttccaacactatgctgaataggagtggtgagagagggcatccctgtcttctgccatttttgaaagggaatgcttccagtttttgcccattcagtatgatattggccgtggctttgtcataaatagctcttattattttgagatactttccatcaatacctagtttattgagagtttttagcatgaagggctgttgaattttgtcaatggccttttctgcatctattgaattaatcatgtggtttttgtcattggttctgtttatgtgatgaattacatttattgatttgcgtgtgttgaaccagccttgcatcccagggatgaagccaagttgatcgtggtaggtaagctttttgatgtgctgctggattcggtttgccagtattttattgaagatgtttgcatcgatgttcatcagggatattagtctaaaattctctttttttgttgtgtctctgtcaggctttggtatcaggatgatgctggcctcataaaatgagttagggaggattccctctttttctattgattggaatagtttcagaaggaatggtaccagctcctctttgtacctctggtagaattcggctgtgaatccgtctgtccctggactttttttggttggtaggctattaattattgcctcaatttcagaacctgttattggtctattcagagattcagctccttccttgtttagtcttgggagggtgtatgtgtccaggaatttatccatttcttctagattttctagtttatttgcgtagaggtgtttatagtattctctgatggtagtttatatttctgtgggatcggtggtgatatcctctttatcattttttaatgtgtctatttgattctgctctcttttcttctttattagtcttgctagcggtctatcaattttgttgatcttttcaaaaaaccagctcctggattcattgattttttttttttttttgaagggttttttatgtctctatctccttcggttctgctctgatcttagttatctcttgccttctgctagcttttgaatttgtttgctcttgcttctctagttcttttaattgtgatgttagaatgtctattttagatctttcctgctttcccttgtgggcatttagtgctatacatttccctctacacactgctttaaatgtgtcccagagattctggtgtgttgtgtatttgttctcattggtttcaaagaacatctttatttctgccgtcactttgttatttacctagtagtcattcaggagcgggttgttcagtttccatgtagttgtgtggttttgagtgagtttcttaatcctgagttctaatttgattgcactgtggtctgagagacagtttgttatgatttttgttctaggaattgaacgttaaaaaaaaattgcctttaaaacggtgagaaacacataccatcaaagtttttttgacaagaaattcatcagattttaaaaacaattttttaacttttctgaaaattgaagattcttcaagtaacttcatgaaagatgaaactgatcattacaaaatgcaaaacttacattgatgtagttgtgtttcagagaaataaaaatgttgatttgtttttaatattataagctacatttggtctccaaaatacagttagagcaaagaaaaaatagtatgagctgatgattttcctttagttgcagaaatgcatttctggggatggtgatgtggtggtaagctctaataaaaactgtccagtgtgtcatatttctggcttttatgtgttgcatacaaagcaccatcagtcaaatgagcaacacaagactaccatattaggcattataaacagtgacaaagtataagtagtgcaagtagtcatatttctagttttgaaatgcttaaactctagtagataaagaataatagaaaatgagcgataaaaaaggacataatttagattgtcaagagaaaacacagacccctaagaatttaattaagaggacagattatatttactttttcagcccctaatacagcttcttggacatatataagtgttcattacttaaaatgatctggaactttttctagaatttattatttattcagttaaacacttattgaaagctaaagtgtgtattcagcattgtactacccttgagatactgtggcagactgcttcctggtacatttcattgtgatttttttttttttttttttgttagtcactaattcagatacatagacagttgttacctagtacaactagctaacgtgtttggattataaattcattttggaagagcttacatctatataaaggaaggtacagacagtcctttgcacagttctgattagcacaatatctgtgtaactttcatgtaactgagcaaagttcagctacctatacagaaggaagagcctgtacttgcagacacacgtatatctggatttacccaactttggcacttattctgggcaagttattcagcttctgaattagctttctcatctattacagtcagataataatatctatttcacaagggagttggaaatagtacataaagtgatatccatataatttttaaaaataatgttatctgtagggttttttccccttttattttagattcagggggcacgtaatgcagtttgttacctggataaattgcatgatgctgaggtttagggtacaaatgatcccatcacccaggtactgaacatattaaatagtacacagtagtttttcaaccccaagtaattttaaatttccatttccaaagctaaaaatataatcgtttttagaaaactttatcttgtattcagagctaaaaccaatcaaagactataatgctgtttattgtactattttaaccaaaccatgtggtgaatattaagttatggtagctgattatatttttagaagataatcacaacaatgtctcttgccccacatatttttttagaacttcctaccactcattaagagttggggtctaattctcctattgaatctgagcacacttatgtaaccattagaatgcagcagaagggatgccatgtgactttcctagcttaggtcataaaaggcaatgctgcttccgctctgattgttggaataccagcctgcttggagccctgagaaatccgagtacctggaggttgctgtgtcaggaagctaagccttgtagaaaggtcccaagtctcaggtatcagatttcaggtcagaaatcctagtctttgagtcctttcatgccagtcaccagccatgtgagtgaatgaactgttagatgatttagatcatgccagcttcagccactgagtcactcccagtcacccctagcctttgagactctgcatcaaggctgtagattttgtgaagtagagaccagccatcttgaatgtgccctttgtgattcccgattcatagaatctatgagcgtaataaaatggcttttgttttatgccagtaaatttggggtggtttgttatataaaaacgtttttatataaaacactgaaaagatacatttcctcagtgagcaatagattgctattgaaattcatcaaagtaggaactacctgctgaataaatgttaactgagtttttctttcatttcaaatgaagatagcctaaaaagacatttgcctagagaaatttggtttctttacttgttctttattctgacattaattgtcttgaagagatattaattgactgttctagcagccaggaaagaaatgtatatgcttaaagagtgctgtgggttttaacatagctttatgataaattttaccagtttggctaatgaaaaatgtcaattagtacttttaaattattaagaatagtttccacaaaagtttagtatttttattaacacaggagcctaataaaaccttgtaggaacaaaggaatatctgtactgatctctccaactgaaaattgttatccctgatactaattttaatgttaatgtaaaatattagcatcatcactagtatatttggcagttgtttgagtcatctttcctgtcacttcttagaagacagtggattttctaggttgatcaccattgaataaaattataactgtcataaaattatcaagggatttctgttatgtagtacatattatgatttcctaaaataatataataattataataatgggcactttttattaatatattaatatttataataaataattataaataaattataaataatttaaataaataataaatttaaattataaataataaataattgtaaataaacattataaattatttataatatttatttataaatatattcatatttattataataatgggcacattttattaagattattgccatggctgggcacggtgggctcatgcctataattctagcatgttgcgaagctgaggcaggaggatggcttgagctcaggaggtcgagaccagcctgggcaacatagaaagactctgtctgtccaaaaaaataaaattagctgggcgttgtagtcagcacctgtggccccatatattcagcttgctgaggtgggaggattgcctaagcccaggaagttaaggttgcagtgagccattattgtgccactgcactccagcctgggttacagagtgagaccctgtctcaaaaaaaaaaaaaaaaattattgccgtgagtgccaggagccaaagtattgtaggcctgtcgcatccagacacaatgtatgtgattaggctctctctgtgtagagcctaatcacatatacacagacataattcttgaactttatgagaataggtctttaggcattgtgtgaaataaaattttacaaattgtattttgctcttatttattatagtttaatattgtagttgtgaagatcatctgtcagattcttcaccctctcatcaaacatgacaagtaagactagagtgtttctatttcagactaaaatagagttttaattccatttaagaatgaatgaggccaggcgcggtggctaacgcctataatcctagcactttgggaggcctaggtgggcagatcacctgaggtcaggagttcaagaccagcctggtcaacatggtgaaaccccgtgtctactaaaaatacaaaaaattagctgggcgtggtggcaggtgcctgtaatcccagctgtttgggaggctgaggcaggagaatcccttgaaaccaggaggtggaggttgtagtgagccaagatcacgtcattgcacttcagcctgggcaacgagagtgaaactccgtcttaaaaaaaaaaaaaaaaaaaaaaaagaatgaatgaaaaattactgcttagaaaatttttatcacatttctaaaatagagaagatgacttagagtgaaataaagtcattgtttttagtatagcccattttaataaaaatatttcttaatcaagacagtttgtgtcataatttctaaaaaaacatgccagtgcaagtaactcaaaagtaatgtaggttttcaggatttactaaattttcactatagtgagtagtatgagtatcctagcataatttcctgtcctagaggaattttcaatctaatagtagaactatacaagtagggttctatgtacctagaactataaaactaacaaaatgaaaaatacagaaaaaataaaactgtataaaattctacaaaaataatctcataaatagattacaaacttattgatgaagtttaattttgggatttaaccacttggtgtagagttcaaactgcttgactcacacataggacaggttgattacattcatataagcccttatattttatgaaatcttgtaatgaattataattaacctggaacaaaagaggtgtatctagtggatagatgtgtgtgtaagtggtgaataggcacagagttacaatgtcattgcaacctggagagtcatactgggagcaaagaccatgtatatgaataggtatgactacatgttaaagtaataaattcatggattaaggtagaagttaggtgtgtaacatttatgaaatatagtttggagttttcattaaatagaatagtttttagctcttttgtttctcttcaaatattagaaatatttctaattatccaagtactgcatgaattgcctttgaaatattgcacacatgcacctgaacagttacttttttgctcagatattttttttttcagatcatgtgtacataatgtatgttcacaaaacatatttagtatttaggtacattcctgttagatcttgcatctgtggaacttcatcgtggaaactaatttatcaaagtagcacattcacattagtttcatattctttttaattttcaattttattgggaccaagtaataattatgaaggtagtgataaatgattaaactttaaatactttttctaagctctcagttttcttatttgtttttcttttttttactataagttttagggtacatgtgcacaacatgcaggtttgttacatatgtatacatgtgccatgttggtgtgctgtacccattaactcgtcatttaacaataggtatatctcctaatgctatccctccccgctacccccatcccacaacaggccccagtgtgtgatgttccccttcctgtgtccatgtgttctcagtgttcagttcccacctatgagtgagaacatgcggtgtttggttttttgtccttgccatagtttgctgagaatgatggtttccagcttcatccatgttcctacaaaggacatgaactcatcgttttttatggctgcatagtattccatggtgtatatgtgccacattttcttaatcccgtctatcattgttggacatttgggttggttccaagtctttgctattgtgaatagtgccgcagtaaacatacgtgtgcatgtgtctttatagcagcatgatttataatcctttgggtatatacccagtaatgggattgctgggtcaagtggtatttctagttctagatccctgaggaatcaccacactgacttccacaatggttgaactggtttaccgtcccaccaacagtgtaaaagtgttcctgtttcttcacatcctctcgagcacctgttgtttcctgactttttaatgatcgccattctaactggtgtgagatggtatctcattgtggttttgatttgcatttctcttaaggcctagtgatgatgagcattttttcatgtgtctgttggctgcataaatgtcttcttttgagaagtgtctgtttatatcttaacagcaagcatctgtagccgcagcagcagtgaagagaagcatgattttttttcatatcattagaagtcagtgaaatggggaataactggagaatttgattataatacagtagtccccctttatccacagggatatgttccaagatcaagaggcatgatttttgtgcttaaacttttttagcttgctaagaagtaagataatttgaatggtgactgaatatgtgataattatacaaggtagccctttttttactgtagatatgtcacctacccatgaaaatgggacaacttatttaattctcagcaatcacaaaattctaaaatcttttggaataaatttaacattaaagaatctatataaaaatagaaactttcatgtttatcaaggtataaacaaaatgtgggagcctagaaaaggaaggttcctctgactgcaggaatacagaaagcttcatgcaagacttggcatattagttgacttcgccaagtaagtagccatgctagatgtggaaaatgcacagaaaggaattttagaaaagaatttaattctcacaattgtgaaaatgaaagtgtgcttgggaaaaagccaataatgtggtgggactgacacacatgatgttgtgtgagaaagtaatgggagatggcataatgtgagttgtaaaagtttctgatcggtttaggaccagctctggtaaacaaaaaaaaaaaaaaaaaaaaagaaagaaaagtaggaaactgaaaatacaacatagtaaaactgaaaatattataatttttaaacacagtcctttccacttgacatgctaacagaaactactattcctacttcattagagaagcttttaaaaatagcttcattctgtcagatactaaaccctttagataagtaaaacataatattcaagagagattgctattatttccagctgctaagccaggtgccccaaattgacttaatgccattcattttgagataaacttgaaattcttccattcatgcattggctgtattctaggtacttgaaaaccacattagcacagaaatatttttttttttggatttgatgtggatagtgatgctttcaaagtaaagctttgttactagatagttatgtgaaaataatagatacagaaaaaaattgagtgacatttgaagtgaggtaaaaatgtcttgaacttttacaagctcagttagcagttcttgtgtacttgtctcctgtcggttttatcatcagcaatggtataattgtccaaagataacaaacacatatctatctatatacccatgtatctacttactggcatatagtaaagtgatagaattgattaacatttaaaagtatgaagttttagatccaataaccttgaaaataaagctaccatttctgaataatattgtgaggaagataaactgaaaaatgccaccacaaataacataaagaatttcatgacttcctagtttaacatgacactgtcttgagatttgttctttgggacagtcctttcttcacagtcaagtgtattctttgttgttggtgatgatcttaagtacttttatggtcaaattatttaaatattaaaacagcatcactttcctcattagtttttcttagattgatgttaagaaaggaactgatagctaaaaatttaggtcttatgaaaactcttccattgcagcaagtacttacagaccagtaaataatttgtttctggtttatagaagagaggttggagcataaagagcctctggtgcctaagataaaagaaaaaaaaggcttggcaaagtttgaaggttttagtgggaaagtatagctgtttgtctttaacagagacttttgagaaatgcgaggaatgatagttagctgttcacggttaccagaagttgcatcaggttttatccaaatgtatcaaggcctaaaatgtggtaattctttatattgatagggacataaagcaagtggtctgtccagctgaataaaagaagggaggacagaaggaaagagcataccatcctaatattctgaagggcatgcatatattattcaggaagagaagaggctctgtgcacaactggggtcacactaatattaaaggggcagatagagaaggaagatctattgaagaagaccaaaaacaagtgtttagactgatgtttctaagttaagaggtgtttcagaaatggaaaaactgtctattgctacagagatatcaaacaagaggattgagaaaaattcattggctttgtcaagatatcatttaaaacctttgacagagtaattttgataggcttttagaggacttggttagatcaggttttaaggagcgattgagtgggtaagaagtgggagactcagaattttaatgaccaagtcaactttgctttaaccctttgaagatgtcacatatttcacaagacgaactagaccatatgttgatatataggaaagaaattgttttaagaaaaaattttattttatttgttaatacttctccatttctatctctacttactgcctcattaccagccagaggctgacaaattttcattagaacaatttcagtgcttttaaggaaatgtaaaatacagctctctggaattacacaaaaagtaatttggatgctaaggatttactactgaaatttactgtcatggtttgaaggagtacaaaaataatatcctctgtttcttacccaagcttagaaccactggagatataagcatatgagtcgtctgctagaatttaaaatatctgctttaaaattaataaagtctagagttaaggcctctatttgtagagtcacaatgggattactagtaatttactgctgaattatacatatttactcattttgtcactgtacacctggacagccacaggtgtagaacagaaaattcttgttgtttctaaaataacaggaatgcagaaggggttgagccatacatgtccagtagtcctcagccttaatcagataaatcagataaatctttcctcttctggaaaatggaagctttcatattgtttcggcttagcagggcaactaacctttaaggaactgccaggtgtccagttttagtatatcagtgaatatccgcaattatctgaaaaggctgttaaaatactcacgtgttttccaactacgtatatattgagactaaattttcttcatctattcaaaccaaaacagcatattaaccaagattgaatacagaagaagatacgagagtccagtcatcttctgttgaaccacattatggagattttttttttttccttttttttttttaagagatagggtcttgctctgccacccaggttagagtgcagtggagcaatcctagctccctgtagactcaaactcctcaggcttaagtgatcctcccactgcagcctcctgagtagctgggaatacaggcacatgccaccatatgcagttaatttttttatttttatttttcttagagaagaggactcactttgttgcccgggccggtatcaaactcctagcctcaagtgatccttccaccttggcctcccaaagtgatgggattacaggcatgagccaccgggcctggatgaaatttctaaaaatgtaaaacaatgccttatgtaagtgataggttgatgggtgcagcaaaccaccatggcacatgtttatgtaacaaaactgtatgttctgcagatgtaagccagaacttaaagtataataaaagaaaaaaaaaaaacaatgctattcttcttgctaaatttttttgttaggaaataatttttttcattaaaatgctaattatgttaatgtgcagtaggtttataattgttacatttaagtaaattactaaataattttaaaaagtctcagttttgattttgtagtatgttaaatgtctatagcaataatataaacaaaagctctttgggattctcaataacttttaatagtgtaaagaggttttgagaatctgtgatctagaggaattcacatataatttaggaagaaagcatagctttataatccaaaatatgcatgttagggcttaaagcagtactttgatgtgaagtatttttgaaatgacagtgtaagttttgtagttatcacactttgtattatttggaatcatattattttgaaatttttctaaaccttcattttttatgtctttaatgtacaacagaggaagtgaacaatgaaataaaatgtttgtaaaactatataattttttatgaacatttaatttttctaagccatagatgctttcctgaacaagctcaataagttataagaatatggaaaaaagatgttctttgataatatttggaatattcctggtatcttacacatagcagaatgaatatttcatatctgagttaagtgaacaaagtgcatttaaaatttttttaatagtacagtctaatgccattttggaatgtacgtggaggttaatttgctattataggaagctctccagtttagtggtaactgtttatccttttgtcatgtaacatatggtggtcataaggttgagtttctgatttttttttttctttaagcagataatctcagtgataccttgaagaagctgaagataacagctgttgacaagactgaggatagtttagaaggatgcttggattgtctgcttcaagccctggctcaaaatagtaagtttcattatgtttactcaaattccaaagaagaaaatcaaatcagtagtcattcagaaactggtatgtagttaagcacataactttgtattcatataacttgaattcttttgaatcatatccctgaatactgagattgttttacatgttctaccctcctacttccctccacgcccccgcaagatcctcaaagccaagctgataggcaaagaaaggaggaattgatgggtggtgatgacattaataccagtcccagagagaggccattgtttcatttctaacagtcaagcatcgtagttgtttttcttagcacctacatctgtgctttaaaaatagattgttttatatgtggggagagtggggagggagagagaggagaaacagagggggagcttaaaacacttaacatttttttggaatcttatcatattttaaaataattgtaccttaaaataatatgtatgcatagataaatttggaaggaaccattagaagtcatcaaaaatcttttgaaattggggtaggattttatctttgatgtgataaataatgctagagatagaaactgcacagttcttcattgaccattgtgttgcattttatttatcctatttctagtcactaatttctgtattatcaccattaatagatcagtatagagtgattttcatttgttatcttaattctgcttggttgtgctgtggttttttctgtacttgtttttaattatgctcttgtcctatcctgaaactaattatgtagctgacaaagaatggaggggaacgtatatattgttaaggttttaattgtaaggtttcaacacttattgatatatgttttttttattttttagtaaaccttgattagaaaaatctaaaataattgattgcagtacttttcatcaaaaaagcacattttagagctagcttttaaaattatttttcagtaattattttagattacaactgtcatgctgtttaatcatagagataacaggaagagatttgaaacaaggagttcaataagagcatccagataaggctcaaaatggtaaagaaaaaggacaggaaaggagaacgtctaagcctgctatccattttagtggacacatgtggctatttaaatttaatacaagtaaataaaatgtaaaaggaagttccttagtctcacttctcagtagttatatttggcagatgaccactctcttggggatcacagatataaaatattcccatgatcacagaaaattcttatggatagcactggtctagaaactaggaagaaccacacgatgacctgatttttttttacatgtgcctgtataggcagctttacacagtaacataattaacctaagtaaattgagtatctcaggtatatttttttgaacagttgttttattataaccttcgtctgttttcagcaacactttttttctctgttagacagtaaacttttaaatagaccatttgctttagatactgaaggacatgaagggtcatattcttggtcatctgtagaggttgcccatttgtctcctaggaagactggaagacaaagagatgaagttgaagggaaatgaagaaaaaagggagtaaaaagtgtatagcttttaaaagaacagatttaagaaacactgagaagttcataattattagattaaattagcttacattagaataagcccattgcggacttattcactgtaccttttgttgaaaatggtcttgtgaaattgtgtatcacaaaatgttaaggccacgtaaccacaaggtattaaaacaataaactctcaccaatttaactaatgatgccccaggaagggaacaaaaggaatgtcttgttaacaatctgaaacaaaatttataaatgccctcaagcctaagactactgacaaagaagaattggaaaaaggagttcatgcagatgttcagtctttgacacctgtcattggatcacttactgtatgtttagcactgggctggggattatagccactatctaatctttcctatagtcccatgaggtaggtattattatcaccatttaaaggatgaggtaacagattaataagcttatttgccttgctctggaagaagccagagtttggatttgaactcttgatttacaaaataaaaaattgtaatctgaataaagtgaagctttttgctgagttcatgtaatgtgaaatcattccaagaagctaggttttaacattgtgttttaaatttttgttttttctttaataaaaatagctctaaatttttattaaagtggataagcctgtttttcttgaactataaagtgatatatgtattttataggcatttattgatacactttataaagtcagcatatgcctttttaacaagaaaaagtaaaatatattagtgagatgttaattttctacagttcttccttgaataaggtgattgagccattgctacttctgtcctcctaaatgtaaaattataaaacatttaacttagaagaatctgtacttgctttttaaacaacaacaacaacaacaacaacaacaaaaacacagagagcttctcgtttcataattcttccttagtgtcaggtgttttaactaaaaataacaactgtaccataattgcacctgatcaggaaagaaagatttctccattctgtacaaatataagatggtaatgtatgtaatggaaatataaacaaaattttattttacagtctattaccctgttactggaaaggttatctctgaaaggaacaaaataatgcttttgaaatttttacactgtgtgatttagtgcatttgaattgcatattacaaatgactgtaatctgaaattagaatttttactttgatgtatggctttagagtggttttctttttttaccattggcagtatttctctctgtaacgtttatactatatgtgtctatcttaagagacaagaagatttgaatacttactagattttatgaaaacattttgtttaagcaagcattttgtgtaaatctatgatctaaattaatataaagtcattcattcactcatataaatacatcagatctcagttttaaaatgtttttagtaaatgtgtgaaggctaccagccaagaaatcagcttctgtttattttggtctcttttgattcagattatagttagaagattctcagtaaatgcttatttgattgtagtatggttactctattttatggttatttggaaatgtaaaacaataggccacctattttcatccccaaacattaagacaggaattgtctttggagaatgtggcatctaaatcaccttgcaagagaaactattagtttaaattaaagtcccaaaggcaagaaaaattaacattctatttgtaataaaaattctatccattttattccattttgaggatgaagaccattttgtgttgccggggggaccataaagtgtgccatacagctttaaactctctccctgaagaagtaagctgtcttcccctgcctcgttctcttttttttttttttgtatttaacttagtttcttgcttgatggcaattcccatttcatacgagagtcacgtaattgtttattttttatagaacaactctgtgagatactgcgtgtttacttgtctttaaagaaaaaaagcatttaatgtctagttccacatctctaatcttctatgataatattcactcacatgttgaattcttgctttattttctagccctaaggtaatttgctagcccttgttctttatttcatttgttgtattgatttttggctcccttctaggctacaatgctaagcatacgtaattataggcaaacttcattttattgtgctttactttattgagcttcacaaatactgtattttttacaaattgaaggtttatggcaaccctaagttgagcaagtctttcagtgccatttttccaacaccttgtgcttactttgtgtatctgtgtcacattatggtaattcttgcaacatttcagacattattattatatctactttggtaatctgtgtcaatgatctttgatgttactattgtgattgttttggggtgccgtgaaccatgcccatgtatgatggtaaacttaattgataaatattgtgtctgtctgactgccccaccaactagctatgccgtaccccctactccccatctctattcctctcctcaggcctccctattgcatgagacacaatgtttaatttagaccaattaataatcctacagtggcctgtaagtgttccagtgaaaggaagagtcacatctctctcactttatatcacaagctagaaatgattaagcttattgaggaaagcatgtcgaaagcggaggcaggttgaaagcaaagataggccaaaagctaggcttcttgagccagttagccaagttgtgaatgcaaaggaaaagttcttgaaggaaattaaaagttctactccactgaaaacatgaatgataagaagtctaaacagccttattactgataggaagaaactttgagcgctctggttagaggatcatactagccacaacattcccatgtcctaatccagagcagggctctgattgtcttcagttctgagaaggccgagaggtgaggagactgcattaagaaaagttggacactagcagaggttggttcatgaggtttaaggaaagaagtcatcttcacaacactgaaagtgaaagatgaagcagcagctgctgatggagaagctgaagcaagttacccacaagatctagctaaaatcattgatgaaggaggaggctgtgctaaacaacagattttcagtatagatgaaacagcttggtattggaagagatgccacctaggacttttataactagggtggagaggtcaatgcctggcttcaaaggacaggctgactctcttattaggggctaatgcagctggtgactttaagttgaagccagcattcatttaccattctgaaaatcctggggcccttcagaatgatgctaaatttctctgcctgttctctgaaaatggaaaacaaagtctggatgacagcacatctatttacagcatggtttactgaatgttttaagcccactgttgagacatactgctcagaaaaaaaagatccctttcaaaatattactgctcattgacaatgcacctggtcacccaagagctctgacgtacatggagataaatgttatttttgtgcctgttaacacaacatccgtggatgaaggaataatttcgaagccttattatacatttcataaggctatagctgccatagatagtgatttctttggtggatttgggcaaactaaattgaaaacctggaaaggatttaccattctagatgccattaagaatattcatgattcatgggagaaggtcaaaatatcaactttttttttattatactttaagttctagggtacatgtgcacaacatgcaggtttgttacataggtatacatgtgccatgttggtttgctgcacccattaacttgtcatttacattaggtatttctcctaatgctatcctttccccagccccctaccctacgacaggccctggtgtgtgatgttccccccgctgtgtccaagtgttctcattgttcaattcccacctatgagtgagaacatgcagtgtttggttttctgtccttgtgatagtttgctcagaatgatggtttctagcttcttctgtatccctgcaaaggagatgaactcatccttttttatgtctgcatagtattctatggtgtatatgtgccacattttctttatctagtctatcattgatggacattcagattggttccaagtctttgctattgtgaacagtgctgcaataaacatacgtgtgcatgtgtctttatagtagcatgaaaatatcaacattaacaggaatttggaacaagttaattccctctattatggatgactttgagtagttcaaaaccagtggatgaagtaactgtagatgtggtagaaatagcaggaaaactagaattagaagtggcacttcaagatgtgaccgaattgctataatctcacgataaaacttgggcagatgaggagtcacttcttatagatgagaaaagaaagtggtttttttttttatttgctttggtttttttttttgagacagagtctcactctgtcgcccaggctggaatgcagtggcacgatctcagctcagtgcaacctccacctcccaggttcaagtgattcttctgcttcagcctcccgagcagctgggactacaggcacgcgccaccatgcctggctgatttttgtgtttttagtaccatattggccaggttggtctcgaactcctgaccttgtgatccacctgcccctgcctcccaaagtactaagattacagacatgagccactgcgcctggcctcgaaagtggttttttgagatggaatctactcctggtgaagatgctgtgaacattgaaatgacacaaagaatttagaatattacataaacgtagttgataaaacattgacagggtttgaaagaattgactccaggttttaaagaagttctataggtgaaatgctatcgaacagcattgcatgctacgggtatcttttgtgaaaggaagagtcaatcaggatgataaactttgtcttattttaagaagttgacatagccacctaaccttcagcaaccagcaccctgattaggtggtggttagtcagcaacattcagcattgaggaaagatcatccagcagcaaaaagttatgacttactgaaggctcagatgatcgctagcatcttttagcaataaaatattttttaaagcaagctgtgtacattgtttctttagacataatgctcttgcacactcagtagactacagtatagtgtagacagaactttttttttttttttgaggcggagtcttgcactgtcacgcaggctggagtgcagtggcacgatcttggctcactgcaacctcctcctcccatgttcaaatgattctcctgcctcagcctcctgagtagctgggattacagatgcccaccaccacacccagctaattttttgtatttttagtagagatggtgtttccccatgttggccaggttggtcttaaactcctgacctcaggtgatccaccttccttggcctcccaaactgctaggattacaagcatgagccaccgtgcccagcctgtagacataacatttatatctattgggaaaccaaaaaacaaaaaacaaacaaacaaaaaaaactggtgtgatttgctttatagtcactttattgaagtgatttggaaccaaactcacaatatctctgaggtatgcctttatgtacagaaggtgttaatctagattactccatgagtcttgtctagcagtaaaaacttttgttgtcatttgctttagtcagctttatgcatttactatttttgaacagacttactttcaggtagcaaagttacttcctaagtaagagagttcttattatcaactgttttttttttcctgtatttgcaatctctgaacatactcctgctgttttagtagagatgaaaaattattattttattctttcatagtagtatcttgaagagatttttacctttttatctagtgttatcaaatgttccacagaagtgatgtatttcttttgcgaactgaattcattattattatttttttttaccttctttactttttttcatattgtatacctcttttagtgattgtgttcattgtccatgagggcttagcactggtgctccttatgaagtagtgaagattcagtttttaccaaataaagacagcatttggagaatataggagattctcaactaaagtgtcaactaaaaagacattgacaattcctgatgggttgagactcctggattgccataggatggtggtggcctcctaaatctgtatctttccatgcattctctaaaagtccacacagatccacaaagagataaaaccaactaacaatattctttgtctccagcataactaggagacagacttcaaattattacagagataaataaatatccaaatctagcctactcagcttcagagaccactgcagggagagttaagactccagagaccacatggacaagaggagagggaaatggggaaccaggagcccaagggtaatagcacacaatgaaaattacctttagaaagaaaaaaattcctaccctagtaggaaaatagtgcgatctggtcttagattagattctaacattggctacttaaaagtgcatggactccaggtgacaggtcaggaaagcaccactttggggatggagttgttcacctttatatacttggtgatgaaaagaaagaagcaagagggagaaatgaagtgttctgtagaaataaggaaaccacaaaatcagaagacatactaattaccccactttggtctcagttcagaagagggagcatttgaactaaaaatcctggatatttatcccaaattgttgcccttactgcattcaatttttattactagtcaaggaaaataaaaaattatacactgaataggaaatttcagataagatacatacataggtgctacaaaaaagaaagcagaaaataagaataaaaacattttagctattaaaaattttccatctaagccatctgtgttgcagttatcattaacagaacaccatgacctatattaaatattcttaaataagcctttgcagatatgaagagaagaaaccttcaagttataaattcagaaacttagaaccaaagtgaacaccaggaagatgtgaaactagagttgaccagaagaaattgaagaaaatgacaaaattgctttaaaaattaagactaaatttcaaggtgcccaaggaagaatagaggtgattgaaaatttaaaaaggggcattgaggaaagagatgcaaacaggcaactgagaagacaaaggatcagagaaaagattataatacagaagatagtcaaaaagatccaacatacatgcaattggaattcagaagaaggaaaacaaaatggtgaaacagagatagtatttaaaagtacaaagtttctaaaagtaaaggaagaccagaatctgttttttgaaagggcccaccatatacttgtgaaaattgacctgaaacagtcaactgaaagacatagtgtaggaaaacttttagactttaaagataaaaacaaatacagaggaaaaaatcctcaaggcctccatgcaaaaatattatttacaaaggaaagaaaggccaggcatggtgacccacacctgtaatcccagcactttgggaggccaaggtgggcggatcacttgaggtcaggagttggagaccagcctggccaatatggcaaaacctcgtctctactaaaaatacaaaaattagccgagtctggtcatgcatgcctgtaatcctagctacctgggaggctgaggcatgagaattgcttgagcccgggagacggaggttgcagtgagcagagattgcgtgactgcactctagcctgggcggtagagcaagactcagtctcaaataaaaaaaaaaaaaaagaggaaagaaagtcagattagcatcagacgtccacatagcaatacagaattcaatagtggtgcagtattttcaggtaactgaaggaataagaattttatattgaaccaagctgcccagtaaaaatcaaagctgtagaagaatcctgttaaagatagaagaatcaagggaatactgtactctttgccttctagaagaatcttcttaaacttgcactgtttaatacagtagtcactcttcaacatggctgttgagcatttgaaatgaagctagtctaaattgagatgtgttgtacatctaaaaaacatacaaaatttcaaagacttagtacaaattaaaaaatgtaaaatagtcattaatagttttagaaatattgattatatattaaatcttattttaaaaattttgtgaaatatttacaaatgctttgtttctgctgaagctttataggccagcatttcttggattgtgggtagtagctgatcaaagtgcttataagacttgggccagtcagtgtgatatgatggaaaatgcaggttagaagaaaataataagtaaattaataataatataatataatataatataatataatataatataattggggtattcagtataggaagagaactttttaaaaaaaattattttaagttctggaatacatgtgcagggcatgcaggtttgttacataggtgaatgtgtgccatggtagtttgctgcacctatcaacccttcacctaggtattaagccccacatgcattagctgtttatcctgatgctctccctccccataaccccctctacagaccccattgtgtggtgttccccttcctgtgtccatgtgttttctttgttcagctcccacttataagtaagaacatgcagtgtttgggctgctgttcctgtgatagtttgttgaggataatggcttccagctccatccatgtccctacaaaggacatgatctaattcctttttatggctgcatagtattccatggtgtatatctaccacatttccagtctatcattgatgggcatttgggttggttccatgtctttgctattgtgaacagtgctgcagtgaatgtacacgtgcatgtatctttataatagaatgacttatattcctttgggtatatacccagtaatgggattgctgggtcaaatggtatttctggttccagatctttgaggaatcagcaccctgtcttccacaatggttgaactaattcacattcccaccaacagtgtaaaagtgttcctatttctccacagccttgccagcatctgttgttccttgactttttagtaatcaccattctgactggcttgagatggtatctcattgtggttttgatttgcatttctctaatgatcagtgatgttgagcttttttttcctgtttgttggccgcataagtgtcttcttttgagaagtatatgttcatgtcctttgcccacttttaaatggggttgtttttttcttgtaaattcgtttgtagttccttgtaaattctggatattagacctttgtcagatggatagattttgaaaatgttttcccattctgtaggtggtcagttcactccgatggtagtttcttttgctgcgcaaaagctctttagtttaattagatcccatttgtcaatttttgcttttgttgcaattgcttttgatgtttttgttatgaaatctttccccttgtctatgttctgaatgatgttgcgtagattttcttctagggtttcatagtttggggttttacatttttaagtctttattccatcttgagttaatttttgtatagggtgtaaggaaggggtccaggttcaattttttgcatatagctagccagttttcccagcacgatttattaaatagggaatccttgtcgaagagcagatggttctagatgtgtggtcttatttctgagatctctgttctgtcttattggtctgtgtgtctgtttttgtaccagtaccatgctgttttggttactgtagccttgtagtatagtttgaatttgggtagcatgacgcctctagctttgttctttttgcttaggattgtcttggctatacaggctcttttttgattccatatgaattttaaagtagtttttttctaattctgtgaagaatgtcaaatggtagtttaatgggaatagcactgaatttataaattactttgggcagtatggccgttttcatgctaattgattcttcctatccatgagcatgcaatgtttttccatttgtttatgtcttctctgatttccttgagcagtcatttgtagtttggtagagaacatttttaaaggaaccttaggttcattattctagggttacattctaaggagaaggctgtatatagggtctaaaatatgtcctatgtgcttaatctaaaagcagagattaaaaggagagaacagtgtgtatccaaatatattcttacctaggagtttatagaaaagggagcatggaaaggcttgaatctgggagagtgagaaagaccatcttaaaatcaatctctcacaagccatgagattagtaacagaaacaagatgtataacagtgatactgggtgctgtttgccttccgatatgctctgaagcactgtactttataaaaggcaaaaaaggactctcatgttgtgcagttgccagaaggatataaatctccattggtatttgtagttggtgattgaagccttggcagaagatctgggtttgctaacattagctaatgaatgttaccatttttgcttcttaagtttgctacatttgaaaaactttttatgttcctaacacagagaaaatgtgtaagagagaaatgtgatttgaaatgatgctgtatgccaaatacatactgaagaagatttgccagtctcagtatttatagtaccagtactgatttactataactaaggactacactttaaattatacttggggaaaaagagatgaatttgttctgctgtgtctttctaacattatttttcatcagggttccatgtcactgcacctatagccagctgtgggagtagtctgtggacatataattgattgaagttaactgtcttctctaatcgtataagcagtaacccaatgtgtccatccatttgtgctgttataacagaataccacacaccggctatattacaaatagtagagatttatatttctccctgttatggaggctgagaagtccaagatcaaggtgctggtaggttcagagtccggtgacatgccatacctcattgatggtacctttttgatggcaccttgttactgcattctcacatgacagaaggtggaagggaaggagagcgagagagcgaggcagctctctgaagcctcttttataatggcattaatccattataaagtcctcacctcatactactgtcatattggggattaagttttaatacatgacttttgggtgggacacaacatttaaaccacagcacccactatgtcctgaatgtgttcaagaatataagacatgtaaattggcattttaattgatacaatgaattggaaatgaattaatattagtatctgaataagaattatgtattctcaacagaaagctagtttgatacaaagaaaatagctttaagtaataaatagattagataaatgtgttttcattatctttactgtgattgtagatgtttgaatttgaaattaaaggcaagggtagtatcatgctactttttacttcagtagtgcttgaaagtccaagtgggttctattcgctctagaaagctttcttacatcgtctaaatgctttcatttttacctcttttcagattttctgaatacccacttggcattgtaaaacagagaagattaaggtttcatcattaggtttcatcattaggtatacattggaatctataatgagacattttttggaaataataaaatttagtgaatcatttttttctaatggaagcttctttgtaaaatatatgtcttcttattataattaatttatttgtactgtatttaaaaatttattttaacatatggtacatgtgaggacttaattgtattttttttttagataatcaattttcctaatacaatgtgttgtttaatctgttccttatacatatttctatcatggaataaccatttagtttaatataattgcatcagtgtctgagtttttttctgtcccattaatctgtttgtctaatattgtgctgttaccttaccatgctattttaattatggtagctttatggaggaagtttcctattataaatttatttttgaaaaattgttattgttttcatgggtttgttatatcagaaattttgtaaatactttgtcatgtttctgaaaaatcctattggaattgtaataagtcataaattaatttggggagaattgaaaacttctcaatattttgtctgccaatctaagggcatagattgtatcttctcttattctaatcttctttttatgtctcagtaagattaggtagtttggttcatatgctttccatacattactttttaaaaatattcctttgtattttgcatttttgttgttgcgtatggattttttctgtataacttctaagtgattattgttagagattattgtgaaagatgtcttgatttttatatttttgtatgtattcagccaccttctgttcttcattaaaatgaatttttagctaattctcttaggttttgcaatcagaacatctacaaagtgatacttttgtttcctcttgcccttataactaaagccgacttactgtattgggttaagcttccagtgaaatagtaaataacagtgatatggttagcaccatattttagtttccgatactgatggtatggcccttctgatgtttcaccattaaatataacatctcttgatttttatgtaaaagttctttttcagtttaagaaaataataaggccgggcacagtggctcatacctgtaatccctgcattttgggaggctcacgcaggaggattgcttgaagtgaggagtttgagactagcctgggcagtaaataaagacagcatctctatcaaagaatatatatatgtgtgtatatatgtgtgtgtgtgtgtgtatgtatgtgtatgggtgtgtgtatatgtgtgcgtgtatataggtatatacatatatgtgcatatatgtgtatatacatgtatatatacacacacacccacacacatatatatacacacacacactatatatatatatatatatatatatatatatatatgcgccaggcatggtggtgtgtctctctattcccagctatgtggaaggctgatgctcaagcatagaagtttgaggctgcagtgagccatgattgtgccactgcactctagcctacgtgacagaacaagaccctgtctcagaaagaaaggaaaataaagaacaatttctttaaaaacaaaaagattttaaaccacaaattttttgccgaattaatgtgttgaaagtagtctctaccattttattgctataaagcttgtttataataaaattatttgttgagagcattaataataagggaaccttttcataagaaggaaaatacaacaaagttttataatctttgaatcaaggtcatgcagtatactagtgaagttcagtataatttacatcctcctttgtgtattcagggacaaatatttatctaatgagaattagtatgtaaagaatgattggaattaatgacatgaatgtgtatatcttagaaaaaatgactattaaaacatctgacaaacataggagatttcttaatctagtaatgtatagtttcaaaagttttcaaagctacattcaataaagcattgcttttaccaccagaaaattgtttacacttacaaggtcgtattatatcagcctttaaagtatatctgtgtgcctttaaattaataagtattcatttatttgtttatattattcagccctgaaaatgtgaacttaattgcttatgatttcagttactttaaaaaatgtagttttacacagattcacatattgagtgcgtgatgccaaatgaattttggtgtttcaagatttaataatatatgaatagaaatttttaataaattagaacaaaatttttaaaatacttggccttaaagactgtttttgtggccctagaggaaaagagaaacacatttaaccggaaaaagaggtaattgaagtaaattcttctcctttgggaagaattttgtatgaatcttaattcacacaaatctgtaatttatccattatgttaaattggaagagatattacaccatgggaatttgttttataccaaatttataaatctgttatttcattttttatttttactcatttatgtactgtaattttcactttttgaattatgaatatatgtgaatatgcatgaccaaatgtaaaattgttgaaataggaagaataatggaaatattaaatacaaaatagagagtaaaagattagctcttggctctaagtagtcaaggtaagggaaggatagccaagaaatggaaatgatcccaaatttaaaaagaatttgtagaagcacattaaaaatatatagattctagttgaagaaatatagttgtcagaaatatatcttcttaattgaatataaaatactacgttgttttctatttgctatacaagagtatcttgaaaatgccatattcttaattttgtgtggttcatggtcattttattctctcttaaatctctaataattgaagaaatgtgaatatttcatgtttttagtaaggtagggttcaggtataattttctagggtaatatatgtatatacatatatatataatgggttatataattaagagtctttatttgagttaactttttaaaaaagaagttcacttactaaatgtaggtcgactcattagaatagttggtgagtattcaaacagaattgagctcatactgttgtgctatgtcatactgctgttaaatacttagtttaacgtataacataaatgttaaatacttcatttaatcatagattgggagcattttatacagttatatcatgctttgatgaggtaagatttagactatacacccctccatcttcaggtctcattcattcatttattccacacttagtatttatttagtatgtgccaaacattgtgctatctcacaataatgacagaagcttatttcttttgtggagtagagactgatagataaatgttaaattataatttatcataataagtgctatcataggggaatgttcagtgtctacactagatcttagccagagggctgagaagcaatgaggtatgttcagtacctagtgggactacatatttactgaccttaaagtaaaaattgcaatgtcaaatcaaaagggaataatcataaaataatgaaggacaaaaggaaatgatctgattccagtacttaattcagcttattaaaagttcaaatctttgatttttgattgaattcgttctttaaaaaattgttttagaagacaccagaagtactgcatgtaaagcagaatgaactaatttatattgtattatactctgaattactctgataatatgcatgctgatgttcttggatcatgtaccagtctttgaataacaagttctagatgtatgccatccagtctagtagccaccaagccacatatggttattgagcacttgaacggcaaagttgaaattgagataaactataatctcaaagacttattgctaaaaaaaaaagatttaatttttatattgatcaaaacttaattttatctgtttctttttacctttttaaatattgctgctagaaaatataaagttatatgtgtggctcactttatatttcccttggacagccatggctcacacaaatgcttctcaaattttaggctgcataaaattatttggaaagattgttaaatcgtaaatacttaggccctatccccagagactctgattcagtagttttggggtggggctcaggaatttgcatttctaataattttctagaggatgccaatatgctaatttatggatggcactttaaaccataaggttttaatgtagacagtatcttttcagtgggttgaaaagaatgctgcctgggatgaatcaaaagcaataccagttttcacacaatttgttatcgggtctaatctgtaaataagatactgtcatactgtctagaggaatataaatgtaagcattttgctaggcctctgaagaaaaaatgtggaattttgtcaaagactcttaagtattttttaaaataagtatgtgtttgttgtttttacttcttgtaaagagaaaagaaaataactctgtaaaatgggaaagtaagacctagtttgtcatttccaagacaacagaatttacttacattctaaacaaaggagggggagaacaccgtaggaaaaatcttacatacctatgaaggtcccatcgtgtgtgacattggagagagatcttttacttaaagtatttgctttttcttattttcttgtcacagatacatatgataagaaatatatatgtatatttatgtgtgtgtgcacatgtatgtgtgtgttttgagacagggttttgctttgtcacccaggctggagtgcagtagtgggatccatgctcacggcagcgttgaacccccgcactcaagcagtcctcccacctcagcttcctgaatagctaggattgcaggcatacttcaccatgtccaactaatttatttttactttttgtatacatggggtctcactatgttgtccaggctggtctcaaacttctggcctcaagcagtccttctgcttcagcctcccaaaccgtagggttagcaggcatgagccactgcagttagcttcatttttatgttcttaaaaacaattaggcaggggacaatgaaattggaatgaggagtaagataaggcagcaagaaatcagagtgacaggaggaagaagatagaggatggtaaataatggaaagcagtgaggagatagatgattttactaaagttggggaacaaggcttatggtttcttctactatgatacttgtagacctgtttagctcactattctcagggccaggggaagcattttaataatagtatcatctaattttgcaattcatgaacaccttagtaacccagtctccagctaataattctgtttcatccttaccaaatagcccttatgaagagggaatctttcatcattctttatgaggggatctgtttcattttttcatagccctaagactggaagacactttttaatgttgatccctaatcatctttctgtcagctgctgctcattggtcctatttctagctcctagataaacatacaatgtgctttctccctaacaaatcctctgtatttggtgataactgtcatattccttatttcctgagctggccctcatatgatgacaaggagacagtagattgtagggcagaggttgatactatttttttctaatatttgtgtggtacgtttgtgttcttacttggaaatctttgttgggagggctaagatgatcctcttttctaggagcagtggtatattagggttcttcagagatatagaaccaatggaatgtgtgtgtgcatgtgtgtatgtgtatgtttgtgtagctatacatagatgtatagatatatatatatagagagagaaataggtatgggcggggggagagagatttatttaagggctggtcacggtggctcacgcctgtaatcccagcactttgggaggctgaggcgggtggatcgcaaggtcaggagatcgagaccatcctggctaacatggggaaaccccgtctctagtaaaagtacaaaaaattagtcgggcgaggtggcaggcgcctgtagtcccagctgctctggagactgaggcaggagaatggcatgaacttgggaggtggaacttgcagtgagccgagatcacaccactgcactccagcctgggtgacagagcaagactctgtctcaaaaaaaaaaaaaaaaaaaaaaaaaaaaagaaattggctcatgcaattatgggggttgcaagtccaaatctgcaatgtgggttgtcaggttggagacctagggaagggctgatgctgcagttcaactctgaagactgtctgttagcagaatttcttcttatttgggtaaggtgtgttgtttattctgttcagttcttcaactgatagggcacaatgtcccacataaagagcaaatctgctttactgaaaacctactgatttaaatgttcatcttatccaaaaacaccttcacagacagagacatccaaaataatgtttggccaaatgcctgggcactgtagcccagctaattgatagaaaattaaccatcagaagtggaatatacatttctaggtatcaagatggattgtattgtacaatagttatatgttgggataactgctagtgaggaataccttagcattagaactttacacacaagaagctacagttgggcctggtgtggtagctcacagctgtaatcccagcactttgggaggctgaggccaggaggatcatttgagcccaggagttcaagatcagcctgggcaacatagtgagacctcatcgccacaaaaaaatttaaaacattggccaggcatggtggcaggtgcctgtggtcccatctacttgggaggccgaggtgagaggatcacttcggcccaggaggtcgagggtgtagtaagccatgatcatgccactgcactccatcctgagcaacagagcaagaccgtgtctcaagaaaaagtaagaatcacgatcatgtcctactttttaatattcattgaaataaacctcacaaggaggctccaaaaggcagagaaattgggtcgttgttttgtttcttaaagagacataaggattcatagtctagattttagcacacaatgttctgtgaggtgagtccattttagatgcttgtaattttcttttccatggttaagtgttatacaccttttcattgtactaaaggagcaagcagaatgtttttatttggctcgtaataacttagttatggattgatcatattttcattctgatgtgtgcatgtgggagggataatataaaggcaaggtaattttctgcagtgatttctgaaagcttaaagaacatttttgcatacatttgcttatgaaaaaactataatccaagacctgattagcttaatgcaaagtgaaaagtttagtctctgcatgagctagtgactggtaattatatgaaaaacttcgttcttaacttcaaaagaaatcaagtttccttggtgagagaatcttatcaagattcttaatgagagaatcttaaaatataagacaatctctttgtaaactcaatcctcttttctcttaggagtaattataactactgcaacatcaatacatgtaacttgcttcatctttagtattcccatagcagtttatacatccctccagttgaacttatgtcagtgtgtattcattgtttgtataagcctctttcatttattctgttataactctgtaagaggagggatgcagttctattcaactagcattaattgtgtaccactatgcattagttggtaatcttgccctggagagtttagtggtctacatagataagtaatatataagttttaatacagtataatatattatataatggagctgattacgaagtgttgtagaaacagagatatggattcaactcacatttttaagtctttcaaagtgtcacagaggggatgacattttatccgggtcctgatgggtaaatagacattttataggtataccgttgttttttccttctatctagcttttcttcaaatcttggataataccagtcatctactttttacagcttctcaatactggtagccttcagctgttggtcagaaaattactcagtggtagagaatgttgcttttagaaatgtagtgtctgtagtttcagctggtagtgcttttacatattccttccttgtagaatgtatttttctttttggcttagaatatgctttattgtccttaataactccactcaaatgttaccttatttgcaaacttcatgatatttatacatctttgattgtttctcattatagcttgtacataacctccatagtggtatcaatcacattgaattgtggtaatttattaacctctctctgtctcttactggacagttagctctctgaggatatgatttgtgtcctctttattttatattcccaagatagtagcgactcagtaaaaatacactttccttggatgatctcatccactccatgtctttgactaccaaatatgctctaacaacttggaaacaattacagtgctgtgtgtgagtattgaagtaggggtaagtttgataagcagaaccaaggaatgctgaattttgaaaacaaaatgtattttaaccagctaaaatgtgggggcctgaggattatgggaagaacatcctaagcaaagggagagtatatacaaagtcatagtggtgagtaaagaatctagtccattaagaaactgaaaagcttggtatggctagcaaaaagggtacatgcaaggaagggtcaagaggtgaaaagtggaaagggcataagggatcatattatcaaaggacttttatatcatgctaaacatgatttttacttgaaaagcaagtaaaaatcagattggtgttttaaaaagatcagtgtggagacagtgtgaaaggaaaaaaatgttggcacacctaattaccaagaaaggtggtgtgttgacagtgctggagaatatggcatatagagagagtaataaatgtttacattataggaatatggcatacatagggaataataaatctttagagttccagggcctaggaaatgtgaaagggaaatgactaagggtgaaaggataactgaacaatgttgaagggtccagttaagattataaattatgaatttgtagtgataccaggtaacatacttaataacataatttactgttttaaaatcagggaacaggcaaagtatatggctagattcatccagtgctaggatttaatagcaaggtgagataaatagatagggtttagggtactgcagtaatactagagttgttgaaatcattggtctttttttcttccagtgtaggtaagcatgacatgaattatggaaagagggctgatagggaaagaaggaggagttgaaagaatagagttttcaatgaggtttaaaaaatgtttaataagtataaaagacatggtagaagagaagactgatcagaaagtgatttccaaatataagctttcaatcatagggtagttctacctatgatgataggccttgggtgtcatattgtggtggattgttaaagagcagtggaaattattaaagtcagggagtgtgaggccaagttattaaccactgtatgtagattcagagttgttcaggatgatggcaggagttgaaggggagaggcaaactgggagtaagctccagtgtactggagggttgttgtggtactaatgatgagaatgggggaaatacaatgttaccagatggcagaggctgaaaagagagaagctgtttttgaatgaaggcagaagacaaaatgtctcagatatttttgagctaagaaaatacaactttagctccaagcctgggtcttggggtagaaaatgaagaaaagagagttgagaagttctgcatgagagtacttcaagggaagtctcctgagaataatctagctaaaagtgaaagataggagctagagttttgtgagtgtctgaatttaagagattcaaagggtacggtaaaaagtgttcaaaactaggtctgagggggaaattccagtgtaaggatgccgctatgggatgggaaagtctttaattggctgtcgtgcagttaatcttttcccagttgctttgctctgtccatatggtttgggagattgtgatccattttgtcattataatcttttcttttcctctctgcttgagagggtgaattctggtttgactaatattatttccctctttgttcccctgaattaggtactgttaaggggcctccatcacacttttttacccttatcatttaaataaggccagcttgtgataccatgcattccctcttatcttagaacatcttgccttggcctttccccatgccagattgtaggatttttataatttcagcatttgtcgtaggtattagggagatctaagcaattactctagtgccatgatatttagtaaatccagaatcaatctgaaaacctttccgcactcatgttaggctgctatgtattactgtatccccacagtctacaaagaacattatatgtttttagaacacaaacatctccaaattcggggctaaggtcatattgccagtctggcttctactgtcatggggtaatcacatgttaaggtgatagggttggaggaggaggaagtatgggaatgtagtgaagcacgagaactaaatgcagtttttgaagacgagactgaactgatagataattgtgaaatattgcatgtgggaagagtttttgacatctgaaagattctgcaagccacactaagtgtctttattccctaagctatcatggaaccttaagtggccacaggagtcgtgccttagtgtggggtatggagagggagatagttttttggtgagcatcctagtggtgttaacagacgcgatgctctatgctgttacctcagccctgatatttgactatatatatatatatttttttttcttttcttctctttttttttttttgagacagaatcttgctctgtcgcccaggccggagtgcagtggtgtgatcttggcttactgcaaccctctgcctcctgggttcaactgattctcgtgcctcagcttcctcagtagctggaattacaagtgcacaccaccacgcccggctaatttttgtatttttagtagagacggggtttcaccatgttggtcaggctgatcttgaactcctgatctcaagtgatttgcccgccttggcctcctaaagtgttgggattacaggcgtgagccaccgcgtccagtgatatctgactatattcttgaacactgaatctagccactctggataaatatcttgcttagtctagcttagtctcttaatacctttcattttaacatgggacctacaaaaggatagagtacagagatcctcaggggatgcgttcctagacccacagtagatgcctgaaactgtgggtggttctgaaccctctgtatacaatgttttttccggtacatacatacttgtgataaagtttaattattaaattaggcacagttaaaagagtaacaacaataactaatgataaaatattattagaacaatatactgtaataaaagttacgtgaatgtgtactcgctctcctccccatctcaaaatactttattgtactgtacttaaccttcttgtgatgtgagatgataaaataccttcttgatgagatgaagtgagatgaataatgtaggcattgtgaggtagcagtaggctgctattgaccttctggggatatgtcaggacaaagatcatttgcttcaggtgatctgagactgttgagccatgatgatgttgatggttggagttcaggagcagataatgttgatgtctgtgtcaacaactaatgggcaggtagcatatacagcgtggataaaggacaaagggatgagtcacattctgaatcagatggaagtgtgagatttcattatgcaactcagaacggcatgcaatttaaaacttacaaattgtttatttccagaactttccatttaatattctcagaccacagttgactgtgaaaatttccaaaaccgtggaaatgaaattatggaaagtaaaactgctgataaggggcaactgctgtagttctctggggggggaaatgaggttctggaaccatggctgatcatcatgaaggttagactgatagaaacctagaatggattaggtgcctctgtacattaagtatgttgtggaatttttgtcaaaatattaaaactgcttctatacatatctgtctcctttactaaactataaactctttcagagcagagtctgtgtcttgttagccatttgcttagcatgttctaggcacttacctaagtatttaatgatgagtcattgcatgaatctagtaactttcttttgagtggctaacctctcaaaattaatagtgtaacttaaatgtatgtgtaatggtgataatatcgtactcccttattagcatatatttctttgaaaaagcaaggaattttctcaagatatatggtataggtttcctcatactttttatgatgtaatatgtattggtttactgatattttttcagtctcatgtgtattttaagagccattatagttgactgttggaaaattgggttttgtggctgggcatggtggctcacacctgtaatcccagcactttgggaggccggggtgagcagatcacttgaggtcaggagttcaagaccagactggccaacgtggtgaaaccctgtctctactaaaagtacaaaaatcagcccaacatggtggtgcacacctataatcccagctactcgggaggttgaggcacaggaatcgcttgaactcggtaggcgaaggtttcagtgagccaaaatcatgccactgccctccagcctgggcaacagagtgagaatgtctcaaaaaaaaaaaaaaaaaaaaagagagaaattggcgtttgaactacacaggtcctcttataagcagattcttttcaataaaagttacaccaagtgtgcctgcctctccttccgtcttctccacctcttccatccctgctacctctgaggcggcaagaccaaaccctcctcttcatcttcctccacagcctactcagtgcaaagaccgtgaggatgaagacttttatgatgatccacttccacttaatgaatagtaaaatattttgtcttctgtatgattttcttaataacatttgtttttctgtagcttactttactgcaagaatatagtatgtaatacatataacatactgaatatgtgttaattgttatgggtaaggcttctggtcagcaataggctattagttaagttttgggggagtcaaaagatatttgcgggttttcgacttactttatttattcttttatcagcaataattaaatccaacacatatacttactcatttttattggttgatttggtggcctaaagtatgtttctctttttagattagtgttgataggttttgtgttttttgtagccagagtatctggagaagagctgtttgaaaatgtccccgttacgtgattctcttttcagaatgattcagtgtaggggggaggagccaagatggccgaataggaacagctccggtctacagctcccagcgtgagcaacgcagaagacgggtgatttctgcatttccatctgagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggacctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatatataactagaataaccaatacagagaagtgcttaaaggagctgatggagctgaaaaccaaggctcgagaactacgtgaagaatgcagaagcctcaggagccgatgcgatcaactggaagaaaggatatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgaggcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccacccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaccgagacagaaagtcaacaaggatacccaggaattgaactcagctctgcaccaagcagacctaatagacatctacagaactctccaccccaaatcagcagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaaggaggaaagatccaaaattgacaccctaacatcacaattaaaagaactagaaaagcaagagcaaacacattcaaaagctagcagaaggcaagaaataactaaaatcagagcagaactgaagtgaaatagagacacaaaaaacccttcaaaaagtcaatgaatccaggagctggttttttgaaaggatcaacaaaattgatagaccgctagcaagactaataaggaaaaaaagagagaagaatcaagtagacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcgcagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagtagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggaggtattttaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccgtactacccaaggtaatttacagattcaatggcatccccataaagctaccaatgactttcttcacagaattggaaaaaactactttaaagttcatatggaaccaagaaagagcccgcatcgccaagtcaatcctaagccaaaagaacaaagctggagacatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcagtacataagcgtgggcaaggacttcatgtccaaaacaccaaaagcaatggcaacaaaagccaaaattgacaaatgggatctcataaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaagacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactaggtcaaccattgtggaagtcagtgtggcgattcctcagggatctagaactagaaataccatttgacccagccatcccattactgggtatatacccaaatgactataaatcatgctgctataaagacacatgcacatgtatgtttattgtggcattattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgaatattctcactcataggtgggaattgaacaatgagatcacatggacacaggaaggggaatatcacactctggggactgtggtggggtggggggaggggggagggatagcattgggcgatatacctaatgctagatgacgagttagtgggtgcagcgcaccagcatggcacatgtatacatatgtaactaacgtgcacaatatgcacatgtaccctaaaacttaaagtattaaaaaaaaaaagattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacagttttctccgacagtcttgcatattacttttttttaaagtgctttggtttgatatttctttcattcatttctcagaatagaacttaattcttccctcttccaaacatatgctttttaaatattgaatttcctcaaaatatttcatagttaacgcagccaatatcttagccatcttccccaataaatcaaaaacctctaccaaaagttacataaaattattcattgtcatttcagcattaggccatcttttaacctttgggtaattaatatcaaatttctacttggtcagcaatatctcccttttttcttccccattctcaacccctttcttgaacctcattcgataactgctgaatttcttttctttctaggattatacttgaaaggaaattgtgatttattcccattaaactttaaaaacattttggctttatttaagccaacatgattctatttggatttgctttctttttcactacagatcttaatcacttctgtttcttttatgccctgtgtttctacatttatttattttttctttattaatgcttaaattctttccctcctcagctccagcacccatttcccttccttttcttgcttcacaacccttctcctttggggaagttataagattagagtgagatgaccctcagctccactcactaggttacaggattcattattaatcctacagattagttttagtcatgtgagccatggtgattttggtctctttttcttttttggaaggtaggtggaagaaaagacttttgtgttgctctgaattgtgtggtgtgtgcctgtaagagctagaattagtatagtcgtttttctactctgatacaagctagtctgatgacagtgccacacacagacgaggagaaagttgaggagatctcagagaaatgaagcaggagccttgattaacctgtttatgaagctcattctacttccagactttacaatgatgtgatctctgagctgataaattcttctactggagtacagtacagtagtttctattacttccagtatatcctaactgatatatacaaattgtaacatttttttaaaaatctaaagtacagtaagcatattgttggtcagcctaaataacagagagaggctctcttaacagaaatgatatttaggaatagggcattgccatgggaatacatgtgccatgataaactatgcatgtttcagggaagtacaggaaaacaaaggtttttaatagaaaaaaatgagaaggattacataattgttttgagataattatccttggctacaaggatcacactggtctgaggttggacagacagttgctgggcagatgtctttccagaagtattttttgtgtaaggttgtgacagcctttgtgtaaggttgtagtttttgaagaatgttttgtgatagtttttgtcaggcatttattcatgagaaccctattttcatagcctttcctgactctgtttgttaggatttttttgtttttgtttttaacacgagtgactcttgatttcaacagctttaattttctcccttttgatcaagatctttctctgaaggcattgatgatcagtcttcctgtaattaggttttgattgtcccttggtgctgggatggactggtttggtcccacattggagagggtgattggtgaccaggaatcagtgttaaaatttttctagccacatttgagcaacaagggagattgaaggtgagtggttcttggtctaagcctatctggagaccatcattaagtttaattttctctgttttgtaggtgcttgctgtcatctcaaagtgctgagctagtattattttgttaggagttgtacttctgcaaaaatttaacaagtaacagatacaaagtttaagaaaggaaaatacaaagtaaaattcataataatatggcaatcccagtttgcataatggttttgagccatgaaacctagcgtaaagacaactaattaaataattccagtggccatagagaatttggtgagacctattgtaaccatgtggcctgttttcttattttatgtatatggggtctcaactttcccataggaatttatccagttacagcatgtggtattagcaatagcacaggcattttcttatttaaccagttgatacaaaaagatctcttaggtttcattctttcaaactaccagcagaagccactgattgttaaatttcagttatggcattctcctatcaagtgaaaaaaagtagcattgaggtgcgtaagagtcttactattatataaaagtcttgttccaacaccttgggaaaaaccgtctaccatgtaaaaatgtcacctccttgtcttggtttgcagtttgaatgtctctagttagggcatcgggtggtttggtgaactttccgtgtgattcgtacatcaggcccaggacttgttccttcagatccatctagtttcagtttataaagctttaggaaaatttaggattcgttctagtctacaggtagataagaactattttaaaacaatgcacagagctacaatctaataaggatgtgttttatagttttttttaataaacataactttctctgtatagtcatcgtgatttatttatttaattttttgagacagagtctctctctgttgcccaggctggagtgcactggtgcgatctgagctcactgcaacctccacgtcctgggttcaagtgattctccaagtcatcctgatttttatcaaagataatcagagtaagacaaacttgtttgtaaaataagttttatcaataattgcctgtaagaagtgatttgatcacacggtattcccagatttaaaaactcttaaggctgcaaagccaaaccaaggcagattttagattttacctacactcttaaggttcctgagcttgtgggaagtgacactttttactcactcactgtgaggctgggaacccttgaaaccaagcatcgtatgcacattctcaaatatgatatttcagtcaaagccttggtaacacaaccagtgtattttattgtatcttgatagaaaaacaatagatttttattgaacctttcagttaaccatattgccataagaatactcacaaataatttttgaattgggggggcagtcaaataaggagaaaatgcaactatttctacctttgttcataaaagtatactttattaaattgcctaaagagaaagtttccttaaatctggaaaacagaacatttaagtaaataactaatagtgtttcatataaaagtcatggaaacattatctttatcatttatttaatctcatctgttttatttttgcttcatcttaacagtcttttgaacccatcagtttattagtgttctagaaaaaaaagatttagtccattaatcttaaagttattagaaacctgcatttaaaaggacccattagggcaaggtgtggtggctcatgcctgtaatcccaacactttgggaggccaaggcaggcagatcacgaggtcagaagttcgagaccagcctggccaacatagtgaaacctcatctctactaaaaatacaaaaaattagctgggcatggtggcagacacctgtaatcccagctactcgggaggctgaggcaggagaatcacttgaacccaggaggcagaggttgcagtgagccaagatcatgccattgcattccagcccgggtgacagtgtgagactccatctcaaaaaaaaaaaaaaaaaaaaaaagtgcccattagggccttttctgttaatctgattgtaaatacttgttttttattccagtatttattgtgcacaagtgaccagatacatatatatttccttatattctcctcttttttttaaatttttttagtatttattgatcattcttgggtgtttctcggagagggggatttggcagggtcataggacaatagtggagagaaggtcagcagataaacatgtgaacaaaggtctctggttttcctaggcagcacatcctgcactgcccttaatccatttaaccctgagttgacacagcacatgtttcagaaagcacagggttggggataaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccggtatcgtcatcatggcccgttctcaatgagctgttgggtacacctcccagacggggtggcggccgggcagaggggctcctcacttctcacacggggcggccgggcagaggcactcctcagttcccagatggggtcgcggccgggcagaggcactcctcacttcccagacggggtggcggctgggcagaggcgctcctcacctcccagacggggtggtggccgggtaaaggcgctcctcacctcccagacggggcggccggacagaggcgctcctcacatcccagacggggcggccgggcagaggcgctccccacatcccagacgatgggcggccgggcagagacgctcctcacttcctagacgggatgacggccgggaagaggcgctcctcacttcccagactgggtggctgggcagaggggctcctcacatcccagacgatgggcggccaggcagagacactcctcacttcctagatggggtggtggctgggaagaagcgctcctcacttcccagactgggtggccgggcagaggggctcctcacatcccagacgatgggcggccaggcagagatgctcctcacttcctagatgggctggcagctgggcagaggctgcaatctcagcactttgggaagccaaggcaggcggctgggaggtggaggttgtagcgagccgagatcacgccactgcactccagcctgggcaacattgagcactgagtgagcgagactccgtctgcaatcccagcacctcgggaggccaaggcgggcagatactcgaggtcaggagctggagaccagccccgccaacagggcaaaaccccgtctccaccaaaaaatacaaaaaccagtcaggcgtggcggcatgtgcctgcaatcccaggcactcggcaggctgaggcaggagaatcaggcagggaggttgcagtgagccgagatcacggcagtacagtccagcctcggcaacagagggagaccatggaaagcgggagacggagacgaaggagagggggagaccgtggaaagcgggagacagagaccacggagagggagagggagagagagagggagagggagagagagagggagagggagaaggtaaatacttttataaaaattcaaaacagtaactgtggatgtcagagacttaagagtggctatggttaaaaatccaatggaagtttattatcaacaattgacaagaaaatttagttatatttgtggcatatgacatattatctagaattctgactgattacattagatttctgcattttatataattttggaacattcattatctgtaacatacacatacatgtaactgaaagatctagtatcacctaccatttgacaatgtttcttattcaatttatccaataaccctaatcacttaatatctctacaagatgagagatacattctttgatgctctctaggagcccagtggggaaatcccaaagttaattctaggtcaaaaaatcttaatttagaattttgagcttgggaaagcctgccaaagatgtcaaaaggttcaaaacacttgaacaaaacagtagcacaggtcactgtgaaatcagtcttttttattattattatttattttaaccagagtaataatcaaaagacttcaaaagcaatacagaaagttacatggattttaaaaatcttaacccttacaaagctcagtttccccaaccaatcaaaaatctaataaagaccacatgaagttatcttgataaaatgcaaagtctttgtttctttggccagttaccaaaaaggtaaagagaatttttctgcagtgtaattgcttcttcttatggtaaacccatttagatagcctggaagttgaacctgatgaaaaaggtacttcaggttaatcagacaaaggagaagtgtgtctaaggttatgactctacaccttattatagaggaatgtaaacaataaaattagtaccttgagcaggggaacacgtggatcttagcagcagcctgagaaatttcctggttacatggaataattgagatacatcaggacaagacaagagtgcagaatcaagttttactaggaaacattgcttttctagtccttcaagacagaacatttcagtttcaggtcacaaaaacagagttagaactggagaaaaaaggaactgatgaaaaagttaaaaagagagagtcccagttattgtcccagctaaacaaaaagatgtatttttcaagaggagaaaggaggagagcagaaggcaatgatgcatgacctgcaaatcatgtgcagtgagacacagcagaatttaaacttctgagctatgaatatgagaagctttaagaggaaaactatacctcaagaaatgaaattaccattctaaatgaaaaagacagcatttccaacttgaaactagggaaattagatggaatctgttagaagatggctaagagattttagaattaaaaatcaaaatctcagtacttccaagaaaaccttgttctaacacaggggaccaaatttttagttttgtatcagtgtatttttagtatcaaagctcaatctttagaaagacttgtaaataattcccttctaattatagccaacttgatcacacacaatttctttcctaaattcatctttctcaaacctttcgtgagctgcatagacctttgacaacatgcttagactttttgttttgtcctatatgtcctctttcttaaataacgcaccatctttaggttgaaaatttaccacaagattctttctcatacaaaattattctctttttctttttaacctttcttaccaaaaatacaatttcatacctgtaatttttttaatatctctctttcctacttattttacttattggttccttttcttatttccttcttaaatcatattttgaaacaacctttaacctctgaattagacaaaatgattatctcaatagcgaatacatttttatgctttcatcgaaaacacatttttgtgtactttgtttacaaaattatatatattagaattttaattcttagtaacaatttttagtgaaaacataggaagcaagaaattttgaactgttcattgtatatcagtacttttatagatgagaatcattttgtaatttcagaaaatgtttccccataatttttatgttaaaaatagacccaaacatatttaggctttttataaaatttaagaagctaagagcaaacttacaattatgttcagcaatttatgttttaatgttttttaagaatcttaattggaaagacccagacatttaatgaatatctattacttaatttaacataacagtgggaatttagattgcctgaaaagttcatgggtaaacatttatcctgcctacatttacctggtttatctttaacaattatacctagattacttatgaaagttgagatactgggtaaaactagtcatcatttcaagttatttttcttttaaccatttatatagactgaatatcaggcattcacctaagtaagaaactaaaatatattggtattttgccaataactcagaacacacagctgtttttattaaactaaacagtgttacattagtcttaccaaagaattataccaacaaagattattctgttttaggttgggtttatagtgttatggccttaaaacatctagcagagacaaatataatcctgtctgaccagtaaacttaggcaaaaatgtatgctgataattttgaatacatttttattaagttttaaaaccagcttatttatcaaagtttttttaagtcacgtgaactaaaagacatttggcttaattactatgtatttcatgtaagcgctcatttatttaagccaatctgaatagaattccttaagggatttctggccaagtacatcagattttactatgtagacataacatacaacataaaatatgtgcatgtgcataaacacacctaagcatatatacatacacacaaaaattttggggtaaaactgtttctatagcagtttaaaaaaacaaaaaaaacctcttttacccttcccccacctttgactcagtttcacatgagtttagggttaaatattcaatgtttacatttttagctaggactggctgaattgtatgagaaaaacaaaatttctaagtggcattgaattttcggtaacaagtctatcttttgtttgccagtctgatttgcttgactagtcagcgtagcagggaaatcgtttagtgtgtttttggttttttgtttttcacccccgcatggcagaaaaaggaatttttatgctagacagagatactttatattgtttctttgagctcaagactttcaagtgtttgatctgagatcctaacttttgtgagcactatatagttctttttcttttagactatgaatccttcagttaactgtttctttaccctaagcaattgttagtcaggcaaacctaaatttacatttccaaaagatacttaagtcgttagttgtcatcgagctgttatactttgtaaagctattaatttgaaagtcctttaatacttttttttttttaatcttggctggaattccataagcagtgagttttatatcaacaccagtaggaaaatcagcagaatcaaagtaagcaaaaaaaaaaaaaaaaagagatggggaaggtagaaggctttacatgtcagcttaatatttgcaggttttttgtttttttaaaaagagagtttgaataatgactgtttgagctctggattttcctcgatatacttggtccatcagttaaaaaatgagaataggccataagatgtagcctgctgaagtcccctagaacctgacatgccttaatgtttgagaattccattccttttcttattaatctctcaaaagtacggaaaatcccataaattctgtcagggtatgtcaggactgttgttttaggtgctggtgactgtcctactggcttttaattaatcattctgtgtccatcaggctacaaggatcaataataagagtgaggccagtctcaggttggtcatgcagttgctgggcagatgtcctcactgaggttgtaagtttgtgatggtctttgtggtttttgcagtcttctgtgatagtttttgttatcagggatttatgcatgagaacactctcttcatgaccttttctggctctattagggttgtttgtttgtttgtttttaaacacaggtgactccattttgatttggacaactttcaaattgtatagaatgtggaaaatatgaaaaagttttttttttattttacaagtttgaattatttcacataaatgtagcttctttttaaaaaaacttatctttgaatgtttatcatattaaatattcttttaaaatgatattattaatgactatataatgttcttttagaatgctagaccgtagtgatagttgtcttttaagatgatactgtgagccacttcactctttcctttggccaagattaatgttgattttaagtgacttcttaccttttttttttttttaacttttctgtgtacctttctgttgttttattttcctgggaaagtggagtaaattttatatcatacttgtataaagtagtatttccttaaatagattccttggattactcattttcttagatgccctattaagaagtgacttacttgataaacagtgtatactcctattggctcacagtaaacattagcaaattgacgacttcaaaaaatcttgcagatgctaaatctctttatctttatttacttcatattttcccccagggtatctgacaatagaatggagatagatcttttgctgaaaatattttttcactatgttttattgtgtcctcattctcttagtctgcagtaagaaatctgtatttcttataggtaaatattcatatcttcagtaattcaacttcttggtgaacaatctagttatatactctgcttataccacagtcattaacacatttcctcatggtgtttacattctcaataaatatatcttattttttaaccatgtaactcttaaattttttagcaactgctttatgacctacttagtggtaattttaaagaaaatagtcaaactagcagatctccctgcttattctagtgatgatttccacacacataacttctcccactcccacatcctacattatccctggaattgaaatgagtacaagactatcaaaatcatttactgtaattttataaaatgagtctcacaacttagttttttagtgagatctgtttctgatggtgaatcacggtataaatgggtttttgttctgctatctttcttttcatgacttcatatatcctttttttaaactcttgcatttcatgttccttttgtttatttaagatcctcaatcagttttcttcactaggggaagaaagtgaaagaattcactttcttgtcgtcagtgaaagaattgccatttttttttattcccatccctgccacctccactgcaaacactttcattttcttttagaaacattaatttctcatttttctggcccttacattaagctacttatattcagcatatttctcttctgtgttttcattctgggttttttttgttttgttttgttttgtttttgttttttcttgaggcagagtctcgctttgttgcccaggctagagtgcagtggcatgatctcagctcactgcaaactctgcctcccaggttcaagcgattcttatgcctcagcctcccgagtagctgggattacaggcatccaccaccatgcccagctaatttttgtatttttagtagagatgaggtttcaccatgttggccaggcttgcctccaactcctggcctcaactgatccgcccaccttggcctcccaaagtgctgagattacaggtgtgagccactgcacccgtccttcagtctgtttcagcctgcttcattctttgtatatgcagttgcttttctctcatttaatcactgcctcagtttagctatcccaaaatactatacatctctttctcactcagttgtcttactttagttcttactcttgtaaaatgtgttaaataacaatatttttcacataatgatttggcaaatcaggtcaaaatatagtcatcaacatataacttctaaatgacagttgtagtaggaagagctttggagaagaaatcacaaaagctggtttcttattccttttccagtgtaatcttattatatggccttatttgtaatatgaagaacatgacctatcatccctatctcagatgactttttaaatgaagagattaatgtgtttgaaagagctttgaaatttttacaaatgctcttaataaaaaattaagacacagtgtttatggaagtcagataacattaaaaagattgaatagctttcagtcaggtaccttttaatgaggacagtgtgagtctaatgagtaggaattagctaaaatggtagggtgaggggggtggcatttcagagagggaacatcatgtgcagaaaggagttatgaaataagatgattagtatggattactataagtaatttagtatggctagagtgtaggatgtccatggaggagtatcaagagataggattaggaaatatggatgtgcttgaatgtttaatgaaaagatgtggaggattgcttaaaaatttaaaggaatgacataaactttgcattttcagaagtttattcttatactattgtagatgaaagatgcggacagggcaggggaggcaaaccggagttagggagacttgaggaggctattgcatttaacaagggtctgaactgagaacttgaagtaatatgaatgtagaaaggaaaaagatagatgcaaaagacaatagtgaaatggaatctatgggacctatgttctgattaaatgtgggggtaggaagctatttactaaaagagaaaattttataattattctagggcttctggcttaaatgggtttcctaccattcactgagttagagaccaaaatgaatttaaaggaaagagggtaaatttgattttgattttgttaaatttgaggtatttagcatatacccaagtgcaaatgctttgttttctgttgcataaaaggagagaggattggggacttgtctctttggtaattgaagccttgggtttagatcagatcacccaaagcagcatagggctaagtctctttgttacaccctatttttaaaatctaccccttgagaaatatacaattccccagaaaccttgatatccatggcccccctttgattcatatttgtggtccttaatcccaagtctgagccttcagtgaaaacctgtcttctcacaatctgccgtaaggatccctaggccactattttaccacttttttattgttctcataactctaagtaaaacttaaaatgttttttattactctaaagctatattaccaatctaatccaaatacacttttaacctaatagagtcttagtaatagcagtcattatttttatttttttaacttggagtttactataaattggtcaattgcttttcattagtttatcctcatgaaacctatatgataatataacatcataaattcagtttattgtagtagcatacctggaaattccctcttggtatttaactgtaaaggcaattattttaatatgtttacttggcagctttgtttggaacttgagcctttctcaagctataaccttaaattatgagttccctcccattctccttactccctcctttgtaatactttgtattgaccttgacgatttgtgtgagttgtgctttaaactctgctcatatgacattataggctggcttcttgatttactcttattccaagtttctctggcctgattgcccaattttccttttctttcctatatctggcagtgtcataactaagctgcctccttgctaccaggaggtcaggtggagtgaggacatagggcttcagggacagaatgagtgctggaagaacttcaggggctattgtgatggatatgactcctgcctcagctcacacagatactattttaaagtagcaattgcccgtcttatatgggtcctcaaaattcaaaaactgccagttgcctataatttgtaggcattctcaaacatttttgtcactgcacctagatgtgaaggaggagaaagatgttgaattgattcctgcaaacattaaaaaggagtgtagttaaaatgtcaatagtagtctggctacagatagtgaagagtctaccttttttttttaaacaagacttctgatcacagtgcatcgtttttgatttttttttttaacaagtagccattcatttggacatggaatcatcaacccctgactactccttagtgccattttaaaattgtttcaagggttttcacagatatctgagaacatcctcagttcacaggtcaatatacattttgagatacagtgtaatgccagtgcaaaaagtatatatgaaatgaagttaaaactttgtagtttatacaagctggaatagctattattaaaaagtcaaaaaataacaggtggtggtgaggttgcagagaaaagggaatgcttatacaatgctggtgggaatgtaaatagttcagccattgtggaaattagcttggccattttacaaagaacttaaaatagaactaccattctacccaacagttgtattattgggcatgtacccaaaggaatagaaatcattctacaagttggaatagctgttattaaaaagtcaaaaaataaaagatggtggtgaggttgcagagaaaagggaatgcttatacactgctggtgggaatgtaaatagttcagccattgtggaaattagcttggccattttacaaagaacttaaaacagaactaccattctacccaacaattgtattattggtcatgtacccaaaggaatagaaatcattctacgataaagacacacacatcgcagcactattcacagtaacaaagacatggaatcaacttaagcccatcgatggtatactggataaagaaaatgtggtatatatacaccatggaatactacatagtcataaaatgagtgagattatgtcctttgcagcaacatggatgaagctgtaggtcattatcctaagcaaactaacacagaaacaaaaatcaaagaccacacattctcacttaagtgggagctgccaggcatggtggctcacacctgtaatcccagcacttggggaagcacttaaggtagatcacttgaggcagatcacttgaggccagtagttcaagaccagcctggccaacatagcaaaaccccatctctactaaaaaatacaaaaattagctaggcattggggtgcacacctgtaatctcagctgcttgggaggctgaggcatgagaatcacttgaacccaagaggcagagtttgcagtgagctgagatcacaccacttcactccagcctagttgaaagagcaagactccgtctcaaaaaagaaaaaatatatattcacatatatgtatatatgtaaatatatatataaaaagtgggagctaaacattgagtacatatggatacaatgaagggaacagcagacactgggacctacttgaggagggagggtgggaggaagatgagtattgaaaaactacctatcgggtactatgcttattacctaagtgactaaataatctttacaccaaacccccatgacatgcaatttacctatataagaaacctacccatgtaccctaaacctaaaataaaagtttaaaaaataaaaaaatacactttgtagttatttattggacagtggtgtttgagtgataaagtacaaatttgttctttacttttttatgtcacagaaaaatggtagttcccagacgtttacattctaaacctatatagaaatctacatgctagcaggtaaaaataattcctgttagatttttctaaatcgtaaatcagatttatgtgaaaaaccaggttatgtttttcccttttatttctttgacaatagcagtgaaaatactattttcaaattctggattcctgtttagtacagctattctcccagttcactggatttaatctgtggaaagtgtcattggagtgcaagagttagcattgttttgttttgttttccccttgcccctgacattccactatgatattaagccactcttttagttacagttaaatgagacatgcatgggtgatttgcagttaactgctcgcctccacacataacaaatgcttcggcttcatatctaatcatgattcatgccttatgccagactcttgctgtcatcccagtaccagcagatggtggggctagacccctggggcagtatgacccagtgttctaaggttatatttcttctggtagcaatggtcagaaaaggaaagattttaacatggcaaattaagtttagttctttatggctttttgcttaaaaaaaaaaaaatcttaggtgtcacattttcacgtggttccttaaaaacttactttttagtccagtaaaataaactggagtgttatcattccttaactccaaatcctggtagtcaaggggtacaaggagcagtggtttttcactttcctcaaacccatgattggaaatacattttacatacagtacatatatacttacaggcacatatgcatatgcatatacataattcaaaccaaaatttcaatcataatgtttgaccttaccatgtgcaatatttttctcttcttttttgttgtagatgttgttaattcttttattttaaccagtttctagtcttcattccccaagtagattttagcgctcataatggattgggacccacagtttgaaaaactgtattaaacaatcagcacttattataaagaaatatgttacgtacttttttgtggactttctcaaattataaaaaatgattttcctcctctttactgatcacatcagctgccatttagttaacaagaaatttttagggttctctattatttgtatgtatatccaagaatctaaaggacatagaggagctacatatagaaacaaatttcaattgaatgttttaatgagccttataacctctagctttaaacacatgccatttctcttcattgttcacaaataataattttatttctttgagcttttctttatttttaacatattttaataggtcattctttcagtaacatacatgaagtagcttgtttttataggcccattatttgtattttaacaaggaaaggaaagaagtgggggcctcttgaatttctgtatcaccaaatagagttcagaatactatgggtttttgcagtgtactatttctcttcttcattaatggtgatgtgaatgagttgcatgaaaaacataggagtcataggaaccatgtaatcccttgactatcacttttcattccgtataaaatgataggaggtgagttttttgcctaattgccattttttaaagttgctatggcattatagggaaccatagagtttatataaagtgatagctcttagaattcagaagagatgtagaaaaaaagcatttatattctgaatagacagggttagaactaacattgagagtaagtttggtatgcaaatgatatattcagaaagaacttctttatagtctgactgtaaataaacaaaatattatattatcaagtgttttgtgccgattaaaactcaaaataaaagcagcttgtggagcagaaggtaattttgtataaagacatatatttgaatgtataccgaaactaatttctattatgggtgggaaaaattcttgaagaatttattgtagataatggttgtcagtgttagcattaaagattttcactgaagctctttgtatgtatctcttttagatacggaaacaagtgaaaaaatccaagcaagtggaatacttcagctgtttgcaagtctgttgactccacagtcttcctgcaaagccaaagtagctaacatcatagcagaagtagccaaaaatggtgaggtttacctcaagaacttttctgctgggaacgtcttcagttttacatcttacttgtcagtatgctttattaatttatgttttaattttgtagattagacattttttatttctatttatcttttgtttgactcttcatgtaattgttttaaatggctatagttacagtcattcatacctgtcccatctgataacccattccttctcagtagaattatgggaaagctctgctgccctcagctatacctgtgttatttattactttgggtataagattcttgaacttgccactgagtcattcatctttattgccataagagataatatatttttaaatatttatgtttgtttgtgttatacccacataaactcactgttcttttttagtttggcctattgttccgacattggcacttcaacagtatagttggaatatacgttctattttctacactcaccatatatttcttaagtttccatgtaagaatactctggaaaaacaataatgacaacaaagtttagattgtgtactatttatacactgagagattctttggatgaattatatcatagcataaatatttgcatgtggttttaattcagtccgtttgagaaaaacactgaattcctaaagcaatgtttaagcatataagaaggccgtactatatataatacctttagtttgcctcagtttgtcagttttacattattttttagccttttattgtagtatgtttcatatattattctttaaagtgaaggaatttgcgtaatcatcatggcaggtggctttgtaaagtaccagtatatgttggtttgggctggtaaaacaatgtatttttagatgtgttgccaaaaagaaaattgtttgaagctgtgtcatttgtgtagaggttctcaaaatgcatttcaagttccagttagattctatattggtatatgattttttggtggttgttagaaaattggccacttatcactcttatatgtcacatctaagaagcagatctagtttgaaaatgaattctttccagacattgcttgttaacctggaccaacccctatctgaattttcttagatacccagcatcttggtttttaagaacaagtcttttatttttaactttgttagagtcatagtatagatttccagaaatcaaggtagagactccacaatttttatcttaaaatcttttttcttaagcattcttatagtataaaatctgaaattttggataacagatttttgtgaaatggattgccattcctatattctcttacttaataatattcctcataatgctctgtcacaatttcatgacaactctgctttgaagagtttcttacagtaatactctagtagatgacagctatgttcgaaagacataatagaatttttaatgtttatacttttaatcagaggctgataaagggcatatcactaacctccactggttaaaataaataggatacattggtatggtgtttattactccatgaccacattacttttttaagtgattggctgagaaagtggaccagagtcttgttgagtgtttttgtttgtttgtttgtttttgagacagggtcttactgtgtcgcccaggctgaagtgtagtggcaggatcacggttcactgcagccttgacctcccagggtcaagcaatcctcctatctcagcctcctgagtagctggaccataggcatgtgccaccatgcctggctaatttttaaattattattattttttgtaaagacaaggtctccctatgttgcccaggcttgtctcgaactcctggattcaagggatcctcccgccttggcctcacaaagggctgggattacaggcatgagccactgattctggcctttgagtgttcttttcaaaagaaatacgtaacttcagaaatgcaacctgacacaacatagtacactgattgggcatatatttctttttagaaattgacgatgaaaaagattgtatgaaccagagaatatgaggttggaagttaatttgttcatctttactctgctgtgcacagaggagaaatattagcatatacttcttccattcaaataaaccccaaataggtttttgtacgcacaaaaagaatctttaaaaattaacacacctttgtgctgacattcaaaatttagaggatttgtaagaagttccgtgggcgagtttaatgtgggagggtagctttgaccataaattatagtaaaagattttttagaccttttaaatgtattattcccttatataatagacttaagactgatatgaggcaaaggacaaataagatatgacatatctgtgaatatttcagaattgggctctcaaagtatttaataataatagtaatacttcttaatgccagctatgattttgtgctaacataatttaagtgttgtgtacattatttcaatcccatatgagatagagttattttatacagataagaaaacatagaggctaaatatcttacctgtcatcacacttaagtgatgatagttggattttatgcactagtttgtttctctcctttcatttcttttcagtaaatgagaatttatgatggcagtggaatgtgtagaggtggtctgagtacagcggtagcagcatgtaacctgaaagattgggctggtaactgatgtgaaaatgtataaaaaccagcaaaagttgaactgctttatgtctgttcctctaaagtagttccctgcctttgacctgtagcagcaacagactcacccgggaacttgttacatgcaaattcttggatccactcacccagacttactgaatcagggactcaagagtgggcccaaccatctgttttaacaagtcctctaggtaatgctgatgagtataaagcttgagaaccacgtttcagtataaagcagtacagaatcagtacttttgattaacattatgctttttttgttcttctgtgtactttatcatattgcaaagtgtttatcaaaacttccgcctgagtgctcttaacaacaaaagagtgaaaatgtacacccaagaggacctggtgagagcattaaccagaaatacagaagtctcctgttctgttttatttattttaattttgccctctattccataacaggtacatgtagtacatgtttattttagtataaaatgcatgtgtgccctagaaaaatcattgaataaagttgagactccagaaaaatgcactatattgtcaggtagcttaaagtatacctcgagacctcagtgttggaagcttaacctccgtcattttgtaagaatgattatttattttttttttttttgagagggagtcgcccaggctggagtgcaatggtgcgatctcagctcactgcaagctccacctcccgggttcaagcaattctcctgcctcagccccctgagtaggtggaattacaggcacgtaccaccacacccggctaattttttgtatctttagtagagacggggtttcaccatgttagccaggctggtctcgaactcctgacctcgtgatctgcccaccttggtctcccaaagtgctgggattacaggcgtgagccactgcgcccggccagtactttctttaaaaacaagggcagtacaaagagtgagtgaaaaatataaatgtcagtttgacaacccacatataaaagtcactcattcttttatattcatgcctcatagttttccttgtttttcaaaagaaaaatataaaaagctaagagttaatacagggaagttattagagaaaattcaaacatgaatatgttatgatttagtctaataaacactgaggtggactctactactcagtgtttttatttggcttgaaaattttggtttaaaagagagttttaataaaatagtttcttcaggtaggtaaaagtggagaaagtagatgttaggttttttaatatttgaggatatgtgagggggatataaatcttggtgtatataaaaagaaaataattttcatcacagcctgtactttatgatgctgctgaaagaatatgtaattcaagtaggtttgagaaagtaaaagaaagaaagtaaagcgttaacactctaaatttacaaaagaataaaaaataatcgacaattatttaatgaatgtattactacagtcaaagggaaaaacattagtcttaggtggaaatcaactttttatttttattgatattgaaatagagcagtacctattccttaaacctctgtattgaatttctacattaacctatacatgttttgcaaagaaaaaaaagtgaattctatgttgtgtaggcaaatacacatatacagaaacacttaatggctcctgctttctacagcataatggcatccactaacgttgatttctattcactgtcattctgcatgtatcttggtttcagcctctttcccttgcagtactgcccctttccccgaaccaaaattttcagttctccgagttcaaattgcctagagagagaatctgattttttgcctgtttctttttaagttcatcgccattgttctttttaggaaatccttcaaagtagaccatcttttaggctattgagtcagaatccagccagctgtgaaagatagcaggtgtgaatgtagaggtataggtagtaggaacccctttgaagaaggacgactgtcagccattctgaagcctctccaacataatatgtataacattttaaacatattcttttttattattattattctttaagttctagggtacatgtgcacaacgtgcaggtttgttacatatgtacacatgtgccatgttggtgtgctgcacccattaactcgtcatttacattaggtatatctcctaatgctatccctcccccgtacccccaccccacaacaggccccggtgtgtgatgttccccttcctatgtcctagtgttctcattattcaattcccacctgtgagtgagaacatgtggtgtttgtttttttgtccctgtgatagtttgctgagaatgatggtttccaccttcatccatgtccctacaaaggacatgaactcattcgttttttatggctgcataatattccatggtgtatatgtgccacattttcttaatccagtctatcattgatgggcatttgggttggttccaagtttttgctattatgaatagtgccacagtaaacatacgtgtgcatgtgtctttatagcagcatgatttataatcctttgggtatatacccagtaatgggattgctgggtcaaatggtatttctagttctagatccttgaggaatcgccacactgtcttccacaatggttgaaccagtttacagtcccaccaacagtgtaaaagtgttcctatttctccacagccaatccagcacctgttgtttcctgactttttaatgatcactgttctaactggtgtgagattgtatctcattgtggttttgatttgcatttatctgatggccagtgatgatgagcattttttcatgtgtctgttggctgcataaatgttttctttggagaagtgtctgttcatatccttcgctcagtttttgatggggttgtttgtttttttcttgtaaatttgtttgagttctttgtggattctggatattagccgtttgtcagatgagtagattgcagaaattttctcccattctgtacgttgcctgttcactctgatggtagtttcttttgcaatgcagaagctctttagtttaattagatcccatttgtcaattttggtttttgttaccattgcttttggtgttttagacatgaagtccttgcccatgcctatgtcctgaatggtattgcctaggttttcttctagggtttttatggttttaggtctaacatttaagtctttaatccatcttgaatgaatttttgtataaggtgtaaggaagggatccagtttcagctttctacatatggctaaccagttttcccagcaccatttgttaaatagggaatcctttcctatttcttgtttttgtcaggtttgtcaaagatcagatggttgtaaatgtgtggtattatttctgaggcctctgttctgttccattggtctagctctctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaggtagttttttccaattctgtgaaggaagtcattggtagcttgatggggatggcattgaatctataaattactttgggcagtatggccattttcacgatactgattcgtcctatccacgagcatagaatgttcttccatttgtttgtgtcctcttttatttcgttgagcagtggtttgtaattctccttgaagaggtcattcacatcccttgtaagttggattcctaggtattttattctctttgaagcaattgtgaatgggagttcactcatgatttggctctctgtttgtctgttattggtgtataagaatgcttatgatttttgcacattttaaacagattcttaaacatccctgtttttttttttaatatatctgcctgaagcatgataactttatgtctttaaaattagctagcgaggactaccactctttgtttaaaaaagtaaattagctgaaaagcaaatgagttttagaagaaattcttttttactttatccagagactgacagtgactgaaagctgaggaatatattagctttgttttatctttatatgtttttgagtaaaaaatggttccaaagagttttgattccacaatttttctgtaattatttaccctctattattccaagaatacttgaagctattgattgtagagtccaaattttgaaagattggtatcatataggcaaaacataaaagaaacacagtaattcttcaatgttgccattgcctgaatagcaataacaaaacaagcaaaataataagataaacaagttttatttatgaatgagtacaaatcagaccgttcctaaatttcttgttttagtagtcaatgaaatcatcttactgttgggaaccaggcatagttcagtgaaaaggataatgaacatctgtgtttaatatgagttagtagcatgttaatttaagatttgaaatctagtccaggcctggtggttctcacctataatcctagcattttgggaggccacaatgggaggatcacttgagcctagaagttcgacaccagccagggcagcatagtgaaactctgtctataaaaaaataaaaaattggccgggcgtggtggctcacggctgtaatctcagcactttgggaggccaaggcaggtggatcacgaggtcaggagttcaagaccagcgtggccaacatagtgaatccccatctctactaaaaatacaaaaattagctggctgtggtggcacttgcctgtagtcccagctactcgggaggctgaggcagaagaatcatttgaacccagggggcagaggttgcagtgagccgagactgtgccattgcactccagcctgggtgacaaagcaaggctccgtctcaaaaataaatacataaataaaattatctaggcctggtggtacacacctgtagctccagctatgcaggaggctgaggtcagggaggatcccttaagctcaggagttcgaggctacagtgagccattatcatgccattacattccagtctgggtgatagggtgacaccttgtctcaagaagaaaaagatttgaaatctatgaagggtctaaagtaaccattaactaaagaggtagataagcagattgatgtgtcatctcctatagatggtcattgaattcatgaacatgtacagcataattcattttcttaacatgagtagtaggatacttagtactactgagtttgataacgtcaatgataagctcaaaggttagttgttgagataggaaataatctgagtcttagaagtttacattacaggggatttttagtggtagagtaataagtaagaaagagatgataggaattaattcatttatttcgggacagaggaatacctctgtgatttacagctatcttaggaggaaaagaagttgtctcagaggtgacagctgacagaataacctatatggtatgctctaagaatttgaaaatgaagggaaagagagggaggattgctcatgagggtacctgtggaacaaaccaaggggtagaccatcttgatagagtgaaaagatagtgatttttttagtaggacaggttatagatggataaattagttctttgttaactaactttattgaccagaacatccttatggtgagttgtgatgtccaaaaaggtaattcagttattggttattggagaaatttcatcagttacatacttccttatgttttgtagtggtccatcatgagacactgaaaaaaaaaaaaagtttatgtccaatcatgactgtggtggtatcatggtgagttaatacataaagaatggcataccataaaaataaggaaaaaatgggtttgaaatttaagaaatcttaagatttgactctttagacctgtaaatgtatgggtatagcagcagatatgagtgagccataaaatggattttaataaaggacaggagtgaagataagaagaggatgattccaccacatcttaccaatcaaaaaggacatattattttttaatggttcactgaaacctttatacatatgtatatacttatatttatatatatatttatatttataggcttttttagaaaacaaagtgaaaaattaggcaatatgatggcttagtttataactgtagtactttaattatcaggcttatagaaatacatcgccattgtttccatcatcacacatattgcttccaaagcatatcgttattacgagaagatagtgataaattagttgtgatgtaagttaattaaaatccctttggtttatggtagagactgtcagcaaacaaaaatatgaccccactcagttttgtgtattttatgaagcttttagtagggctgtaacagggtacttttgtacagaaatgtactcttcaaatattcagccaccttttcaaggtggcttttaaataccacatattaaaagtaggtatttattttattaggggagatgatttatgtaaattgtgaatcgttagatttttaattaaacatgtctcttattttcagagtttatgcgaattccatgtgtggatgctggattgatttcaccactggtgcagctgctaaatagcaaagaccaggaagtgctgcttcaaacgggcagggctctaggaaacatatgttacgatagccgtaagtgttgacatctcaataatacacatacatttttaagaattatgatattcagactaatctgcttttgtgttagcagtgacttttctaggctaaaacactaacatgggccggcatgattcagcactgcttatttagcagaatttatggagattcaggtcgttgtattcttatcaaagaaatcataggaaatgaaatgttttcctctgttatcacaaatgatattttcagaggaaattaagtcagtttctaagaaattggggctgtaagtttagaaaaaatacatatgtgcatcttctcaattaggtttcattgaaatattatctctgaatgggaatgcttatggacacagttttttaaagtttctgcgtctgtccaaatacatttttaattatttgcagttcggtaaaaccaatcataaaaaccattctcttctcaaaagctagattggcccattacatttgcattgactccattcctgtttgtcattatatcattgtcatcctcaccacattctataatatactgttctactaggcaaaaagaaagcaagaactggggtatgggtatattgtaacagcgttaacaatttctacttcccctttctacatataaacaaaatacagaaaagaattttaagtatatttagcttaactaggcttattctgattttccttagagttttatttgctgagccaaaacacgtattttatcattcacctgtaatgcctcctaggaatttagttttatttctataactaggataacttttagtgcttattttccccattgagtgtttaactcggatgagttatattttgttataacacaaaagatatggcccttttataataggcagtccttcaaaaagtgatttatgcatataagccagaaagaaaggacataaatatattcatttatgataaagaagtaggaaaaaagattgaaactatagttataactcatatatagcagtagtcgtaaagctagcctcatttattctccttttcttactttttctgaaataggagctacaatagccataagtattgaaatgtcagtaatgaatctgaggacatagatgtcttaatatgaattttaacttcagttttcagtccccagtatagcctgtaaatctgcttatctgctccttcaatccagttctttttatcatagggtattagctttatttacaaaattctgttgctttatgtttataattttgtgttttcatatttaggatttttattaagcaccatagtttataatatcaactttcaagactgaatcatttattatatatttatatgattaattttagcaacatatattagacctcagctgagtaatagtcaaaagattagtggcatgtacttggagagtactgattattactgtttttattcttacttttctgtgtttgttactggaatttaagggtaccaaaagtattcttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcccaaaagtattctttaaaccttgttcattttagttgttcttgaattatacattgtttgaacatagagaatattacctgttttgagaacttttgtcctggagtttttcctattaataaaatagaaatacacacagtgatattttgtctcatattgccttggtttttatgggcatagagtaattttatttcctgtgtattctaaagaaccttgaagttagggtaataaatgtctagttaacaagattattcttttgatgaaactgaagtccattattatagtatttatcatatctatttatcttatgggatatacaatataaagttctatggatatcctttaagttatgaagttaatttttttcattttattatgaatatttataaccaacttatcctcatttagttcaatggaagtcatagctaaatgattaagcatagtaaatacagcccatatttttatacttttaaactttagttcaggaaaatgaagtttgaagtcttaaaagtgaataaatgtaagaagtgattcattacttaatataaatcatgtgatgaaaatgtatttattgtgccatgctttcatatgcatataatttccatagactgcatgctttcttacccttttattcaaaattaaattctgtcaacttctttgtgatttttctagaatgattgcaggacaattacagtgtttatacttgaattacaagaataatataaaagccttgtaaatgtgatgttgtgtggttgatttgggaatttacttgaaatgcatttctcattttattttctgacaactggaaatttttcctttttaaacaagtttttagtggcttctattttaattcatcaaccttcttcactctcgggaatgtaatgcttcatttttaaaaggagtatagaaaactacatgatagccttgtgatcaatacaaagaatcttcttctttcaaataaagtatgttctaaagagttcatatatttgtgttttatctaacttacctatggggctaatcagttgatttccattttattaatgtactccaaatgaataatttttttaacataggtttattcaggatgatagtaggcttacagtagatagtaaagttgatgtaaatagaaagtagtataaagacttcactattggatcacttctcggcctgttggctaagatcaagtgtagaattcactattggagataaaaatttgagaaattcatacatgttctatagatttttactttgacacatgaaaagtaaagcatttgctagcatatttcagttagcatagtgtatttgaaaggaggtgagctccaactgtagaaagaattaccataaaatccgtggaaatctttggagaaaaactaggtcagatttcagttttaccagccttgacagtgcccattttaggaacttttcctaatggaagaaaacggccttatataatcctgacatgaggtaacagactggcataccgctaaatgggacggagtaaagctttgttgctgatgaactttttgaatcccagtctccttcttgcatatagagatgaaagaatcactcactggctgggaacgtttttcatttaaaatgcttggtctcttttcttccagagagctgcaaggcacttcatttatgtatttctctttcgaagtatccgaacagacttctgatataagcaatattttaaaatgcttctgccctttaactttgccaaaataactctttttatgagaaatttgacatctttcagatcagagaagaaaggaaagttgtatttcaatttggaaagaaataatcaaaatatgtgcgattgatgggatacaccagggaatgtggttttaaagcgcagtagtattatatttcagaaatgcatgcctttggcctatttacacttccttttcaaaggttttataaaaaagaggattatgttcttatatagctgtctttgtggcattcctcattttattgatttgtttatataactgtacacattttaaattgctgatatacttaaatggccttatagttttaaaaagctttatgttaaattcccatcctgtatttataattcctggggataaattggtgatttgagactagtgttctgttttgtggatattactgcctgaggtcagaaaataattgttacttgatctactggttaaaagatattagtagaggctagaagaaaatgattacgtgaaattaaatatttgtgcctttttatacaccgaggaagaataatgtacaaatcaaataaaaatgttttaaaattaaacaaatatacctctttatagaaataaaatgtatgcttattatataactggtactattattggaaagatatgtacacttaagcttatatgatatgctatcatacataagataaaaagttgtattcttccttgctgatgagtaaatattaaaatgaggtagtaatcagtcttgccaaagccagtgtttatgaagtgaaatattgtttattcattgacatcaagtataaatgggaaggatgctgaaacatatgcatgtatccgtttgtatattggcgattcttgtgctacactattttaatataaagtctttatttttatgtaaaaattctttatataaaaatagtgtagaaggaattatagttcttactgcaaatactgaaaaatagttaccaataattgtacaatattttatcatgtaagttggtcagaaaagtatatattaatatgatacagacatactttgaaattgccaaagtaatcaaaatatatttgcaacagttatattcaaaagggaactatttatatccagcatttaaaataaatgtttatttcagtgataccaattaggttatttgatgagttatattaggtatgttattaaagtctcatgcaagtctttgtatttaccctattttctgtgttattcagttttagaataaaatagaattatcagtcagtaagtagcgtaaaaataagattcttcagttttcatcaatctgttgtattttatgagtttattattaaagtacatcatgtgtataagaataaacaacaatatgttactgctacttttagagatagtagttatgactattatcacatgaaagcattccactataaagacattctaaatatagattgaagtagatgttgttttgtaacactatcataagctctaaacacaagcatatgccattaaagagctttttaaatggtagagaaaataaaatgaacaaaggaacacaacctgaggacaattacagagcacacactaaatatgtttttttatcagaatgaaaattaataagaatattaactgtagctgttttttaagaaattaaccaaatagtgcattgcttagaaaagaatttgtttacaaattaatataattataaatgtataaaattttaatataacccctagaaagttggtattgcaaatgaatgtgatttccagctccaccattcactaagttgtcatttaatttttctgattttaatttcctccttggtaaagtaagcttgtgtggattaagtatgtttatataaaaagtgtgtgtgactcagtgtaatacatacaataacatacaaaaggtatttccataaagatataaaagccagaagccatataaagagaggcaaagataaatctggtgggaagcagggataatgtgcttaactgtgtataagcactgatttcacttgagcttcttggcagcctatgtgaaaaaacaacttgatatgccttgtaatttttattttatgataaaaaggaatattttagttctttaatcaaacaacttttgagacaaaatagtaggagggacttatcaggatgtcattaattccctagatgattctgtgcacatacctagttacaatatgtaaggatatttactggcattatagtgtacctagtgacggttctacaaaagttgcccagatgttttccatgtgattgtttcttgtactaatcttcaacagaatctgggaaataatactgaggactttacagaaggtagttttatttgggtagtatatcccgagtgtgttgttttttggtggttaaacttgcttaaaggattcagtttaaaaatttgaaaaagttttgacttgaatatatttcctagtttagtttaaaaccagaatacaattctggtttccattcattgtactttatccttttctctgtgttgtgtgatatatccaagttctatttcttgagaccaaaaaccatgtttatctctgatttttgagcccattatcagtttgatggaaacctgactagcatgaaagtgagtattttaaaataccactttagttgtggtacacaaatctgtacatatgttagaattgcttagaaccatacatgcccatacacatacactaatgcatgtaaaaactgatgaaatatgaataaggtctgacattgtaccaatgtcagtgtcctggttatgctattgtgtagtagagttatgcaatgttaccattggaggaggctggataaagggtacatgagacctttctgtgctttttttttttaaataacttcttgtgagcctctaattacttctaaataaaaagttttaaaacctcacctatccagaaagcatatatattctcttccctatgggaaatgaccttgttgtttcagcagtacctgaggtgggaggtgggggcagcaggcatacacataaaattttacagcatagctcacagcagtaattttaatgagtttgtgcaattaatgtgaaagacaaaaatgcctgtaattttttctccctccaaattggacttttatggaaaaaaatcaacaaaaacctaacagccctaaaataagatttacggagtgggaattcgtatttgttgggttaggacctagggacaaaagcagagtaaatttcctagaaagggaataactgatagggaaatattatagaccaaaaaaagtgaaattatgaactcaagtaaacaggttgatattaaaatgagaaaggacatttctgccatagagaataaaagacagaagataaatgaaagtataaaaaaacctttaagtagtaaagagggcactcaaaagtgtatttctgggtatagttctgtcttcccagtaaggtagatgtcaggctcatctgttaataaaagtcaacaccaaaatgatggtaggaagtttgtggttttgggggaaagttcaaaattggggctgtaggacatgtaaatcatgaagatacgattttttaaaatagccaaatagtaatataggtatgctatggtagagatcttgattgtgcatccattaatgtatagtgtgcttaaaatgtctataggctaaggaattattttgactttgatatgtggacaggaaggagcctctgaaagtaacttgaagaaattgatattttcagttttgtagcatcatatagtctaattggaatggacagagatgtgaggcagagatatcaggaagccattacaggaggccgggtgtggtgtggtaaatagtgactgcggcagagagaacgaaattatattgtaaagtgagagacagtactcagatagtttattatcagtttggctggtttttgcgtagcactgcaccaggtttatttaagcaatgtaaagtactctatctcttcagatagtttacactttgagaaactatgatctttccatttttgtacttggtattaaatttaaatccctcttttattaaatggtgtttggaaatccaagattctataaagtttaccttaaaattgtaggacaaagaacacatattactgcttttttccccatgcttgattactttccaaatactatgttataaaaagctaatgtcttagggaagacatgaaatagtaatttcgagtaattgttcttaattttatagatacgaaagtagaggcaacctgtgagagagtattgcacgtggcaaaaatattagatgatttttcttgggttcaataagaagtcatatatggttgccttcccccccaaccccacccccattctctgagtcagaagtctgaatggctttagaactttcctttcctcattaagaggacttaggtagggtgggaaaagtctaattatagaggcctacttgggggtttaaaaacattttttgtctaaatctgttttttccccttacctttaccactctcatttcacctgttaaagtcaaagtttagatatgtgaaacataagatttccagtctgcttattgaaaccctgtcaacacatattatcctctgctctttttaatagggttttgtttacatttttaaaattttcttatttgtaaccaagttgaagtactgagaactttctcaacttttaatcagccttttccttgctacaagtagggtgcattttccttggcggtgaggaaatatgaaaaataaatgctacgtaaaagtgaataattcagggccaggcatagtggctcacgcttgtaatcccatcattttgggagggcgaggcaggtggatcacttgaggtcaggagttcaagagcagtctggtcaacatggtgaaaccccatctctactttttaaaaagaaaacaaaacaaaacaaaactagccaggcatggtggcatatacctgtaattccagctttgggaggctggggcatgagaattgcttgaacccaggaggcagtgatttaagatcacagcactgtactccagcctaggtgacggagtgagactctgtctcaaaaaaaaaaaaaaaaagagtgaataatttacatttttcctgctgagtaaaatgtttttacccgttgagaaactatgctgtcatcagttcagattaaattctaaataactatatatgcatttgctctcacacacacacatatatatatacatatatatatagtctagcataatttaagtatgaaatagtttggtacaaaaacaccttttatatttaaaatatttataaaacgttttgatcttgaacaattggagtaataaattggaacaataaattacatacattattatctaaatgctatgtaaaagtaacttttatggaaataattgagttaaatgactttataatttgtgtataaagatattcagtcttttgctaataaaatgatacagaaatataaaaatatagggagtaaagaaagctttagtaatttctttaggaaatgtattgccatttatggagcctttattagataaagggtttttgaaaaagtagaattattgaacaattttaactaatgtgagaaatctgttggacaacagaaattaatactagtatcagcaggcacaccaaaaactgtgtccatcaaatgctgggccataacctcattttatgctgtgcccttggtactagtgctttgggaaatgaaagatttaattcatttacttttcctgatctggcattacaagtgtaaatgtatatacaccttgaaattttcccacctaaatgcagatttttaaacctgaatataatgtcacaaaattgcaaattgcatgcttctcttttgatatgtgtgcacttaacagtcatggtggctttttcttcatgactcatttttgtgattttacttatgtaatatgttatagcttttgcttttatatctagtctttcagggattttgcctgaatctggaaggtgaataaattgcgttttgagttttagaaacgatattcatgagcttttttatttgaatgctgaaaacattcgattatgtctaaggtacataatagaaattcactgttggcaaaattatagggggaaatgtaagcattagaatttaattttctttcctagtagacttcataaatacattttaactttatcttgaaaaacaatgtagggtctgcatgtggtggctcacagctgtgatcctaacattttcagaggctaaggtgagaggatcacttgagcccaggagtgcaagattagcctgggcgtcatagcaagatcgcatctctacaaaaaataaatttagctgtgcatgatggagcacttctgtagtcctgctactcaggaggctgaggtaggatgacacgagcctgggagttcaaggctgcagggagacatgattgtgctaccacactccagcctgggtgacagagcaagaccttgtctgaaaacagacaacaactaacacaatgtaggtatgtctattaccatttccctgctccaggaaattaaaatagaacttggcaaaattaaaagcagtatatttaataggaatgggaaaaaaaaagccttcataatcatgcagatcagaatggccagtatttcagacttagaaaaatacgttgctgctcatgatttacatccctgacttctaatctctttgagtgtgaaaacttcctttttaacaccacaaattattgttctctccctttgaggatataggtcacatatttttatagtaatgattgtacttacaaaatgtatgtactgagaagatatgaaataatgagtaaatgccaggaaattctcactctatgtctttgtattctttggtgtatacatactacaattaaatccacacatattgattgaaccaactatgtttaggggacactgcctgtgatggggattataggggaaagaatgagcaagaagtctctatccttgtgaggctttcacaggaggaggtagataataaacaagtaaatactacagaaaagatatttatagattgtgatgactgacatcaagggaataaagaaggtgatgtataataatggagtgtatttgagggtgaagaaagttctctctgtggatgttatttaagctgaggtctggaaaatgagaatgagccagctaagagaagaggaagaatattccttatagaagtagagtaattgagctaagtgtggtggctcacatctgtaatcccagaattttgggatggcaaggctcaagggctgcttgaggccaggagtttgagaccagcctgggcaacacagcaagactctgtctctacaaaataaaaaatgagccattatggtggcacgtgtctgtaatcccagctactctggaggctgaggtgggaggatcacttgagcccaggagttctaggctgcagtgagccatcacaccacagcactccagcctaaataacagtgagaccctgtctcaaaaaaaaaaaaaaaaaaaaaaaaaaagtgtagtaattgtaaagccctgagagggcaagggatttggtagaaattcagaaaggaaaccaggttatgcaagatactgtgaacagggagtattgtgtgataaagttcaagaaacaaacaaaagtgttgatgatagaaagcctcatgaatcatcttgaagtagtgagaagttgttgaaggcaagaagtgacatgatctgatttggattctaaaaacatcactcttggagctgcatggaaaaggagttgagaagcatggaaattaagagttaagaagggaagcattgagactaattgaaagacttttgtgattgtccagtcacaacataatggtaacttggattaagttatggtagtgtggaaggaggaggaacttagaaagtatttggagtgatggattggattgggaaagtgcgaaagggagaaatcaagagtgatttctaggacttgagtacctggacagaagatggggcaatttgccgatgtaggaaagaacagaggttgttttttgtttctgggtttttccgtcattgctgcttgtttttattttgttttgctgcaggcattattaagtctgagattcttcatagagacacaagaagaaatggcacataggcgatttctatatctttatattcttttacctttggggaataaatattcaaaaagttaaaataatctcctgcatttagcaaaatgttgttaactgtttcttagatggaatatgtagattcagggaaccaagagaaattagaaagcttaagtgaataaaactaccttgaaatcatagttttttacgtaggagggaatttaaaagtcatctcagccacccctgccaaattttacagataaaaaaactgagacctgaaaattcaagtgacttatcagaatcaacagctaaattggtgatagtgttgatctgaaaaccagatctcaggttcattgtttccgtaaatatatctgaggaagttatcactgtcaaatacataaatgcactgtcattaaatacatttatgcttcagtgtgaataattctgagcacgcaggttttggaatatgttttaaggattttactaaaagctgttcttaagccaacattttgtttaatttgtttaaagaacacaaaaataaaatttacctaattgaaagaacatagagtagaaccaagtgatggaggaaaaactttttacatttttccaagtataaaagctttatttaaaaaaaaaaaagtatgatgtgagggctgggtgcagtggctcacacctgtaatcccagcattttggggaggctaaggctggaggatcactggagtccaggagttcaagacccaccagagcaacatagggagatcccatctctacaaaaaagtaaaagaattagcctggcgtggtggcacacacctgtaatcccagctactccagaggctgagacttgagcccagaaagtcaaggctgcagtgaactctgatcaggccactgcattccagcctgggtgacagagcaagaagaccctgtctcaaaaaaagaaaaaaaaagtatgtatgtgaataaacattctttattatatttgatttattcttgacattttctctgtagagaagtgtgtgaaatactgacttcccttttaaactcattgggaataaaggatgttcagatttgattggattcttagtaatacctaaggaaacccaattaaaaatttgagagtttgactcttcccagtaaaccagctagacaaatacaggtatgttcttcaagtttgcagacaagtatctattgctttgtattgttttctttacacacaaggtgtataaagaaaaattaaaattgagccaggcatcatggctcacacctgtaatcccagcactttgggaggctgaggtgagcagatcctttgagctcaggagtttgaaaccagcctgggcaacatggcggaaccccctatcccctctctacaaaaaagtgcaataattggcctgttgtggtggcatgcacctatagaccctgctacttgggaggctgatgtgggaggatcgcttgagcctgggagatcgaggctgcagtgagtggagattgtgccactgcattccagcctgggcaacagagcaagaccctgtctcaaaaaaataaaataatactgtccttctaattgttctgaataaattcactttttcctgcaataatgatataaggaatttatacacatctaactttttttaaatgttactttttatcacttttgttcgatttttactgattgttaatatacccttttaaatatctctattggcacagcaaagtaagcttttcagtttagtagctctctaacaaaatattttctaattctgtgctttaagtgaaataaaacggggatgaaagtggcaaaaccatattatcatgtccatgagcagccaaaaagaagtctttagtgaccagagaaaccttaacgtaaacagtaagaagcaagtaataggacagaaacaaacagattctttactcagaatgtttgtcatttgaagtaaatacaagtggtggttctctttctctcactctcttttcaacataatatgggtgagttaataagtatttaatatatatgtgatatggtttggctacatcctcacccaaatctcatcttgaattcccatgtattgtgggagggacccagtgggaggtaattgaatcatgggggcaggtctttcccatgctattttcgtgatagtaagtctcatgagatctgatggttattataagggggagttttcgtgcacaagctctctttgcctgctgccatccattgaagacatgacttgcttctccttgcctttgaagccatgattgtgaggctttcccaaccacgtggaactgtaagtccaattacacctctttcttttgtaaattgctcagtcttgggtatgtctttatcagcagcatgaaaacaaactaatacagtaaattggtaccaggagtggggcactgctgaaaagatacccgaaaatgtggaagcgactttggaactgggtagtaggaagagattggagcagtttagagggctcagaagaagacaggaaaatgtaggcaagtttagacccctacaggcttgaatggctttgcccaaaatgctgatagtgatatggacaataaagtgcaggctgaggtggtctcagatagaaatgaaaaacttgttggaaactggagcaaaggtgattcttgttatgttttagcaaagagactggcagcattttgcccctgccctagagatttgtggaactttggacttgagagagatgatttaaggtatctggcagaagaaatttctaagcagcaaagcattcaagaggtgacttgggtgctgttaaaagcattcagttttaaaaggaaaacagagcataaaagtttggaaatatgcagcctgactatgtgacagaaaagaaaattctatttttctgaggagaatttcaagccatctgcagaaatctgcgtaaggaggaaccgaatgttaatccccaagacagtggggaaaacgtctccagagcatgtcagaggtcttcacagcagcccctcccatcacaggcctggaggcctaggaagaaaagatggttttgtgggccgggcctagggcctgcctactctgtgcagcctaggaacttagtactctgccttccagccactccagctatggtgagcaggggccaaggtacagctcaggctgtggcttcagagggtggaagccccaagccttggcagcttctatgtggtgttgatcctgcgagtgcacagaagtcaagaattgagtttgggaacctccacctacattgcaggaaatgtatggaaacacctggttggccaggcagaagtttgcttcaggggtgggaccctcatggagaacctctgctaaggcagtgcagaagggaaatgtggggttggacccccgcacagagtccctactggggcatcacataatggagctgtgagaagagggccaccatcctccagaccccaggacggtagatccatcaacagcttgcaccaggcacctggaaaagctgcagacactcaacaccagcccatgaaagtaaccaggatgggggctataccctgcaaacaagagggcagagctgcccaagaccatgggaacctacctcttgcatcagcgtgacttggatgtgagacatggagtcaaaagagatcattttgaagctttaagatttgactgccctgctggatttcagacttgcatgcagcctgtagctcctttgttttggccagtgcctcccatttggaatggttgtgtttatccaatgcctatagccccattgtatctaggaagtaactaacttgcttttgattttacaggttcataggcagaagggatttgctttgtctcacatgagactttggactgtggacttttgagttaatgctgaaataagaatttgggggaatgttgggaaggcatgattggttttgaaatgtgaggacatgagatttgggaggggccgggggtggaatgatatgatttggctgtgtccccacccaaatctcatttttaattcccatgtattgtgggagggacccagtgggagataattgaatcatgggggcagatctttcctgtgctgttctcatgatagtaagtctcatgagatctgatagttactgtaagggggagttttcctgcacaagctctgtttgcctgctgccatccatgtaagatgtgacttgctcctccttgccttctgccatgattgtgaggcttcccctgccatgcggaactataagaccaattaaacctcttccttttgtaaattgcctagtcttgtgtatgtctttatcagcagcgtgaaaacaaactaatactgtatgtattacctcatcttggttaactgagatccatattatgcactgctttttaataaaaagagaaaggaatggagatatgccagattatttgttttgagttggtatatatttcaggaagtcataaataaatgagaatgatgagcagttttcttaaaggtgactttatgttaaaattgattgactaacaaccaagcctccaggtaaaatatttaattttttatgagtgagatcaattgcattatttttacatgaagatctatatttaacaatccttatttcctttagccttgaacttttttcatcattttatgatttgtatgattatgttattattaaattaattagaaaagttatacatttaaaatttgtttcatagaatagggcttattcttttctgtagctctgttgattttggagaaggagaagccctatatttacctatataaatcagctaaagttccacttcagtttgatatgcatgtactgaagtcctcttattcactcaggaatacattcattcttttaagaatttttcatttttacagtttattagtctgtttcacatgctagtcaagacatacccaagtctgggtaatttataaagaaaaagaagtttaatggactcacagtttcacatgactgggaaggtctcacaatcatggtgaaaggtgaaggaggagtaaaggcttacatggtggcaggcaagagagcttgtgcaggggaactgccctttataaaaccatctgatctcatgagactcattcactgtcacaagaacagcataggaaaaacaatccgccatgattcagttacctccaactgagtccctcccatgacacgtggggattgtgggagctataattcaagatgagatttgggtggggacacagccagaccatatcatacagtatatgaaaacttcttaaatataatgtttcagtggctcatcattcttttaatgcttaataaccatatactcacaaatacacacctatgatatgatctagctgttttattcctagatacttgcccaaagacttatgcgtgaatgttcaatgcagcattattcacagtagcctaaaactagaaacaacccaatgtcaatcagtatatttgagtggataaaagatatagcggtatatccaaacaatggaatactatttagcaatgaaaaaatacttctatacatgatgacatggatgaatctcaaaatcattagagtgaaaatagacacataaaagaatacttactgcatgaagccatttctataaaatgcaaagtaatctatactgacagaaaacagtggttacctgggaccagaggtggagggaaagatggcttacgaaaggacttgaggattcttttggttgtgatgaaaatgctcagtatgttgattgtggtgatggttgctaaggtatgtagagctgtcagcactcatcagttaaacacactttaaatctgtgtagtttattttacctacatttttccttaatagagctaataaggaagggaatccaattagaatctaaacaaaaaggtacacaatttttgtttctttttatatacatgttaaattgcagtaagggcttgaaagacgttctggaaaacatggctatgaatctctttctgactcctccaggtaaaagtaatttccttatttgtgcttccattttactctgaacacttaattttgtttgctgcttaaattatatgttttccctcacacttccctctttttcccctcacccaagtaaaactgtgaattatctgtctttgtattctcaggacctagttcaatgtatgaaacatagtgagcattcagaaaagtgataaaggagggagagaatgctaatttagttgcagattttgagatatattgatgaaactgactgtgtaatacatttcattaatcagtatttaaaataaggaaattttactcctattaagtaggatttaacttaggttataagtgaactagagaaaacatgttaatgttaccatgtaaatctacctattgtggattcattatttatagatattaggtgaatgtattcatgtttattatgaacattttattcctttttattcctgtgcagttttatataaacctcctttctccttttttctccagtcattcctccaaaagaggtatattctcttctctatgcttctgtaacacaccataaaaaaattgcattaaagctttttttttttttttaacagagtctcgctctgtcaccctggctggagtgcagtggcgcgatctctgctcccagctcattgcaacttccacctcctgggttcaagcgattctcctgcctcagcctcccgagtagctgggactacaggcgcgtgccaacacacctggctaatttttgtatttttagtagagatggggttttgccatgttggccaggctggtctcgaactcctgacctcaggtaatccacctgccccagcctcccaaagtgctgggattacaggtgtgagccatcgcgcccagctgtattgaggcttttattctgtttactactctgtcttcctcattggaatagaaactctttgaaagcaaagtcttgtgttgctgtttgtgtctactgtacctgacacaaagcctaagttaaaacttaataagcatctgttctgtgattgtgaatgtgtggatttatccctagttttatcagtttttgttttatatattctgaagctctgtttgtaggcatttatacatcatttaggattgttatatctttttttttttttttttgagacgaagtctctctgtcacacaggctggagtgcaggagcaggatctcggcttactgcaggcttcatctcccgggttcaagtgattctcctgcctcagcctcctgagtagctaggattacaggcgtgtaccaccatccccagctaatttttttttgtatttttagtagaggcaggatttcaccttgtcgggccaggctggtcttgaactcctgacttcaaatgatccacctcagcctccccaaatcctgggattccaggtgtaggattgttgtatcttcttgttgaattaacccttttgttgttatgtaatgtccccctttatccctgataatactgcttattttttatgttttatttttttagatggagtcttgctctgttgcccaggctggagtgcagtggtgcgatcttggctcactgcaacctctacctcccaggtttaagtgattttcatgcctcagcctcccgagtagctgggattatagacacacgccaccatgcctggctagtttttgtatttttagtagagatgagatttcactgtgttggccaggctggtctcaaactcccgccttggcttcccaaagtgctgggattacaggtacgagcctccgcccctggccaataccgctttttctgatgtctactatgtctgacaatgtagacacaccagttttcctttgatcagtgtttgcatggtatatcttttaccaaccttttaatattatttaatattcttaaagtgggttaattatagacagcatggttgggtcttgcttttttacccaatctgaccatctctcccttttaagtgacatttagattatatgtatttaatatgatctttctgtggttggcttcaaatctaccatcttcctagttgtttctttttttctcccacaaaggcgggtttatttccgaacctagttgttttctgattgtctgaactgttctttgttcctctttccctctttgtccgcctttttttggattcttcacatttagctccattactggcttcttgtgtttttttattgtttgtttttgaggtggagtcttgctctgccacccaggttagcgtgctgtggcgcgatctcggctcactgcaacctccgcctcctaggttcaagcaattcttctgcctcagcatcatgaatagctgggactataggtgcacgccaccatgcccagctaatttttgtatgttttttaaatagagatggggtttcaccatgttggccaggctgacctcgaactcctgacctgaagtgatctgcctgccttggcctgccaaagtgctgagattacagacatgagccctcgtgcccagcccattactggcttctgatgccactttgtaagtttttagtggttgccctgtggcttgcaatatttattcttagcttatcacagtttatcttcaaatattatgtcacattaatttaatcaatcaccttactgtacagttccacttcctcccttaaatcttttatgcttctgttttctatttcatttttacatatgttagaaatcccaaatatattgatgttatttttacttaaaaatttgagacacggtcttgctgtgttgcccaggctggtgtgtagtagtgcaatcatggctcactgtaaccttgaactcctaggctcaggtgattctcttaccgcagcctcctgagtagctaggactacaagtgcatgccacaatgcctggctaatttctttttttccttttgagtagagacaggttctcactgtgttgcccaggctgatctcaacctcctggccacaagagaccttcctgccttggcctcccaaagtgctgagattataggcgtgagccactgtacctggcctgtttttactttagacagtcaattatcttttaaaaataggagaaaaactgtcttaacatacttttatcattttcagtgcactacattctttgggtagatccaaatttttgtctagtatacctctaactgaaaaacttttactaacattttttgcataacaggtttattgcaatgaattatctcttttatttgcttgaaacaattttacttaaccttacttactggaagatattttcactgggtgtagaattctaggttggactttaaagatgttacttcattgtcttctagcttgcatagtttttgatgagaagtctgctttatttcttattttttctgtttttttcccccttccggctgcctttaagagattctctctctttccctctctctccctccctccctctccctctctctccctccctccctcttgtttgtttttcaacagcttgggtatgataggtctaggtatgtttaattgttttcctttgcttggggttctctaagctttaatagatttgtagcatgatggctttcatttttggaaaatttttcagtcattaactcttaaaatatttttctaccctgttctctagcacttcattctctgagattccaggtacagtagtgcccccttatccacaagggatacattctgagaccctcagtggacacttgaaaccaaaggtagtaccaaacctgtatatatcatgtctttttaaatatattttcacacctgtaataaagttaaaccatgaattaggcatggtaagagattaatacaataactaatagaacagttatagccatatgtcagcatcactgctcttacactttgaggccattaagtaaaataagcattacttgaacacaagcactgcgataccgtgacagctgatctgacagttacttaagtgactaatgggcaggtagtgtatctagcatgaatacaccgggcaaagagggagttcatgatttgaatgggatggtgtaaaattttatgttactcagaacagcgtgcaatttaaaactttattttttttatttctggaattttttttattattttcatgctaccattgaccatgggtaacaaactgcagaaagtaaaaccatggatgaagggggactactgactactgtacacttaggttagaccatttgctattttctttccttcagctcttgggtgctctgggttatcccactcccacttgtttagtttgttcatgttttagtttgtgtaatttctattgatctatgagttcgctgagtcttttcttggtttgttgagtctgctattcagcctgttgaaataattctttgtgttgctcctttctagcatttccatttaactctttcttacagtctccattttctccaaaatttcacatctattcatggatattattcagtttttccactagatcctgtaacgtagtcattatcgttaaagtccctgtatgatagttttaacatctggatcacctgtgagttttgttggtttcatcttttgacagtgagtaatttttttcttaaaatgcatctcaactttttattgcagctggatattattgtaggaaaacagattaacagtatttaatctctggaattgagcgcacttccttttaatttagggtgttcgcatagggtagaggtcaagccagtctagtcaggagtcgaactaggttcatgttttgttgttgctcaccttacttgagtgcagtatgttcttcaaattcctttagtagtcggccgttcttactttatgcttagagtatgggtgctggaggactttccttagtgttcttgctttgacttcaggcttggacccgttcccgcacagctgtgggctttttctgtgctcttgctcctctcccagtggtaaattgttgttaacaaggaacattcctattacagttagcctgtagagcaaaatcccatttctaaacaatactcacacacacaaaaaagaaacttaaatatttcacagtgttgtattatattctattatatggagtggtgtgttagtttcctagggctgctgtaacaaagtaccacaaactagttggcttaaaataagagaagtttattgtttcacagttccagagatttttaagtctgaaatcaaggtgctcaccagggcatgcctctctctgaaacctgtaggggaggaggacatttttgcctctttgtagcttctggtggtcccaggtgttctttggcttatggtagcataattctaatccctgcctctgtcttcacatggcattctcctctgtgcatccccctcctcttataaggatacaagtcatattggattaaaaatctgccctactccagtaggacctcaccttaactaattatatctacaatgaccctgtgtccaaataaggtcacattctgaagtgctagggattagaacttaaacatagattgaaggagggcacacaatttaacccatgataagtagaaatgacatttatgtctcaaaaacattactcatatcagtaacattatctcctatagaaaaagatactaaaccacagaatattaaaagccaggctaagaatacactaacatattagaaagatttttgatacttgcttccttttcaattcagataaatttaaagatgcaagtgacagtttttaaaaatcacattttaatatgaaatgtacaaagtccaacgtatgtgtgtgtgtcactctcacaatcatccatcctcaaggtgaatagtaatttatcaatatctgtcaaaaggccccattcattaaaaaattcttgagtacctactatatactaggcatttgccatacacaaggaggaaacgtagtaaaatccaaagttaggatgcactgtacgacatgccacaatagttagattcagtggctgtattttaggtcttttcctcacccttagtgtataacttgtacctgataatagtgtttaacttgataacattttttttttctcatttgtgagacatgataaccatgacacaaattttattgctgcttgcttttgattacagaagggtaatggaagtgcagtaactctttagatttaaagccctgctcttagctaatgtgaagaatgatcatacttgtgctggaaactgctttgtgtgaaagatcatcattaaaggatttaataggactttaaagagtgggctgcactttttccagtggttggatgcttcataattaaatgaggaaaattgagatgtaaattatatttttagaagtgacagctcaggatgcttcataggttagctgttacttatgagaagagtgaaagatgagcttacacttagggatacacaagtttaggatagggaaccttttgagaattatttttaagtgaacaataatactcattatgataatgtaacatgaaggtatagagttaactatggaaaaccaatttatatggacttgtgcaatgatagctgttgtatttaaaatgatttgttttctaaatactactggaaaaataagtcagttgtaagatacttctaaagatgacttatgtcactggttttgctaaaggaacacattattatcatttattcctttgaatccttaaattctattaaatatttttaaaaaaatgcttttactgtgtttctcaggctgacttgtccaaagaaagaaaaaagctgtataatcaatcattcctatagtggtggttaatattttttgaacccagatcactattattgtaatacatgctttgcttttcttctcatatttggtaataatgtaatttctagtatacagattgtgtttatgccttgcaaacaattctcaataacacatgagcaaaaagctgtgttatagacaattcagaggaggggggtggaaggagaggaggagaagaaaagcactgtggctctgaaacacaaataggtaatttgcttttaattgtattgtgtttttattgcatcaaatttgttgaataagtttgtattttaatttattgaattatggaatttttgaacatttactagcttagtgtggataagaagccagctttcattcacagttcattgcaaataggtgccacatagtttctaagccctagtttcctagtatatgaaattcctaatatatgaatacaaggcttagtttagctattctctaagatgtcttcttctaagtaagtcctaagcatacatgatttatatttcaaaagcccagtttactcaggaattagaatcaaatactattcgagctttgcaatttaggatgggatgtactataccttcatattattgaaggtctgaacatttagatttgtaatcctaatgttcagttttctgagacatcatccacatagaaattgcccagtaatttagataatttacatctatgttatggaaaacaaaaatttggaaattagatttctaaatgagatttgaccaattgttcttggctggttcatctagctagttactctggcagtataagaattttctgtgatctgatgagctgattagcatacagtcctgttttccatctttataacaatacagtaaaactaagtggataaaactgttttgtttcattttagtgtggatttcctcaaaaattttcaaaattatgaacatagtatttctgaggtcttactatataattgtgtgtgtgtgtgtgtgtgtgtataccataagaaattacatattttaagttgtatcatctaatatgattcagcaacagtaataaagatgtgaccttagtttcagttcttatatttggaaaatgaaaatctttcaaattgtaactaacttcgtagctgtaattcctttgtgagtcatttattttgctgatctttgtgctatatttctgtagctgaatagtacagtgtggtagctactagccaaatttagctactgagcaatttaaatgtggctagtctgagttgagatgtaactgtaagggtataaaacacttggattttgaagatatattgtgaagatgataatacaaaatattttgttaatttattgatttgcatatcagagtgatatatattgaattgaataaaatattactaaaattaattttcacctgttttttaatgtgtctattagtaaatttaaattacacatgtggttcacatttatggctcacacatttctcttggacctcttctagagggtggttatattttatctaaggtgtcagatttagaatgacacgtattcttcttttaatttattttcattcttatgttcaaaagttagaaagtagtctaaagctgtttgtatgttctgacagttaagtaacatctgttttatgcaatgtagatggacacataatggaagttatgtttgaccatcacttgaccactttttgtaatgttgaattatattggtgtgccctagaagagagggaataaggaaaaaagaaacaaatcaagaatgaaaaaagggaacatgcttctggactataggaaatgccattaacaaagaccatagtaccaatattcaggaattacctattatgatttagagttacaccatatggttttctttaataagagctattatcaaagacataataacgttcccatatggttttcttcgataatagctgattttgaaaaccaatgacaaaaagttatatttagtgattttttcaacctgagggacaaaaacttatatcaatagaatatcacttagtttctgtttttttctcttacacagcattgtcatttgtgaaagagggagtgaaagttttcatattgtaaacttctaggacacagggaagttctgtaagctcctatatgatgccaatgagaataatcttggtttgcttaaaaagtgattgtctcttttccccatcccacccccatttccatgtttatttcttttgtttttttctgaaaagacatatttaatgtcctgcctaggtttattttctatttattcacaaaataaagaataacactgttatgttttgtatttgaaattgtaaggtacatttcttttttcttttatttttaatttaactctttgttttacagatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatggtaaacaaaactgaaaacttgctttatctctgggggaaaaattaaaaattatctttactatagtgcaaaacaaaaatatttgaaaaatgatgaacaaagaattcgtaagtggcatataaaattaataattagccaacattaaatttcaatgtttcaaaaatgtaaaatggttaatttactaaatgggactaatttttgaagggctgccagttttgatcagtatcaaaaacaaaaactccacagccctatagtatgatttaagcattcttactgtgaacattttaaaaataaacaatattaaaatagttttatcttcgttatatatataccaggagtagctttaaaatatgaacactgtttgcagaagtaaaattattttatctagatgctaggtttacttcgaataattttttaaaactctaataaaatctggctttagaaacaagttcagagcaactgtagagatctcattttagaaatttaattattgtaaacagcagtttcttttctctgtaaaacatttttagaccctagaaacaagtgatgtatcaataattttcagatagcctatatggttaattaaatgcatataaatctgtgatattaaggcttcacaatacgtttgtgtcacaaaatatccatttgtttctttatcatcttatgtgaatcactgtgtggatcagacattcaaattttggtatgttcctggtatgtaacacaaataaggtctttctgtggtttgtttcataatggcattttaagttgtgatattttggcagagacattttatttgcatattagacatgcagtattattctttactttcgtgtgttgtagaaacacgtggcccttttggcatactttttattttttttcacattttatagttgtgggtccaaagaaatattctcaataattcaaaaaaaaaaaaaaagataaaccttggcaataaatggctactgatatttggcccttgttgttagtgacaacagtgaatggtggggactgtggtaagttgaagagcccttgtcctattgaaaggggaaaaccactactcttctctagccagttgtttctgtatgacggtttggccaaatactgcccaatctttatattttggggatgggaggtgggggagaaagctgaaatgtctagtttgttatgtgacatctgagttttaaatgttggattacatatttttaatactatagaagctaaacagaaagtatcttcaggcctcatcctgtccaagggctaccagttttaagcctttgaattaagataatagagtttttattgatcaaatggcttacatattaaacttgagctaataataaatggtagtcttcataggataagttacatctgtttttccttccttctggtggaatcaattttgaagaacaaatgccctaaatataaatatgagaaacagaaaggacagagcctgagaaatccacaaaataaatacatatttcctaaataattgaaatttaaccacaatacataggtgtctgaattgcattaagaaatcattggtcagattttcatattgttttctttgcttttaactgcatttgggcttggacatttgaggaagtaggaagaacactaaatgggaaaaagttttagaaatataaatgaaagaaattttaagaagttattccagttttggaagtagtagaattagtcttgttatgcatctaacctagctgttagttctttgaggaagctgttaaaaaaaaatctgtatagaggtattaatatatcagatggctggtcttcaaaagcatcactatttccaatccaaagcagtgattgagtcccataatattatagggtatcccagtgtgtagagaagtgttctgagaaagaagattataattaacagcatgtggagtgcacagtctaactgtataatatatatattttttgaagagtaggcttttttctagagctcaggcattcccaagaaataacttagagactttagaaagctatattaacttttctctgaatattattagacaaatggtctttttcttcctttatttcaaaagctgcagtttgcagcttttaaaacttatcgaataaaaaagacataatcttgagtatttttaagaaacaaatgcgaaacttgtaactatcatcatctttcctctacttcctttttacattttgtctgtcacgagtgtcttaatttgtgaagtgattctttttcttctaatgttcactgaaattatatccttttatgtatgtttggcataattattaaagcgtctttattgttttgtccattatttgctttctcttttccttaaaatttatgtttgaagacttaaatattacatcatctttactgactcagattgtttggtattgatcatgtgtacctagataagtccctgaaacaaaaaataacagctttttgaaactcaggaggcactttctattagcactaataagtgaagtttctttttatatgtatttactatgtagaacatcagtatacaagactctgctaatttataagtaaaatattgagtgacaaatagctttttcctgctgtagtagaaaagttaactgccttggacccaataacttaagccgtatctgtagttaggaagttattgttctttagctgtatgtataaaatgtttaaagtatgcttataaaaaaaaagtactgagagtggtcacaaaaatccaccaacatagtttccctgaagagaatattttcaaattatttattagtctcaaaattgaaacttagaatgtcttgattcagaagcttcctgttcatacagtaaaactcagagcatatccactttttaaacccattaaataaggaataaaacaagtttcctaaacacatgcaagtcatatatgttatgaaaatattcagtaaagtcatttttgtaccatttgctaaagctgtatataattcataatttatcagtttcaaaagttttaaactagctcaagactctatacctctaagctatgagctggatatatacttttgtttccctattggtgaagcagttaatactcaggtaagtgtagaataatctgaatagcaaaagttataattgcttagccaaagaagttgtatcaataatgcataaataaaataatatttaaataacacaaaactttagtaaaaattgttttaaatttatccattttggaaaaaatatacatgtttttcacatggtgaaaaagcactctttgattctgtggctcatgaaaatagcctgaatatttgacaattatggctgtagaaaagcttgttgacactttgacattcagtttgagggaatgtgttgaacttgctatttttttttcttcattttgttacaactttagttattctataatccaaggaactcaaacctttaattgtaggtattttaatctcattagtttgttatctgtttcctagctttggttacccaatgccaaaacattgcagtgatgactgaaaattttgttcagtcatccagctgttttcaaatataacactgttttagcacataggagtttggaaaattttcattgattgactttttctggatacttattatcgtctaaaattttcattagcaaattcaatacttggaagagaaacatgttattggaatgcatttgcttcattaaataagttagaaccattacaaactctttcccactatgttagttgatgttccttatctacgtatgatacatggtggcagcagtaaggggcattgaaaacacactggtagtaacaagtaccagatctgtaattaaaaatttcccataggtgatccacaagcgtgttgagtctgcatttgtacacttgaattaattgcacgtttgaatagaaacaaaccagtgatctaaagcaaagcactaaagaccagaacaccaccttgttgacaaatctattggtagtcaccattgttgtaagtagatgtaattaatcaataaatatctcatggaaggtgtaattgagggtttaactttttctcctagtattgttgtgctagagacacaaatagagggaaaattctattataactcttaaagaaagtggtaaatgataagcattaaacactaaagttactattttacgtaagctatgccataagagagaaaagtagaggcaattgaaagatgccatcaggaaaggaaaaagtatcttctaaaattattaacatatgcagtctaggcttcttcatctgacctatattttatatatacatgtatgatatgtgtatatatgatttctacaaatacagccgatttttctaatattttaattactcctcattattgaaaaactaatttctctttttttgtagttcctgaaatctctctgagatacctacatgataattcttatatttatttgtcgcatgggctgatgataattaagctatggttgaagggaggccatgtatgtaatttaggaagtgtaacacctgtggcatattattgaagcatgacaactgagtttaaatattaagctcattgtttaaattcacttgtttaaaaaaggcctatactacttctccccatattaaagattatttaatgtgtaattaatcttagctgctactttcagtcaatagcaacaatttcttagttcataattaaaaactaaaaagcatgttggcctgagctgcatgtttatccttatgtttcagtattacaatactttattacgggtgaaaaagagcatttcctagatgtgttagatgtttagaaaaatgatttgcttcacatgagtgaagaactatttttaaactttacttactgtggttacaagctagttaataatttatatatttcctaaatagtaaattatttttaccttactctaaggaaaaagaacaaaacaatatgtaaaaggtaaaattgtatctttgcaatttattatcttttttaaagtttttcttctttctcagagatccttgttctgatactgtcttttttaatgaaactaattttccatcatactaccttacatgtattttatttttcctctatttatgaagacatgggagatgtacatttaagttaacatcttttgaagcccagtttgtcactttttactccagtgagttaaatgaagtgtgttgaagacttattgggcagctgaaaagtacttaggcttttttattctttctttattatactaactgttgttctttatttactgttgttctcttttttaaaaattcctgaatttttgctgtttgtccaacagctttctagtcagtttgctgaaaaaggttgctttcataaagttctaccacaagtgttattttaaacaaattgtttcactaaagaatagagcagttagttagtctggtgcctcttgctaattcaacctattaaatttgaccaattagaccaggttagcttttagtgataatcttcctagactatttctatgataatgctgttacttaatgaacaggctgagagcttgattttcagtagaggtgtatcagatacacattttggtctaattccacatgatcaagtattggcatttatattcagctttggccattagagaatgaacttctgaatgtaagaagctgaaattttatcttagaaaaataaaattattatagtctttttgtcagtaattttagcagtctaatacttaaaatttggcattatattattacaggaataatactttctcagcattgttagcttctagattgctactgcgattatgataatgcatttaatatcataataccacatagatgcccacttagttgagggcagtgaaagggcaaaatatgtttggagttgctcattctttagtatggttttctcatttttatttgctttatgtctggattgaagattaatcatagccgttatcaaatattattttcaagatttttctcattgtgaaaatttgaagtggaaaaattggttttctgattttgatttcatccttacaagatgtatatcaccattaattattggtgcattttaatataataatatgcatttacatttcaactgatagaatttcaacatataaagcatataggcaaattttctctttacatgaaatgcttacctatatttaaaaataaatattcagatagtaacaagtctgaaagaccaggtctttactgtaagtgttcctatactagttgaaatatgatgatatgaggcacataatcattgatcatgcacaaatttttaggttccagaaatgatgttgaagtaagcattgagctgtttggcctttcaaaagctgaggctaaaatcagaggtaaataataggttttagccagatatctgtatttgcgtgtctaatttaggccatttacaaagtccattcagagaggcgctgaacccagaaaagcatcatgtgtaaattaacttttatgaagattattaatcctgtttttttaactataagtaaaatccagttaatactgtactgcctatattgttttatttactaaaaaatttttaagtcctacttgaaaaactagaaagtgaaatgcttttgaatatgcagatgtatcttgttaacagaatttttgccttgcaaataacttctgtgcaattttaaactgtaaaaactaaattacaataatgccccatggtaactagaaaagttttttttaagctaatatattcttttgtaaaagaagggatttctatgtttttaagcatatgtttgtaagatacacgttggaatataaattaatttggcattagcttaacttgctgtacaaaaattcaggcttaaatttatacttactgtagatgtggtctttatctcagcagtgctgtatgaaagcagagactgaattggtttctcttaataaatgctgcttaagcaacagctggcagtagtcctctttaaaaaaaaaaaagacatttaacttaaaagaccagtttttttctgagatgaaagcgtagagttttctttaatcagaataaacatatctatagaatttttttgtagcagtattcattgtaacaaaagttgatctgtaacaaataattaacctgtagtaaatatggggaaaaattatctactagattaaggcataatcactctagttgtcattatattgagaacagtaaatgaataagtttcttaagaataataaaatatttttactatctgttgatttttgctttggcatttttttgttgttgcttctgttttacatcaatctcacacatataattttgccatttatatttaaaacttttacaaaagggaaattttgccatgtagagacaatttttattttcagaacccagaaagaaccttagaattatcttttctagttttttatttgttagcgactaggaagaaatgtataaatgtattgttttaaacctccaatattgtcaatattaatgaatgttggctttttttttttttgaaatttctatgtatcattgaaatgtataatggggcttaaagcgacaatctgggtgcaaaacacatgcatgtttgatataaagaaggctttaaaataattgaattttaaacacatgtaagtaatctagtttttatatcctcaacactaggcttagaataaagttctccactttataaacatttgagtatataaagtttttaaccactaatcatcctcttggtagccatatttaagtcagtttactttgcagtgttataatagagctaaaacttgcttgaacttgaagctctacttcagttgtatcgtttctaatttttaattttcatatccttttttggaaatacagatatgtcattaaatcaaaggtagttttcttcagtctttattatgcccaaatgatttttagccaatttgtattagaacttttcatcaagagttttatttgcttctttcactgtttcaactatgctcaactcatttgactgtagatgggatttttaatgcaagcctgtaaatggcaatatcatatcattatactgtgaataatatatctacgtactaatgtacagactgtattttgaattgtgtcttgtcttgtttttacaagttcattcttaagttctatttaccaaaaagcttaatcttataacattgtctataaggccttaggaataaggtaaacctgttataatcttcttaacaaacttatttttagtaacttcagttgaatcactggaattctcagcatacttttctggacctataatctagttataccaatgttttaaacattaaacttaaaactcaggggggaaaaggttcctcaacttgagatcttctctccagatctccattctttggagtttccatgagtgtgacctgaagaacttggaaccattgaaattcaaatgtaggtaggtaagtgttcacaccagcgcatgcgttgattgccttatatctctttgtatatgcatctgtattgcaccccctcagtgcctttcttcctcttcctccccatagatcatgtagggcctgtgtcattttgatattatgtaatttcgtaaatctgtatttggtcagtgtttgtctgtgatgtgtgtcaggagcagttaaaacagagtcttcggacatttatgacattgtgctgtctaaagactgtctttcacacataagtgtttgctatgtatgggcctgggttacatttttgtgaattgctgtgtttgttgagctctgataacattctcctggaggtgctgatattcactgagggaggcagaagtagtagtcttgcagttgcttcacttaatctgcctaatgtatctagagaacaagaactatttctagttctcagaatttcttcctgtttgtctttcgcttaaaagtcatactcctgataacattcatgataccatggatgtcagctattatcctttgaaaaacatttgcaagttttctttgggcaataaaaaagatgatcaaatgaatcatttgtttatgtcaataagaatatcaacttatcctacacaaacaggacccctacttaatcttttcaaaaaacagcaccgccacctactgaattgtaacatctacatagtaactgaaataggtagactcaatctggaatgatctcttaggcttaagtagagtttcttctcaaataagcatgatgagatgttaggagctttattagtgttatttctctgaaaatatcagagtgccaaaatctaggattcctaccaagcttttatctaatttttttcctgttatcacttctgctaagcacatcattgaacttcagaatatttaccatgtttcccactcacctcccaatctcttataaaaatgagatagccctggtgggcgctgtagctcacacctgtaatcccagcactttgggaggccgaggcggatggatcgcctgaggtcaggagttcgagaccaacctgtccaacatggtgaaaccctgtctctactaaaaatacaaaaattagctaggtgtggtggcaggggcctataatcccagctactcgggaggctgaggcaagagaagtgcttgaccctgggaggcggaggttgcagtgaactgagatcacaccaccgcactccagcctgagcaacagagtgagacttcgtctcaaaaatttttttttttaaaattaggtagtcctttgacactggttcttaaattttggtcttatgattttagatgtctaaaaattatagaagacctagaagactttttttatgtatttgggttatgtctgtcaatatttactgaattagaaatttaaatgaagaaaatatttaaaattatttagtatttcattttaaaataagaaacctattatatgttaacagaaataacatttttatgaaaaatattttcccaaaaaaattgctgcaaagaatagcagtttgttttactatttgtgatggtgaagaaaacaatggctactaatacaatttggtgccattgctggtgttcatgctaaaatgccagcagttttacctaccattgctttcgtaccattggtacaaatgtcaacacagtggcaagagcaaataaaatcttgggatttttatgaaaatagctttgactttgtgatcctctgaaagggttccagggacactttttgagaaccatattctaggaggcctctttctttgtccatgaagtggaaatttatatcaacctgtttctgtaaaagtgtgttttttttttctctctctctcctcctctggaccttcattatacaagtagaatggcaggcctgccagtcggtgtgaacaaattttagaattatttgagtatgattattgttttagttagcatcatagaagtagatagatataaaagagagcacccagttggtccacagtgagttcatccaactggatggctatatatttttctcttttgtgtggtatgtgtgttgtatgtgagtatataatgaatttggctcctgggtagttagacacattttcacgaagcaacatgattttcatgaattatggcaatacctacaatgtgccatttggctatgctaactttttctcccaatctgccataatttcaaatattactgcttcaatttgtatgccaaagattgtattaagcgctataacatttctttacttttcacccctcttttacctggaaccaaaatttgtaacattgtaaaagcagtccagaaaagtgatagatatgccaagttagcagaacatgaagagcattatcttctaagtggtattcttctgttatcttctccataaaatgtgttattcctctgatgtccctggactgttggatttttcatagtttgtaccaacagaactgagggggtgtgtgatgcttacatatatgcagacatatagtggagtttgactcacattcaatgcatgcgctagtgctcacgcttacatacctgaaatttaatgattcatcagctctgcagtatttgacaaagtagtgaaaatgaatacatatataaataaaaatactgctaaagaacaaggatcttcagaggtgaccctctagtaaagagccctatctactggtaagtaacctaaataatttctaacttggaaagctccttggtgcatgattattacaaatactataaccataatgcaactattctgccaatataatatagatataacactattgtgtaagtattttacctttaagtgttgtgaattattgctaaatttcatattcagaaaaaaatttaacatcaaaagtataaatacagattacttagttgagtatattttaattcttatctccttttagatttcataacttcattacaaaatttgaaattgttttattagagtatttgaactctaaacataaacttccatttttccatgtttattttttattcttattttggtaataggcccctttctattatagatgggctcccacaaccaaaccagataattatctgtaattagccagtcatcagttttcagggacactaagcctctgttgactatctcctcatacttcactctaaaagcaggaagaattaacaacaaagaccaccaggcaataatgaactggcatgtgagatagctcaactctgtatgttcttttctgaaaatcacccacctgcttccttatctatagattaagaactataaagagtaataaaaaaaattagcaggccaaccctgccaagggattggaactatgaggaacgtgtttttgtaagaaagttttgtctttagattgcaaagagaaataaaagaatttggggaaaattattagcttgaaaatggcatatcattttaaagagaaaaaaatttgtttagtctttagattgcaaagagaaataacttaaaagaatttggggaaaattattagcttgaaaatggcatatcattttaatgagaaaaaaatttttgaagagcatttctgtatcattggatgaaccagttatggacagttatagtgttttgcataaacatatgattttttgtatgtctttcttagcttattctaagaggcagtacttttggtgttcatttttggttcatttatcttcaactttgctacaggtattctattattattgtccatgaagaacccttgtggaaatccaaggcatgtttagtacttcaaaatcaattagtttcttagaaaatgaaggcaagcaatgatgacaaggccatgttaacctcattctcttcacctctctaagccagactttcctctctcttactgagatgatctgtcactataattaaataaaactttaaaaagaaaaatattttaggtaacttttttttctggtacatctcttcctagcagtcatcaagaacactctggttgcaaatattcagaaccaatcatttttgtgtatttattaaatatttttaattttgtattatgaaaagtgtttttaaaggattctaagatttttttctttcttggtcttcattaaacttgctacttttctcatgcttttcatattctgtgatttcctgtaatgcaaatgttactctaaatttttcactcaaaaactaatggtaatgtttgtttatacttattaaaagcctgctttttaatggtataagaccccatttagaaaactaatgatttgatatagtcttcaaactatttttatttctaaatgccttttggttattcaaaggattcaaaactaaactcttctgaactaatgtttaaaatgttcaacacaatcatatgaatggacttcattttctattactgtaatttaaataactttgagtttccaatagggaaaataagaggtgttttcttcttataatgttcatttgacatgtcaacactttcttttctgttgttgttttttttttgtttttacagattcgcttcaagctcagcttatcaatatgggtgttattcctaccttagtgaaattactgggcatccactgccaaaatgcagctcttacagaaatgtgtcttgttgcatttggtaatttagcagaacttggtaagtcttagtcatgaaccacaaatgtaattaacttattaatgtgcttacaataaatttttctgtagatattaagaagctagaaatccatttagattgtattagtttattttttgaagcatttgagatatttccatcaatattttaaaaagtaaatccaattagatcttatgattgcattgtttatgagagcgttttatttccctaataattaattttacatattaatgtttaaagctcacattgtacattatgtaacagagttgaatatttacacttgtctccacttgactttaatctttttacatgagggatggcaattgtatgtccacgggtaaaaataagattgaaatgtattgcatagtggcttgtgcctgtggttccagcacttcggaaggccgaggtgggtggattgcttgagctcaggaattcgagaccagtctgggcccatctttacaaaaaatacaaaaattagctgggtgtggtggctagtgccagtagtcctagctactcaggagaccgaggcaggaggatcacttgagcccaggaggcagaggttgcagtgatccgacatcatgccactgcactccagcctgggtggcagagccagaccctgtctcaagaaaaaaaaagaaatttattacatttcatataaattgcatttttctcaggtaaagaggaatctaacgttagactaaggttcttcatcctcttttcatgaaatctcaaaacatggcagaggacttttttctatgaatatatgtgttatagtattagaaaacaaaatctgtggaatccttgaaattcagaaggcaaacaaaaccagaccaatgctggaaacacatcctagtcataacacagaggaggatgatggcctcagcacctccacctcttcatttttctctttgttatggattaccctttcttcttccccacgcccccaccttcttgtcttccttcacaacccacaatcatgttaataataaattattatgggcatagtgaaatgaaatggtgttttgtcatagctaaataccgtagttacaacaaacaaatatatcaattctgttacgtaccacattctataaataaaagcatgaagtcactagtcttggtttttctaactgaaagctcatcttgattttaacattttacttttattttgtcttccaagcaaagggaatagaaattattaaagttatttttagtaaaagtcattcttactcaatgggtcatatcccagtatttgtgaatgtttctcatcttctctcttcatctgctttttcttttttatactagcctaattaacacattttttctgtcattcattcaagtgagaccaagaataaaagtacattcatttagtatttgacaaagttattcttttccgtgattaaaatggaatgtaggagtttgtgttcagtatggttggcagaaataaaacagaaattgtgttataatccgatactgaaagtgtaacagaaacatgattggttcaaatctttcttcacttgccttcagttttatgaaaatcaaagagtgcaggtactttgctgttacattttaatgtgagcagtttctagaacagcactgtccaatacagtagctaccagccatgtggcttaatgggcattgaaatatgaagtctcaattgagatgtgttcagtataaaatacacaatcgatttcaaacactatatatgaaaaatataaaatctcatcaatatttcatatgttgattgcatgttgacatgataatttgaatatattgggtgaaataaaatattaaaatgtttactttttaacttttttagcacatcttactagaaaatctaaaattatatatatggttccatttttgctctcattatatttctgttggacagtggtgctctagaaaatgaagtgcaacagaatcatccttcactctgttaaggccctcccttttgaagttttaggagagtacatagaagaaagcaaagattaatgaaatttatctcatctaactttaaggaaaagtcagtacaaagtaaggaaattacaataatccttggataggctgtgctgaataagaacttatataattgtagttgtttgctgaggagtatttcatccctttatggttttgtgtctaaatcttgtaaatgcttcaacattaggaactgtgcagaactcctgcttgacctcatgagaggagagttgtttgttaccccaagaaatagtcatcatccacttctcaaatgagagtcaaggaaaagtattagtcattattaccgcctcttatgaaaagagcataacaagaactgtggtaatggaagagggtgggctttgagtttagtcacaggagttacaggagtctttttttttaaactttaagaaacttattccatgtagtatgtccatataaggagtcttatgttttacagtaaaagaagatcctggatctgtatcaaaccttactcacctttacagcacccgtatgaagtaaactgggcctaatccttacagttaacccaaccctgtgatttatttagtaatactaatttaggatcatacatacagtcaagagcttctgtgagaggaaaattcatttatctaagttacgaacacatgaatattgaagtattttagagttctaagacaaataacttacatatttgaacccaaatacttcaatatgtaaatattggtataactcttgctgtgtgtttaagacattataataatataaatatattaacatttctccaaaagtgccttgcataaacccagattccaaattgttcacgttagggcaatagttttcaaactttttgactatggcccataataagaaatacatgttcttatcaccacttattgtattacacacctgaaactaaacaatacttattatccttaacatattcagtgtactctgatcctaaactgatcacatgacttagtggatctctggcttttgaaaaatacagcattataggatttctattattcataaatcatttggaaggcagtcttttgtattagagaaaaataattcttgatgtacattctttttaaaagagaacttgaattctgacacaaagcatctttaagtgatagttcaaatagtttaatttctgattttagtatctatagttatttttactatatatataataggcatagcttgtctcacaagtttaattaaaacatttggtttattcaacttttaaaagtcattaggcaattaaaaattttaatggatatgtcagaaattctcagtgattatgtttgctttgctgagtataaaagaagtttttcttacataataaatatatacttgctaactgatgttttaaagtttccataatgtataccatgccagcctgtgctttctcactaagcagtgtttttactgagccctgtgaactccagagatacctgcaaaagtattgttggaagagtcaaaggcagggaatggtttaatatttaatccagtcattttctcatttgggaaaaaagtgaaaggtttttcaaaagctaaaaccccagaaataagcagaagtatttgccctatagctctgtcggtcagctctgttaaccaaccctttttaaacatagatactctttaggatagccaaagttatcaaccatccacctcttatactttccattctgtgcgtcttttgagtatctcaatggatagtgcttgccacatattattaaatgaataataatatgaatgacccaatcaatactgtaatatcaatgacatttgggaaatgggagtgtatgaatccatttgcactaccataaaggaatgcccaagactgggtaatttataaagaaaagaggtttaattggctcatggttctgcagggtgtacaggaagtgtggtgcctgcatctgcttctggtgagggactcaggaagcttacaatcatggcagaaggtgaagagggagcaggcgtgtcacatggtgagacagggagcgagagagagagacaaaggggaagtcacagactcttaaccagatctcatatgaactaactcacttatcaccaaggggatggtactaaccattcatgagggacctgcccccattatctaattacctcctgcctggcctcacctccaatattggaaattacgtttcaacatgagatttggaagggacaaacagccaaaccacatcagggagttttcattggacaaataaggaaaaataatatgaggacaaaagcagagcacagtatactgagggagccctggcctggtaggagagaaaagaggtaagtaaagagttgcaaagacaaccttgtctaccttgctgatttctctggtatacagggaaaataagccattgaaaacagtttgatacaagttgctgtgctaagatagcagatttgtttgagaggctgcgtagaccacctctattcagcctagtctcccccagtctatgttaaaagataaatatgcagctaatttagttcagcccaggttcatactataatttcagtggttactgccctaccccatttggaggaagaaaggataagagaaaaatatgtgtatctaagacttctcgagtttatataatgagtcagttatgcccatgtaatagctaggttgtatacatcaacacgggagtggaacatgtatgcaccagaataatgtttctcctttcagagtgagctttcttgcctgttaacaagtaatgtatttttattgattcgtgtaaatatcaagtgtttaaaattcatgtcacatacttctgaatatgacatattactaaatgctacagttactttttgtcaaaatgtttttaataaaagtgttaaataacaaatttgtgtatttttgctgactagtgatgagatgtaatagcttaaagatgaaatggaaataatttaacaagtgcaatctatttcagaattgggacagaaaggaaaatacagctctgctttattaagtttcataaattttacaggattaaagatgttttcattttttcccaataatgaaaaaaagattgttttcctcctgattgttatttatgcacaataatattaaagagaaattggcctttaacccaacactctttaatataaccatggaatttttttttgttcccttcgagtcccaatgaatgtgtttacataatttttcatacttaaaatcatagcatgaatatggttttaaagtatgcattcttatttaacatggaataaacagaatgagactttgcctcttttaaaattttagttggaaactaactaaaacccttcagtaaagagatttcttcttaaaggcttaagacctcaaggattgggagcccaaggcaggaagattgattgcagcaggaatttcaagaccagcctgcgtaacatagtgagacctccccccgacccactctctaaaaacaaaaagcaaacaaataagaacaacctcaagggaagggaataaaaaagaaaagcaggagagaggattgtacgagaatattttgggacctgggaagaaaggcaataacttacatagcaaacctttgacatctgaatcctggataagaaaccaagaactaaccagtttgcatttcacagtcttcaaaaggcttgggatttgatggcatcaagatttctagaccctctttcccctttcacaccttgtgatgactaccccttgcctatccaaggagaatgctatgcttcttgtcaggatggacgaaaaagagggtttcttgatggaggatatgacactaaattgaagtaaaaggtaccacagtaccaatccataaacagattaagtgaaatctgaatgccgagaaccacagttttattgccccatttgtctcccagaacgtagacttaaagttatttatattgagggttctctacaaaaggccagcagatgaccctatagggaatcttgcagtcaacaagactactcgtactcatagctcctaatcagtttattattattattatttttagttcctaacttcatcaatggcagacagctcaagaggtgagggcaatctctaacatggaagataaatagagaaaagcaacagtacacttttcttaaggagaacagaaaagagcttgagcattaagaataattgctaagatgaaagacaaaaattggagaaatagttgtacgagtaaaggaaaaaaaaaaggagatagaaaataaaagagaaaatataagaagatcagaccaagagtattagaaaagttaacagagaggaggaaattgccaaataagtatcacagaactgaaatacaaaatttcctacattgcaaatatctgtcaaataaatgtcctaaggaatgaaaatacacccagaccatagcgcatcaatgtgaaattttacaatgctgaggacaaagaacatcttacaagcttctagagaggatgggggaagtaaagttgaatacaaaagatcatgagtccgtggacatatgtctcaaaacaacattggcagccagaagaaaatgcaatgttgccttcaaaatttttagggaagccagatcaattaggcaaggaagaaataaagggtgtcaaagttggaaaggaaaaagtcaaattgtgcctgcaaacatgatcttatatcaagaaaaacctacagactccaccaaaaacctcttagaaccaaaaaatgaattcagtaatgttgcaggatacaaaatcaacatgcaaaaatcagtagcatttctacacactaacagtaaactagctgaaaaggagatcaagaaggcaatcctatttacaatagctataaaacatataggaataaacttaaccaaggaggtgaaagacctacaaggaaaactacaaaacactgatgagggaaactgaagagaataccagcaactagaaggacatcccatgcttatggattggaagagttaatattgttaaaacggtcatactattcaaagcaatctgcagattcaatgcaatccctgtcaaaataccaatgactttttttttgtggagatagaaaaaagtagcttaaagttttcatggaaccacatgtaaaacccaaactataaaactagtaggcaaaaacaaaagagaaatgcttcaggacattggtctaagaaatgtttatgtataagacgtcagaacacaggcaacgaaagcaaaaataaataggatcatatcaaatgaaaaagcttttgcaaagcacagaaaacaacagagtgaaaagagaggctacagaatgggagaaaatatttgcaaattattcatccaactggggatttattccagaatatccaaggaactcaaacatctcaacagcagggtctcactctgtcacacaggctagagtgcagtggccaccttagcctcccaagtagctgggactacaggcgtgcaccatcatgccccatttgtttttgtattttttgtagagacagggttttaccatgcttcccaggctggtcttgaactcctgggctcaagcagtccacctgccttagcttcccaaaatgctgggactataggcgtgaaccactgtgtctgccccagtcccatttttaaaatgggcaaattatctaaacagatacatctcaaaagaagatacaaaaatggctaaccaatgtatgataaaatgttcagtatcactaatcttcagggaaatgcaaatcgaaaccacaatgacatattatctcaccccagttaggatggctattattaaaaagacaaaagttaacaaatcctggtgaggatgtggagaaaaaagaactcacactgggagtgtcaactagcacagccactagggaggttcctcaaaaaccataaataggccagatgtggtggctcacacctgtaatcccaacactttgggaggctgaagcaggaggatcacttgatgccaggagtttgagaccagcctgggtgacatagggaaaccatctctgcaaaaaatttaaaaattagcctggcatggtggcacaggtgtatagtcccagctacctgggaagctggggtgggaggatcgcttcagcacaggatgttgagtcaggttgcagtgagccatgatcacaccactgcactccagcttgggtgacagagcaagactccatctcagtttaaaaaaaaacacaaatagaactactgtatgagccagctgtctccttactgggtatttatcaaaaggaaaggaagtcagtattgaagaaacattacacacccatgtttactgcagcactgttcacaatagatatgggatcaacctagatgcctaaatacatgaagaggtaaaatgtgatgtatatgtatatacacacacacacacaatggaatactattcagccaccgaaaagaatgaaatcctgttttcttgcaacaacatggatggaactggaagacattatgttaagtgaaataaaccaggaatagaaagttaaacactgtatgttctcacacatgtggaagcttaaagttgattttatagaagtaaaaaaaaaaaaaaaaaaacggatactagaggttgggaaaggtagcaggaagagggataatagggaaagattagatacagaagatacaaaattacagctagataggaggagtaagctttagtgttctgtaccattgtaggataactatcgttgacaataattattacatagtttcagatagctagggggaggatattgaatgtttccaacacaaagtacttgagatgatgaataagctaattaccctgatctgcttactattcattatatgtaacaccacagtgtaccccatatacaattattatttgtcaaataattacacttttttattttttgagggaaaatgacttccaacatagaatcctatactctgtcatactatcagttaagtgtgagattataataaggatattgtcacacatgaacatctcagaaaatttcttaaatactttatctctggaagccactggaagttgggttccaccaaaacaagggatttaaatgaagaaaaactacataggagctgaaaacgaaatccaacaagaatcccaagtattacagtgatgttatcgtcccatgtggcatgctttcaagaagcaaccaatccaggttgggttaggtcaaaaaactggtgggatggtgcttaggagagttcttacaggaaatgaaattgattaatatctaaagtgaatgcattaagattagaaaactgctggagtgtttggagttgcattaataacaagcacatagctaagcaaatgaggaaaacattattccaggaaaaatgaattagtgtattactgaaacacaactagtgatataaacaaaattacatataattagaaagatgatggagagtatggtgaacacaggaaagaaagaaaactagtgtttcatctttcatagtagaaatttgatcagaaatgccaaataaactagcagtacaaatatgtagtttagataatacgtaagtaaacagtatgaattagctaaaagagcttcatgtatttgtgaggaagaagaaatggaggagaggaaactggagtctgctgataatattaggctaactctttaaattcatagagttgtaataaaaataaaaccttagtaaatgaggcttcttgccaaaggcctgttgaggatccatggcacttaattgatagatataatgtccaaattatacttcatgctgtcttttcactctgttcacctgcaggttaagtacagattttgttctataattcctatattaataatggtgcataatttccttatactggcaaacagagcctgagttacatagcaacagtgatttggtttccttttattaagtgtttggaggaaaagaatgtggattggaaggaatagagtaccaatactattattttaaagaagagtaagaacatgtaactagatgaatgatgatgtctatatactttacctatgattttatgtttttgaaatccatctcacttggacaattctctgaagcagagggataaccaacaaagttccagggataaatcatctctacttactttttatttattttttttctttttgggacagagtctcactgtgtcacccagactggagtgcagtggcatgatctctgctcactgcacctctgcctctcaggtttaagtgattgttgtgcctcagcctcctgagtagctgggactataggtgtatgccatcacgcccagctaatttttgtatttttagtagagacagagttttgccatgttggccaggctggtctcaaactcctgggctcaagggatctgcccaccccagactccggaagtgttgggattgcagggatgagccaccatgcccggcctcatctctaaatgaaacctcctttttgggtggagtgtgctgacatttgctgaatgtggtctctgagggtttcagtatcttattggaaaagacaccctacccttactttttttcccccttggcatgtgaagtaagagctaaagccgtagttttttgtgacattaaagaatcatacttaaagtcttggagtggatttttgtcattttggaatagatccgttgacaatgtgcaccaaagcagtgtaataaaatgttgatcaaaactgtatttaaccatattaatgtgtgtctctcctgttaaatttgcaaatttcttacttgatagtaacacaagagatttaccagagactagcgagcagaatgtaaccctgataattcatttacatgttcatttactcataaataacttcattttggacacctgctttataccagggactattctgtgcactatgtttctggtggttgaagcagtatgtactgcccctgccctcaaggagcttatagtttagtgtgtaagatggacatttattttaaaatagtttgcaaataaactaacatataattacaagttattataattgctagtatgagaaagtaatagagtaaggtaagggattaatttaaattagaagcatcaactctaggtgggaaagagcattttcagacaatcagtattttcaaaatgtctacctcctacatacacattatacagtagctttctcacgacactgctggaggatgctgccatcaaaacaaaacaaatgaaagagaaaaggcatagataacagggtatctagtacaggaaggagagataatgataaagataacccaggaggccagctgtgctaccagagagaccagtatatattagattaggtcagaattcactgaaagaaacttgtagaaaaattaataggatacttaatgcaaccaaagacattgagaggagaattggagagaaatggaatggatttgggttggattttggaggtagattgacagaccttggtgatttattagatgtggaagttgagtgataataaatgagcagtgactcctagatttctgcctgtgcagatagacagagtgttcatatactgagttgaggaaccctggaggaggaagatttcacagtatgtcaaaagcccctttttggtattgagtttagaatgctagagagatactcaagtagaggtgtcaaatgggcagttaaatagcctgatgtccagaagagggttatgaatatttatgttgtataaatatcaacacagagatgctgtttggtgctatggaagagcattggatagcctcaggtgagaataaggactgagaaggtaaagcaaaggatgaatcctaaggaactagaatttatacaggtcttgtggaaaaggaggaacaattataggagattgctaagtgtagaggcaggtaggccaaaactagtagatttagtaatgcatgtgagttgagagagtagaggcagtgtatgtaagcaatgttatcagaaacttatttgtaaaagcaaaaatgagcttgaatggtagttgatagaggtggactagggggaggatgtttgtttttaatattgttttatgtgagaaataccaaagtatatataaatgctgatcaatggtgaggctctaggagaggttggagatgctgagaggcaggaatgaatgaaaccccaattactcatgcagaattagtcttcaatagtagatatgtcaggaccagtgtagaaaacattccactttaatgatactaaagataagtcacctttaattcatccatataaaatatgttatgagaaatttttctttgactaaaatccttaaaactatgaatttatgacttagtaattttgttgttgctgtggttactagagaacctttttttatagctcaaatataattgggtcagaacattttctctaaagccttagatatttttccttttcagggacattaaaaatggatttgattgttcccatatttgaagagtatttgtatttatcagtaatggtacaaaataactaagtattgaaagtattagaaaacagtttctggactttatttggtttaagtttttcttttttattttacagagtcaagtaaagaacagtttgccagtacaaacattgctgaagagctagtaaaactcttcaagaaacaaatagaacatgataagagagaaatgatttttgaagttcttgctccattggcagaaaatggtgagaaacttaaatgcacctttggatttttgatcatgtatgctttaaacttttttcctaatattatttaattgccagccatttgactcaaaaccattctttattagtgatatgttttattttgcatatctctaactttagctatgttatctactccatagctatatctacattggccaaagcaactttccaggttcctttgattttaaaatcttagaaaagatacttctgtagctaacacattcttgtgccattctggaaaaggcagctgagaggctgagctctacttctacacacttgtaaggcaaaggggataaaagttggagtctcaggcctgccaacagtgaagatactggttaatcactcccttctttgggcagaaaaatcttaagagatgcatcgtagaaataagaatgaatcagaagaaacaaactattccatattagtaatttttcaaatataatgtctaacacgtactcaaagaggatcagatattaatacataagacaaaacacactgtaagcaagagtaggcagcaaatcttcagatactggaattattagacactgattcaaaacaggtgtgcttattgtgttcaaagaggtaaaagctagcttaaataatttagaaggaaactaaaaactatttttaaaaagtggcatagcagatttaagaatgaaataaatggaaatttctgaattgaaaaatacaaccaaaattaagaattcagtgggtggtttaatagcagatttaatagatactgttgaattaaagaaccagtgaactggaaaacgggttggaaagaaatccaatatgaactaaaaggaaagaagaacacatttacataaaagagaataagaggtcagaggaaaaaatgagacattctcatatgcattttttggagtcccaaaaggagagtagagaaggtggggaggggagtgtgcagaggcaatatttgaagaaattttggcagagaatttatcagaaattatgaaaaatgcaaagatccaagaagccctttgaacccaaaatatgataaacaaaaatccacatctagatgcctcatactgaaaatgtagaaaaccaatgaccaaaattattatcttcaaagtaacaacagtttggctgacagctaccttctcaacagcaacaatgaaagccagatgttataaatgtggtttgtcagaaggaaaatgatatagatgcaggggagaataaagaccaaaaaaaacggtagatatataggtaaatcttataaacattgaatatatcaaaaaaataacttattgtgaagtttacaatgtacatttatgtgatttaaaatataccacaaactgagcttataaataagaagaaaggtaaaaggagttagagtcctaagacacttgtgttatctggaagactctggttatttagtcacttttaacttttaaggtgactactaaagtaattttttaaaatgatatatagctgcagaacaaatggaagcgacttatggaaaggttttttaataccctagtaatgcaaaacaagaaaaaagaggaaagaaaaaggaacacgaatcatagaggacaaatgaagcataaaaatacagttttaagacacagtatttcagtaattacgttaaatgtggcctaaatgctctaattaaaagaccatttgtcacttgtgttttaaaataaataactatactacttaagcaatacttattaaatatgagatttaaaagattgagaataatagggtagaaaaaatataccagtgaaacctaaggaaggctggggtagttatattaatatcaagtaaaatagattttaagatgaaaagacttgctagagataaagagggtgactttagtaataaaaggtccaatttacctagaaaaaaaataaccgttatacattatcccaaaacatacggagcaaaaacattcagaactatgaagagaaacagacaaatccacaaatattgtgagaaattttaatacctctttcaataatttatagaataagatagaagaataaggttatagaaaatttgaaaatgattaagacaattgatttaatggacctattttagaacacttcaactacagagctctttcaagtacatatgaaacatttaagaacatgtatacttgtcatgaaagaaagaaatttcaaaagattgctatcatacaaagtatttctttgacctaagtgagttgtctagtaaccaattataaaaagaaaaccaggaaatcgctgtatgtttacatggtaagaaatatacttccagtacctcagaggtcaaaaaagaattgtaatggaaattagaaatttttctagtagtgaaaatgaaaatgctatatctcagatcttacgtgttacaagtaaagacctattcagagggaaattttttgctctaaatgcttatattagaaaaggaaaagaactaaaatcaatgagcccagtattcatctcaggaatttaggggaaagaaaatataaacccaaaaaaccacaaggtaatttttcaaccctcaccttccaatttgtgtgaatatgctcatagtagtctctgataatcttttgtatttctgtggtagcagctataatgtcacctttattgtttctgattgtacttatttgaatcttctctctttttttttgttaatctagctagtggtctattaattttgttaatctgcacttgtactccctaaatctacaaaaaaaaattttttaagtagttaactggaataaaatacaacaatgttaacaaaatccaagagtaatatatattcttttaaaaagcagaagaaaagatagggtatcaacctaagtgtccatcagtggatgagtggataaagaaaatggggtgtgtatacacacacacacacacacacacaacatggaatactactcagctataaaaaagaatgaaataatgtcttttgcagcaacttaaatggaactagagggcattaattctaagtgaagtaaccaaatgccacctattctcacaagtggcagctacgctatgtgtacacaaaggcatagagagtggatagaatggactttggagacagagggaggtagtgagatgagggggtgaggggtaaaaaactacttattaggtacagtgtacactattcagatgacagatgacctaaaatcctagactttgccactatacaattcatccatgtaaccaaaaaccacttgtaccactaaagctattgaaattttaaaaaaaataataataagcagaaggaaggaaatgtaaagagctgaaataaaatggaaaacatacagtgcaacacaaacatataattactacagttgagtctgaaaagacagtggaattggtaaacccgtagtgagattaatgatgaaaagagagagaaagcataattaaccaaaattaagaatgcaagaggaggagaccttaccgcaggtcttacagctattaagaggatattatgaacaatttgatgcccatatattttatatatatatatatttttttttttccctcccccgcaagatggagtctcactctgtcacccaggctggagtgcagtggcaccatctcggctcactgcagcctccacctgggatgcagcctccatctccgaggttcaagcaattctcctgcctcggcttctcaagtaggtgggattacaggcgcctcctaccacgcctggctaatttttttatttttatttttagtagacacggggtttcaccatgttgcccaggctgatctcaaactcctgacctcaggtgatccacctgccttggcctcccaaaatactgggattacaggcatgagccaccgtgcctggcctgatgccaatatattttaaagtatgactgatacaagaatagaaaagctgagtaatcttaccttaagaattcttccagagaataggaaaaggaaatatacttaccaatttattttaatgaggctaatgaaacctttataccaaatcccaacaaagacaatacatgaatgaaaattaaaggctagtctcaccatgaacatagatccaaaattcctcctaaaattttagcaaatttactctagtaatatattaaaaaaattaatcacaccaaattgcatttattctgaaagtgtaacacaatttaatatttgaaatgcaactagtataattcatcaccttaaaatatttaaggggagaaaccatgatcttctcagattttaaaaaaagcttttcataaaattaagtgttcattcattatttttaaaaacttaggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaatacgttggatagcccttttagctggaactgccaccttccagtaatttaacaaaataatgaacacaaagggaaagagaagcatctgatatgtattctgtaggccttttagaaaatacggagttgttcctttagccacatacattcaaatctacaggaaaggtgatattgtagacatcagaggaatgcatcctgttcaaaaagggaatgccccacaaattttaccatggaaaaccaagagtctatggtgttacccggcatggtactagtgttgttgtaaacaaacaagggcaagattgttgccaaaataattaatgtgtataatgagcatattaagcactcaagagccaagatacctccccgaaacacatgaaggaaagataggaaaagaaaaagaagggagccaaagagaaatgtacctgagttcaactgaagcaacagtctgttccacctagagaagcgcactttgtgagaacaaacggaaggggcctgagctgctggaacctcttccctatgaattcatggcataataggtgttttcaagataaaaggcttctagactattaaaaagtatataaaaaattaattccagatagattgacctaaatgtgaaagttaaaacttcagagggtttatcttaaaatgtaagctaggagaatatcatcatggccttgaaatacttttcttagatcacaaaaagctctaatcataaaggaaaaaattgagacattggttactttaaaagtaaaacttctggctagcctggtggctcatgactgcaatcctaatggctttgggagggcaagacgaggatcacttgagaccaggagttcgagaccagcctgagcaacatagtgaggcctcatctctaccaaaaacaaataaataaaagttaaaactctttttttaaagacaccgttaagagtgaaaagcaagactggatgagagaatataattataacatataactgacagagggcttgtgtatacagtgtataaaaactcttaaaaatcattaagaaaaatgtgaaaaacattttaataagcacttgacaaaagatttatattaagtccaacagacttaatatagatatgaaaatgttcactcttaggtaacacaaaataaaaccacaataaaataccactatacacccactggaaagtctcataaaccaactgttgatgagggtgtggaacagtgggagtgtaaattggtacaattgggaagtagtatctattgaagttgaagcaatagatccaacaattctgctcttagaaatatacccagaagcttgtgcacatgtataccaggaactgttacaggaatgttcaaagcagcattatttataatgaaaaattggaaacaaccaaaatccattaacagtagaatgaataaatcataggatattaatataatggaaaaatatagagttatgaaaaggaatgaagacagctgtaaccattactgtggatgaatctcataatgttgaaaggaaaaagccaacactgaaaaatacatattgtatgattcaatttatataaagttaaaaacaaaaagtaaaactaaactgtagtttttaggaatgattatttacttggtaaaatgatgaaagtatagaagtgattaccataataaccaggatgatttgagacaaatgaaggaaggggtttgttatcagaaacagaaatgcagagataggcttcctgagttgttggcaatgaatttcttgatctaggtgatagatacatggttatttgctttctaataatatattaaacttaacttggatattttatgcacttctctgcatttgtggttttctttcactctttaaaaaaagttttaaaatacctatatatgatgcatacatgatacatacaagtgtacattcatacatatgtgtgtaaacagtggtgataaagatacttgtccttggacagaatggttttggtaaatgtgctgggctgtctgctttggcagaatgtcttgctaatcctaattaaggtagtttaagcctcctatatatttgttttcaggtatttgatttcagtcaaattgtgagaagagattatctgtaaactttaacattgagacatttaggctgggagtgatggcttacgcctgtaattccagcactttcagaggccaaggcagaaggattgcttgagccaggagttcaagaccaacctgggcaacacagcaagaccctgtctcaaaaaaaaaaattaattaaaattttaaaactacaatattgacacatttaaaatttcttaaatgtcttaggtcctatttcttagggagaaatttgttttttatctcattggtgttttggcaaagtaaaaattttactgtgaccttcagtcaattttaggccataaaataacctataactttccttgcagtatttcaaaataacaatgtgttgatatttattactgttttcccctctgccttcacatctgttttataattgcacaatggataggatgataccattgaaggcttgtttttggactaattctttgcatgtatcatccttcattttcccagtacacgaaggagagtgatttcagcattagaagttgggatttgtatagttcaaggattttagtatttttaaggctttttcatcatagtttttaattctagtcaccacacatctctagccctagcattctgtaaccaaggaaacgccctacttttagcatggcacagtacaagtgtaccttttaaagaaatattccaggttgaatactctgtgtattctgagataatattcaaaagaagatcagtgatcctagtgattcaaaaaagccaaattttaacacattaaaattgcctgaaagtcttaagtatttatttttaaaagtctttatttttcctaaatgataagctgaagctgccattgccatatatggatgcatatacagcttagggaaaccaatgactaaaataaaatccaactgaaaaaataaagtttaaatttaaaaatttctggccaggtacagtggctcatgcctgtaatcctagcactttgggaggccaaggcaggaagattgcttgaggccatgagttcaagaccagcctaggcaacatagtgagaccctgtctctacaaaaaaagtttaaaaattagccaggcatggtggcatgcacttttagtcccagctactcaggaggctgagataggaggattgcttgagcccaggagttcaaggatgcagtgagctatgatcataccactgcgctccagcctgggcaacggagcgagacactgtctcttaaacaaaaaatctgtgttgcaaatgtatttttcaggtgagttgactagcatttatcttaaggagtatcaactacactcaaagcatttagataggccagtttaggttaagatacaaagatgagtaaggtgtatctattgggggaaccagcccccaatatttcaatgtatgttctattttccctaaatgtcggcccatctgagaaatagagaaagagtacaaaaagaggaattctacagctgggcctccaggggtgacatcacatatcggtaggtccgtgatgtcccctgagccacaaaaccaggaagtttttattagggatttcaaaaggggagggagtgtacagggagtaggtcacaaagatcacgtgctttacagggcaataaagatcacaaggcaagggcaaagcaaagatcacaaggcaaagggcaaaattagaattactgatgagggtctatgtttggctgtgcacgtattatcttgataaacaccttaaacaacagaaaacagcgttcgagagcagagaaccggtctgacctcaaacttaccagggcgggatcttttccgcaccctaataagcctgagggtactgcaggagaccagggcgtatttcagtccttatctcaaccgcataagacagatactcccagagcggccatttatagacctccccccaggaatgcaattccttccccagggtattactatttttttttttattatactttaagttttagggtacatgtacacattgtgcaggttagttacatatgtatacatgtgccatgctggtgcgctgcacccactaactcgtcatctagcattaggtatatctcccaatgctatccctccccgctccccccaccccaccacagtccccagagtgtgatattccccttccagtgtccatgtgatctcatcgttcaattcccacctatgagtgagaatatgcagtgtttggtttttgttcttgcgatagtttactgagaatgatgatttccaatttcatccatgtcactacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggaatttctagttctagatccctgaggaatcgccacactgacttccacaatggtggaactagtttacagtcccaccaacagtgtaaaagtgttcctatttctccacatcctctccagcacctgttgtttcctgactttttaatgattgccattctaactggtgtgagatggtatctcatgtggttttgatttgcatttctctgatggccagtgatgatgagcattttttcatgtgttttttggctgcataaatgtcttcttttgagaagtgtgtgttcatgtccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacatttaaatctttaatccatcttgaattgatttttgtctaaggtgtaaggaagggatccagtttcagctttctacatatggctagccagttttcccagcaccatttattaagtagggaatcctttccccattgcttgtttttctcaggtttgtcaaagatcagatagttgtagatatgcggcattatttctgagggctctgttctgttccaatgatctatatctctgttttggtaccagtaccatgctgttttggttactgtagccttgtagtatagtttgaagtcaggtagtgtgatgcctccagctttgttcttttggcttaggattgacttggcgatgcgggctctttcttggttccatatgaactttaaagtagttttttccaattctgtgaagaaagtcattggtagctttatggggatggcattgaatctgtaaattaccttgggtagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaataggaattcactcatgatttggctctctgtttgtctgttgttggtgtataagaatgcttgtgatttttgtacattgattttgtattccccagggtattattaatattccttgctgagaaaagaattcagtgatatctctcctacttgcacatccgtttataggctctctgcaagaagaagaatatggctctattctgcctgaccctgcaggcagtcagacctttggttgtcttctcttgttctgtaaaatcactgttattctgtttgttttcaaggtgcactgatttcatattgttcaaacacccatgttttacaatcagacttcatatttttcaagcacacatgttctacaatcagtttgtacaatagtgatcctgaggtgatgtacattctcagcttacaaagataacaggattaagagattaaagtaaagacaggcataagaaattatgagtattatttgggaactgataaatgtccatgaaatcttcacaatttatgtttttctgccacggtgccagccagtcccaccatttggggtccctgacttcccacaacatatatctgctcaggagatagatggagacagatatggaggcaaatataagctcttcagtgaaataagtgttataatgaaagaatacttaaagatattagaagtataataaaaagtgttgatgtgggggtggagtttcctatgaagatcagttttaaaaatgtaattgggatgtaaattctgtctctaaaataccttatgttatgtttagccatcagaaaggttcaaggttatttttttcttttaacttttattatgaacattttgaaatgtattcagaaatagcatttagtaaaccaccatgtacccatcactcaagaaagctttaaatcaatgaaaacctgaagccctttttaaaaacacgactttatttatttatttatttaatttttatagacagggtctcactctgttgcccagactggagtgcagtggcacagtcatagcttactgtaaccttgaactcctggcctcaagcaatcttcctgccttggcctcccaaagcactgggattacaagtgtaagccaccatgcccagccctattttatagtattttatagcttgccctttaaacatgagcatgatatctagagtaatagtggagtgatactagttgctttcagagctgagtatcaatttgtttagatgctgcaagacatcctgaaaaatttggcaatttcaaatggaaatatgaaataaagcttttttgtatatttaaatgaactgtcaagatagtttactttgaagatttgagtttcaaaaatgtattatctaaatcatgcattttcttagttttttttttttttttttttttttttttttgagacagagtctcgctctattgcccaggctggagtgcagtgttgcaatcttggctcactgcaagttccgcctcccaggttcacgccattctcctgcctcagcctcctgagtagctgtgactacaggcgcctgccactgcacctggctaatttttttttgtattttttagtagagacggggtttcatggtgttagccaggatggtctcgatctcctgaccttgtgatccgcccatctcggcctcccaaagtgctgggattacaggcgtgagccaccgcacctggccctcttagtttcttataattctttataatggactgcttataccagagctcctattttatctcaaagtttgattattttgttcacgttgttctttagatgctattaaactacagctggttgaagcaggcctagtagagtgtctactagagattgttcagcaaaaagtggatagtgacaaagaagatgatattactgagctcaaaactggttcagatctcatggttttattacttcttggaggtgagttgtaatttatgccagccaaagaatgtggttgtcagatgtttttaaaatttattgtctcttctgtaaatactaccctagacattttctcatattcctatctcacctgctattgaggtgatgattttgacatcttaaacatgccattgatacaaccagacataatgaacctgaaaaagaagtgtcttcactatcttccagtatttgaagagctgtcacatagaagagatagctttggcaccaagggactaaagaaaagctagatggctccctgggacttggactagaaaaaatgctagactctattgtctagtatctattaaatgtttattataaaaagaatcattacttttcccattatgaatgtaacagtttgtgaggtgtgagtttccagttggatattcacctaagaatgtgaatttgttactcctagttatttttctcttgcttaactattcgtttcatttacctccagatgaatccatgcagaagttatttgaaggaggaaaaggtagtgtatttcaaagggtactctcttggatcccatcaaataaccaccagctacagcttgctggagcattggcaattgcaaattttgccagaaatggtaagcatattagttcctcctttgttagtcaaatactctatatttgtttatttttgctttgctaccacatatactaaaactggaacagtttagaagttgtgtaatatgtgtatatgctgctaacttaatttttcagaaatctgaaatacttagtgacattcctaacaaattacatattttatgcaattcaactaaattctaatagtttaaatatcatgaagtgcttcttttgaatacttggcacttcagagcttagtaagtttgaatcccattctagtatacatctgctttcttttgcctagtgattttattttggatctaattatctgagtattcattctaggattattgtgcctcaacttatatacttttatgcccataaaacttaagtatgaataatcccctggcatcgtgtagaatgtttaatttagtttaataatgtttcagggggcgccagacttctatgtttatgaaatctggcactaccaaaaaactcaaatacagtctagaaactcattcttacgttcctcatgaaatataccgtgtctaggaaatacagtttatttttctttttagtttaatcatcttccagtacaaactgttggtatatattatatcataatggcttacttgctccatttttactccttctttttgggagtgacttcctaattatggaggtaagagtggcataatatggataattattgaaactagatatggggtaaatagtggttcattataatattctctccgctttgtaagtgtttgaaaaataatttaggtatcagccatgatagcaaaaggtagagtactatcactgtaacattgggagaacacaagcatacatcacaataaatgaaaaatattggacattctaaccatgtgtttctacttctgatatattatctggctctaaactaaagatttttctggtaattttctgattttaaaacttttatctagtttaagaattttttttaacacttctcactcagtaaacagaaaaacctataaatctgatgggagaaagatttggaattcattttattgtatagctccattttccctaatgtagataatagccagacatcagtattataaagtatttatagatattttaaagaggaagaaaaagatgtgtgttttttttttcagatgcaaattgtattcatatggtagacaatgggattgtagaaaaacttatggatttactggacagacatgtagaagatggaaatgtaacagtacagcatgcagcactaagtgccctcagaaacctggccattccaggtaagacttaagaatagaaggcagctgtgtacaaaataaaatccatcatttggggaagctattaactgtatgtgatttgtgaacctgctctgatgaagaaaatttaaaaaaaaatagtcttcacattgttcacattttttcatgctaataaatggagatcatatgttaaataagttttgtgagactgtacaagaataatctttgccttcattcagatatcctgttaccttttgcgaactgttagattttcatcatgttttatagttaagcttttttaagtttgagatggggtctcactctgtcagccaggctagagtgcagtgacgcagtcctggctcaccacagcctctaccttctgagctcaagttatcctcccacctcagcctcctgaggaacagggactacaggcatgtgccaccatgcccagctgattttttttttttgtagaaacaggatctcactatgttgcctaggctggtcttgaactcctgggctcaagcagtccacccacctttgcctcctaaagtgctgggattacaggtgagagctactgcaccaggccttaggcatctttagttgaggtagaataatgacatcaattaacagagtccactcaagaatgactttcagttgttgtttttctataagcagatgtacaatttttttaaaatagccttaatgtgcctttggaagtcatgaaatcactgtattatggaaaatacaacaaaagatagttaaaactattcttttatcctactttctaaaaataaatttctgattagatgaaatagtacaattacatgatgatccaatccatttgaattcatttggtttacataggatagtaacatttattaatgtctataacatttatattaacacagttggatcaaaaacggaattgtgctttttgttgtaagagggtaacattttcagatttcctttacaaactatgtaagtaagtgttttggattggatctaaaaagccatgatactgtcataaaaattattatattgtctgttatccgcttatacacaaataggatacggacacacacataaacaactgaattccattcttaaaattgacaaaaaagtgacaagattgtttctaaatggaaaaataaaacatggatcttaaagatacttaataaacctgtattgaattgaatgtttatcaacaggaatgctaataccattttaaccatagtctctctttttctccagttataaataaagcaaagatgttatcagctggggtcacagaggcagttttgaaatttcttaaatctgaaatgcctcctgttcagttcaaacttctgggaacattaagaatgttaatagatgcacaaggtaaaagaaatgttttccccaacttgcatttttcatatgatagtcttaatgtgcctctagttgaaaaaggacttgtttttagcttttaggattatgtaatcataaaaaatagcaaataaaagatttaaaagttggttttggaactccatttgttaatttttatgcttgttataattatttatttatacatattatttatttatttatttatttatttatttgtttatttatttatttttgagacagagtcttgttctgtcacccaggctggagtgcagtggtgcgacctcagctcaccgcaacttccgcctcctgggttcaagcaattttcctgcctcagcctcctgagtagctaggattacaggcatgctccacaactcctggctaattgttttggaatttcactagacatggggcttgttgctcaggctgctcttgaactcctggcctcaagcgatccacccacttcagcctcccaaagtgctgggattacaggtgtgagccaccatgtccagcctataattgactttaaatagaaattataccatatctctccttattagtacttatagtcctggttttaggttgctttattcatcagtttcggcagggggtgttgtgttttggcattctatacccatttttaccttggctttgaaatcaaatttcattattgtgacagtcaaaaattttttaaatttgtcttccagacagggagagcatttttctgtttgcagaaacagcagtcagaaccactcctaggaatgaattatgtttatttacttatttctaaattttaaacccttttctatattgattgcatagagtctttctaagaaccctgcattatagtccgccagagcactaacagactagcaggcttaaccaaaagagtatgaagtcatttgttgttgtattttctataaaatttcacagtgttacagaagaaggcaaatagcccatcacataaggaatatttgcagttctagctttaatgaaattgtcgtgctgtgtttttttagacgtccttcacactctcaaatctgtacgaattatttcaactgattgtctgttagtgattcattccttggtttgccttctttcctatagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagtaagttccagaggaaactgttcactagaaaacttcagagtgtctttttcagaaacccagcattgtaggtcctaacaactgggataatatttacctgaaagtattgtgaagattcagtgagatcatgtatataatgtgcttagctgatacatgggatataggaaacactcggtaaatgggggttgctgttgttgctgctgctattgttgttattacttttaccaccaccgttatcagcatcagtgtcaaacattctttgtgccaggcattgaccatgcagcctactgatatttagaaattaaatggtacctagatagtatatgatgtccagagctcacagagttagaaaaaaatccattcttgtggctggctgtgccgctgtctggcacatggtagataaccaataaatgaacaaatgagctattttaaagatcacaatagtgagtacccaggccagcagttcagcagctgatttagtatctagattatatgatttttaaattttttaaatactgttttcttgttgggcgtggtggctgacacctgtaatcccagcactttgggagactgaggtgggcagatcatgaggtcaggagatcaagaccatcctggataacatagtgaaaccccgggtctactaaaaatacaaaaaaaaattagctgggcgtggtggcgggcacctgtagtcccagctactcgggaggctgaggcaggagaatggcgtgaacccgggaggcggagcttgcagagagccgagattgcaccactgcactccagcctgggtgacagagcaagactccgtctcaaaataaaataaaatactgttttctttttcttttttgagactgagtcttgctctctcgctcaggctggagtacagtggcacaatctcagctcattgcaacctccacctcctgggttcaagcaattctcctgcctcagcctccagagtagctgggattacaggcaggcgccaccacactcggctaatttttgtatttttagtagagatggggtttcaccatgttggccaggctggcctcaaactcctgacctcatgatcctcccaccttggcctcccaaagtgctgggattacaggcatgagccaccatgcccagcctttaatactgttttctaaggtgaccctttcagtcatttctcttgtacaacttcagtagtgattatatatgaggagaaagtttagaactcaaatccaccagctgttttcatttatttttagaacagataagaagaagatgccaagagaaaaaacgtaaaactaaagctgttcttgtataaatctctttcatataaataattggcttcaccataatagctgtcccagctggtaagcctcaggagtgttcttctccatcagatgctaaatcttgagaactttccctggggaaaagcagctgttaactaggaccttcctattacctgtctcacccagaccaccctaaaagctcatacatttttcctgacacaggaccaagcagtatgttggcaaggtggaagttgtcaggagagaatagcaaaatggcttccttggtacccctttgaccccttctccatcataactgctctctcacgcccatttgttcatttaacagttaatatttgagttcttgcagtgtaaatactaaaaaatagtgtttctataaaggaattaactatccgttgaggggacagaaataaaaacagctagcttaagtacagctttaaagctacgtatgctattcgggtgtaacagaggaaagaaagactaacacactgtctgggtaatctgggatggtgccatagaaggagtgctattttaggcgttaactaggaatctcaggaggaaagggaaagagaatgaaggaaagggccttttcaggcaaagacagcaggatgtacaaaagcacagagatgtaaaacagcataattttttaaagaaactgcaaataaagcagtattgctagaacacagagtgtagaaagagacagtagccagagaggttgaaaactgggaattaagtgaattatataccaagttaagatatatggacttgattctgtagagaattcgggagcacttaaagggttttaagcagcaagttgccattatttgagggtttttttgttttctttattttttgtttttttgttttttcggggtttttttgagacagagtttcgctcttgttgcccgggctggaatgcaatggtgcgatctccactcactgtaacctccgcctcccgggatcaagtgattctcctgcctcagcctcctgagtagctaggatcacaggcgtgcaccaccatgcccggctaattttgtatttttagtagagacggggtttctccattttggtcaggctggtctcaaactgccgacctcaggtgatccgcctacctcggcctcccaaagtgttgggattacaagcgtgagccaccacacccagccatttagttttcatttagaaagatgtctctagggtttaatgggggtagaaaggacagttattgcaaaaatatatatgagagttgataaaggactgaattaaggttttgagttgagcaatttgaaattgctgatattcagccatttttgaaacaaatttcatatgggttattcaactagaagcagcgaggatggaaaagaagagacagacctgagaaaaatatgggtggtagaattgacagattcaacagtagaattaaaggaggaggtagttttagagctaattccaagtttggggtttaccaccagattgggttatcatgccattcaacaaaataaaacactataggaagaggtgcagctaacactccctaaacttgcccactcgcccatgctctttggagtcattacccttaatctttttgctctactccaagagaatctccaccattggtttgcaggggtatacaatcatttggatttccctgggccatattggaaaacgaattgtcttgggccacacataaaatgcactaacactaacaatagctgatgagcttaaaaaaacaaaaatcacaaaaaaaactcaaacacctgtggcatttgaagaagaagagaaatctaaaagtttagaaaaccagctgagtgcggtggctcacgcctgtaatcccagtactttgggaggccaaggtaggtggatcattgtggtcaggagttccagaccagcctggccaacatggtgaaaccccatctctactaaaaatgcaaaaattagccaggcatggtggcgtgcgcctgtaatcccagctactggggaggctgaggcaggagaattgcttgaacctgggaagcggaggttgcagtgagccaagatcgtgccactgcactccatcctgggtgacagagcaagactcccaagactctgtctccaaaaaaaaaaaaaaaacaaagaaaacttttggaaaacatatttgggagaataatcaaggaagacttctccagtcttgctagagacctagacgtccaaatacaagaagctcaaagaatacctgggaaattcattgcaaaaagatcattgcctaggcatattgtcatcaggttatctaaagttaagacaaaggaaagaatcttcagagctgtgaagcaaaagcacgaggtaacctataaaggaaaacctatcaacttaacagtggatttctcagcagaacccctacaagctagaaaggattggggccctatcttcagtctccttaaagaaagcaattatcagccaagaattctgtatccagtgaaactaagcttcataaatgaaggaaagatacagtgtgtttcagacaaacaaatactgagagaattcaccactaccaagccagcactacaagagctgccaaaaggagccctaaatcttaaatcctggaaacacatcaaaacagaacctctttaaagaataaatctcacaggacctacaaaacaaaaatacaattaaaaaaaaagtggggggtatacaggcaacagatagcatgatgaatggaatagtacctcacatctcaatactaagattgaatgtaaatggcctaaatgttccactaaaagatacagaattgcagaatagataagaattcattaactatctgctgcctttaagagacttacccaacacataaggactcacttaaggtagaggggtggaaaaagacattctatgtaaatggataccaaaagtcagcaggaatagctatcttgtatcaggcaaaacaaactttaaagaaacagcagttcaaaaagacagagggacattatataatgataaaaggccttgtccaacaggaaaatatcacaatcctgaatatatatgcaccaaacactggagcttccaaatttataaaacaattgccaatagacctaagaaacaagatagacagtaacacaatagtgggagacttcaatactccactgacagcattaaagaggttatcaagacagaaagtcaacaaagaaacaatggatttaaactataccctagaacaaatggacttaacagatatttacagaacattctacccaaaactgcaaaatatacattctattcattagcaaatggaacttttctccaagatagaccatataatagaccacaaaacaagcctcaataaattttaagaaaattgaaattatggcaagtactctctcaaaccacagtggaataaaactggaaatcaactccaaaaggaaccttcaaagccatgcaaatacatggaaattaaataacctgctcctgaatgatcactgggtcaataacaaaatcaagatgggaatttaaaaattctttgaactgaacaataaatgatacaacctatcaatacctctgggatacaacaaaggcgttgctaagaggaaagtttatagcctgaaataggcatttcaaaaagtctgaaagagcacaaagagacaatctaaggtcacatttcaaggaactagagaaacaagaacaaaccaaacccatacccagcagaagaaaggaaataaccaagatcagagcagaactaaatgaaattgaaacaaaaaagacaatacaaaagataaatgaaacaaaaagctgattatttgagaagatgaataagattgatagaccataaccaagaaaagaagagagaaaattcaaataagctcacttagaaaagaaatgggaaatactacaactgacaccacagaaatacaaaaggtcattcacagctactatgaacacctttacatgcaaaaactagaaaacctagaggagatggataaattcctggaaaaatacaaccttgctagcttaaatcaggaagaattatttagataccctgaacagaccaataacaagcaaccagattgaaatggtaatttaaaaattaccaacaaaaaaaagtccaggaccagacagattcacagctgaattccaccagacattcaaagaataattggtaccaatcctattgacactattccaaaagatagagaaagagggaatcctccccaaatcattctgtgaagccaatatcaccctaataccaaaaccaggaaaggacataacaaaaaaagaaaactacagaccaaaatccctgatgaacatagatacaaaaatccttaacaaaatactagctaaccaaatccaacaacatatcaagaagataactcaccatgatcaaatgggtttcataccagggatgcagggatggtttaacatacccaagtcaataaatgtgacacaccacataaacagaattaaaacaaaaatcacatgatcatctcaatagatgcagaaaaagcattccacaaagtccagcatctctttataattaaaactcagcaaaattaacataccagtgacatacctcaatataataaaagccgtctatgagaaactcatatccaacataatactgaatgggaaaaagttgaaagcattccctctgagaactggaacaagataaggatgcccactctcaccacttctgttcaacaggactggaagtcctagccagagcaatcagacaagagaaagaaataaaggtcatccacatcggtaaagaggaagttaaactgttgctatttgctgatgatatgactgtatacctagaaaaccctaaagactcctccaaaaagctcctagaactgataaaagaattcagcaaagtttccagatacaaaattaatgtacacaaattagctctcctatcaccaagagcaactaagctgagaatccaatcaagaactcaacccttttacaatagctgcaaaaaataaaataaaataaaatacttaggaatattcctaaccatggagatgtagttttacaaggaaaactacaaaacactgctaaagaaaatcatagatgacacaaatgaaaacacatccaatgctcaccgatgggtagaatcaatattgtgaaaatgaccatactgccaaaagcaatctacaaattcgatgtaggtcccattaaaataccaccatcattcttcacagaactagaaaaaacaattctaaaattcatatggaaccaagaaagagcctgcatagccaaggcaagactaaacaaaacaaatctggaggcatcacattacctgatttcaaagtatactataaggccacagtcatcaaaacaacatggtagtggtacaaaaataggcacacagaccaattgaacagaatagagaaccgagtaataaccccaaatacttacagccaactgatctttgacaaagcaaacaaaaacaaaatggggaaagggcaccatattcaacaaatggtgctgtgattattggcatggaagaataaaactgttgcctcatttccaacttaatacaaaaaaaaaatcaacttgagatggatcaaggacttaaatctaagacctgaaactaaaaattctagaagataatatcagaaaaagccccttctagatgttggcttaggcaaggatttcatgatcaagaacccaaagcaaatgcaataaaaacaaaggtaaatagctgggacttaattaaactaaagagcttttgcatggcaaaaggaacagtcggcagagtaaacagacaacccacagagtggaagaaaatcttcacaatctatacatctgacagaggactaatatccagaatctacaataaactcaaacaaactagcaagaaaaaaactaataatcccatcagaaaataggctaagcacatgaatagacagtaatgaagatatacaaatggccaacttatgaaaaaatgctcagcatcactaatgatcagggaaatgcacatcaaaaccacaatgccataacaccttacccatgcaagaatgtccataatcaaataaaaaaataatagatgttggcatggatgcagtgaatagggaatacttctacactgctggtgggaatgtaaactaatacaaccactatggaaaacagtgtggagattccttgaagaactaaaagtagatttaccatttgatccagcaatcccactactgggtatctgcccagtagaaaagaagtcattatacaaaaaatatacttgcacacatgtttatagcagcacaattcacaattggaaaaatgtggaaccaacccaatgcccatcagttaacgagtgaataaagaaactatggggccaggcatggtggctcacgcctgtaatcccaacactatgggaggacgaggcaggcagatcaccaagtcaggagatcaagaccatcctggctaacatggtgaaacctcgtctctactaaaaatacaaaaaattagccaggcatggtggcgggcgcctgtagtcccagctacgctggaggcttaggcaggaggatggcgtgaacccgggaggtggagcttgcagtgagccgagatggcaccactgcactccagcctgggtaacagtgcaagacgtgtctcaaaaaaaaaaaaaaaaagaaaagaaactatgatgtgtatatatatatatgatggaatgctactcagccataaaaaggaatgaattaatggcattcgcagcaacctggatgagattggagactattattctgactcaggggtggaaacccaaacatcatatgttcttacttataagtaggagctaagctatcaggatgcaaagacataagaatgacacaacagactttggggacttaggggtaaagggtgggaagggggtgagggataaaagactacaaatatggtgcagtgtatactgctcgggtgatgggtccaccaaaatctcacaaatcaccactaaagaacttacttatgtaaccaaacaccacctgttccccagtaacctatggaaataattttttttaatcacaaaagaatttcataatgttttaagaaagctacgaatttgtgttgggccacgttcaaaatcatcctgggctgcaggttggacacgcttggtttagagttttggcaaaccataattgtattaactaatttacagacatgatcctggcatctgaatttggaactctcagataaattcctgttacatgtagtagtaaggctcgtggaaaccttgattaatctagtatcttcagtatcaactaacagaattacataaccaaaccattcatggacacaaaaatatgtccacaggaagatacatcccagcttcttagaaacatctgaatttaggagccagaactacttaaatgctataatatttaataaatttaaagattttgaggcttttctgtgaattttgttcatagatccccctttccctcatctaacctcccacttctcgcccatccccgaaaagaagagttcaaatacccatcaccacgcaggttctttgaatgatgagaactgtggcatggtacccttttaggaaaaggtggatgggggtgtgtgtagcagaaaacaacttgaaattatataggattgtaactttatagttacatattacaactttaggattacaattcaatacctttacatatctttcctacaattgagagtatactgctgctaagcagccaaggagccttgattctcacactttaatgagcagaactataaagtgtgttaattgcatgagttctatgtcagagctgttattttctaacttaaccagtgttacagtagacatgactgcttttgagcagcagttcaagtttgtttcatcaaattataatcccaagaaatcttctacaaagaaagagttgcataggtagattagttatgcaaatagtaattatttttttctttgcctttgagattcacagcacacattaatactaaagaaacctctttaattttatttgaatccactgattgccaaactgtttgaccatggatcctttctgcaggtggcatctgttattacactggacgtactttggaaaaatgctgttctagaataagtttttaaaataattaaacaccaggttcaaatgtattacattcctgtagatccttagccagctgtgtgaatcacagctctctccttgtgttgttcttaaactttgaagatcatacctcaccctgaattccgtcttggagttcaacccttcaaaagtttgcactgactcacaaggtttcatgctgcttagtcatctcagcactttgcagtgtattcctgtgctgatgctcttaggtaaagtcacacctttctttgaaagagtgccctagtctaggactgctgaccaactagctgaatcttccaattatagacatcaaaaatgtaaagagaaatataggttgcctttataccaggaatataaaaactccctgctatcaaagccagcacttttctttaacctttaagagtagagaattctttatcagttaccaggctaaaaacttgtttaaacaaatgtatttagtcatttgctcattcatccaacaaacatttatttaaatcccgtactgaaaaggctttgatgatacaatcttgaaaaagaaaatttttgttaagtggctcaccaactcaatggctataccaaccggcaatcttataaaattacctcaaatcaaagcctatctgaaaatattccgttgtgatcaacatgatacagttttcaacagtcttaacctgggttgatttcactaatcaagggcaaattgactaaatgctaaatagatgaaattgttagcatggataatttgccttggttttatatataccaaaatttagctttctataagaatagaactatgaaataaaacatgtttcagactgcataaagcatctccagaatttttaagaacaaagacccactaatcagccaaactgcctaggttttagccttggctttaccacttatttattgtctgaacttgggcaaatgacttcatctgagcttcagttccttcatctatatgaacaggagatgatatctagctaatgagattttctgcaggataaaaatttgctaatatctataagctactcagtacaatgtccagcttatagttattgctccataaagggttgccatcaatattattctgtcacatgtgacgaatacgatgttttatctattttttaatcccatattctataaggcaaaatgatttcatagaatagctattcaataaacatttgttgaagtagttggtgagagggcaggaatttttttttttaattatactttaagttctagggtacatgtgcacaacgtgcagatttgttacataggtatacatgtgccgtgttggtgtgctgcacccattaactcatcatttacattaggtatttctcctaatgctatccctccccgctccccccatcccacgacaggccccagtgtgtgatgttccccagagggcagaaattttaaaaaggactcaggtatctgttccggaaaagtgagatgaaagtatacctggccaaagagaggacactgttcatttctgatgtacacatttccttagttcattccctactcttccttctactacactggtcttttaagtgtgattagaaacatagaggacaaaatgacagttcaaacatcttccctaaatgattgcatatgtatctgttcatctcttatggtcttctttactcaagctcttttgtgatttttataaaattttttactaagaattctgtgtctgtttcaaataaactgttgctgagtaaacagtaaattggggaggttagaaaaagctttctaaaacagattgatggggaaaaatgtattagatgccagaacacagctaccataaaaacttagttcttggactctatttagcaagtttgatcactaaacaagtttgggctcaaagcaaagatactttctaaaaatagttttctcaaaaaatttttatgaaatggaagcataaagcaaaccctttaaaaatattttagcaaatttggaaaatatttccaactacaattaattttgaagctgactcaggctttttaaaatgtccagaccttcaaattattaaaaatattgaaaatagagaaaattatttttaaaatattattgagacctcctactaaatcagatttagttcaagagttctaagacaacggaacccttggtggaatgaagaccaaaaagggtactagaaataaaggtgaacattttttttttcatctaacttttgccagatggtcttatatgttttctgtgtaataactttgtaataacaaaaacctatgagatatatacttacatcattccagtgacatggagatagtactgaggtaagagaggttcagtaatttgctcagtcagtgggatttattgaatccagagcttgatgtctcctctgtcatggagagaagacagagctctaagcaccatgagaaatgagggcagatggagaattttaagttctgctcagtctttttgcatgtaattcagttttcatatttgtaagattaaatcaaggggtaaaaagtacttaaaattttttcataaaagctttacctggaacatctgcagaacaactacctggcactatcatgaaaatttaaaagcaacttttttttttttaagaggcaggttctcactctgtcacccaggctggagtgcagtggtgtgatcatagttcactgcagccttgagctccctggctcaagcagtctcccacctcagcaccctgagtagctgggactgcagatgtgtgccaccatgactggctaatttttttattttttgtagagatggggtctcgctatgttgccaggctggtctcaagcgatcctcctgttttggcctgtcagagcactgggattaacgtcctgagccaccgtgcccagctgagaacttttttaaattccaagttttattcttgtttgtcaatcctaaggtaggtcaacatttaaggcagtgacatttttacttctttggctttggtagcttctaagccttctgttttttaatatgaactgcagtggtcttttctacttaggcaatttaagttgtcatcttttgatgaatgtatttaaagctaaaagctttttccttttcttctgtggagaaaaaaactatgattaaatcaaatgattcatacaggacactgtcgcaaaaccactcaacaatgagttgactgattttaatgcatgttccttatgtttaaaattaaagtctataattctctgatattatttattgtaggatgtaattaaaaccattgtgcagagtggtggcatcaagcatctagttaccatggcaactagtgaacatgtaataatgcagaatgaagctcttgttgctttggcattaatagcagctttagaattgggtaagtaccccagtgacaaacttattttcttctatttttatcttggatgaaaggaagtatagaagtggagttgaagtcagacagaaccttgactggaagcattttgctagtgtctgtaccgttctctgaatctatggaaaatcattctatatagattgttacagctgtcccctttggctgtgtttttggtaacatttttagggcaatgcattaaggtaagtttaacttttaaataatgtctcaagttacagccacttagagaatagagaaaacgttttcagcaggcttcacagagaaaccaaacaatatttagaatatgacagcatatgaagagtctgctactctcccagtgacccatactttctcttccatctctgctggttctctctactaccgattctttcttgctgttctccttctccatcaccgtgacttctattgccttactctaatgtcttgtcttctgtgttacccttctgtgtgttttgcattcagaactcccccaaagcagaggctaaataggctaaataatttcattagtttcagtttaacatagcttttttttttttttttttgaaacagtcttgctttgtcacccaggaggctagagtgcagtggcgcaatctcagctcactgcaacgtccgcgtcctgggttcaagcaattctcgtgcctcagcctcctgagtagctgggattacaggtgcatgccactgtgcctgactaatttttgtatgttttgtagagacagggtttcaccatgttggtcaggctggtcttgaactcctgacctcaagtgatccacccacctcagccctcccaaagcgctgggattacaggcgtgatccaccatgcccggccctaatatagcatttctgttgggcagaattcatcacgagaagctaatccgtagacatctagtttatgaatagcataagctggatggctttggagccaacccaagacagtcagccagggatggtgtaatagagtcacgtggcctgtggttaaggcctaaggctgcttaacacaaaggaggactttacacttagtagggatgtcctatccaattcaaagccatttgggtaaatactgttaactgatagcctcttaattcccactgacaacttagatccataattctcacactggggcgaatggaccctccaaccccagttccaggaagaggaaacactcatgtgagtatttttttatgtgcatagtgtgtaatgatcaagtcaaggtgtataggatatctgtctccttgaatggtctgttggtgactggaagccttaccaataacagtcagtgaacatatattttgtatatgaattatatactatattcttataataaagccagagaaaagaaaatgttaagaaaattgtagggaagagaaaatatatttactatttattaagtagaagtggattatcaagaaggtcttgaatccttgtcttcacactgagtaggctgaggaaggggaagaacagaaggggcttaggcttgctctctcagggatggcagaagagaagaaaatccaggtataattggacccacacagttcaaacttacgttgttcaagggtcaactgtatattctttggtgaaatgctgatttttgtcttttaaccattttttttttgactgttgagttttgagagttctttatatattctaaaaattttgtagttctatattttacatttaagtctgtaatccattttgagttaatatcggtataagtcacgcctgtaatcccagcactttgggaggccgaggcgggtggatcatgaggtcaggagatcgagaccatcctggctaacacagtgaaaccccgtctctactaaaaatacaaaaaattagccgggagcggtggcgggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaatatatatatatatatatatcggtataaggtacgaggtttaggttagggttcattttctttgtcccatggatgtctaattgtactagcacctttcgttgaaaagctgtctttcctccactgcactgattttgtaccattgtcaaaagtcagttgagcatatatgtgtgagtctatttctgggtcttccattcagtgcctttgacataagtgcctatgttgccaccagtaatatgctatcttgattactgtagctatagagtaagccttaatactggatggaggaattcctcacactttattcttctttatcaagatggttttagctattttagggcctgtggctttccatgtaagttttagtataagcttgtatattttctacagaaaatcttgctaggattttgattgaaattccactgagtccttatcttttatttgtggagggaattatgtgatttataggatttgctccaaaataatttgagatggatgacagcaggtgaatgagagagatcggccataattctttaaggtgataagtgcataaggtatattattataccatcttttctgattttgcatatgtttaacattttccataataaaaagtttaattgtctcatattaaaagaaatgtgttagtattaaatagtaagcttaaacacctgaagtgtctactaaaatctaattctatttactcttttcacatggtctgaatttaatattatttttctaggtcattattatttatcagttccatttagaaggtttcgtatggtcaatttcttcaaaatgaagcagtgtttatcctgaggatactgggttcgtacgcagtagatatactttgttttatttgtaggcactgctgagaaagatctagaaagtgctaaacttgtacagattttacatagactgctagcagatgagagaagtgctcctgaaatcaaatataattccatggtcctgatatgtgctcttatgggatctggtaagtattcttctatcatttgatgtccataaacatatggttcacattaaatattaaatatagagtaatagtaaatgatggttttgggttttaaagccgttagaaattagtttatggaggttataagataacttttttcccctattactgtaaacactcatttcttcatggtgatgacattgaaaatcttctcttctagctgtcttgaaatatacactacattggtattttctagccatccaactgtataatagatagaattacttttcactgaagacattcccaaaagattctcactacaatagaaagtatcatatagcaaatctagacaacattcagtattgcaaaatcagtaagtctcatgaaccctaaaatgttattttatagcaggcacaggttctgattttgtatgccataatattaactaaggaatttgtttaggaggccaggcacggtggctcatgcctgtactcccagcactttgggaggctgaggtggtggatcacttgaggccaggagttcgagaccagcctggcgaacatggtgaaaccctgtctctactaaaaacacaaaaattagccgggagtggtggcacacgcctgtagtcccagctactcagaaggctgaggcaagacaatcgcttgaacctggaaggcagaggttgtagctgagagattgtgccactgtacttccagactaggcaacagaacaagactctgtctcaaaaaaaaaaaaaaaattttttttttcaacaaatcattggtatatcttctatggacattggcatatcttggtatatgttctatggacacctgaaaagagtgtgtattatgcagttattgggtactgttgtataaatgtgaatttgattctgttggtactagtgtcaagtttcctttattcttgctggttttgcagttaattgttctgtcaattgtcgagaggaagggtgttgaagtctcccactgtagatttacctatttctcctttcagttctgtcaatttttgcttaacataattttcagctctgttgttaggtacctacacctttaggattgctgtgctttcttaagggattgacccttttatcattatatagtgtacctctctctggtatttttctttgctctcgtcaactttatctgactttaacatagctacttctgcttgtttttttattattactattttattttctttcatgtgccactacaagaagccatcctactttcttttgaataacattcacatgatcttttctcactcttttagtttcaatctgctgtatttgaagtgagtttcctgtatacagcacaaagttgtcattttctaatctactctaccagtcccttttgtgtatttagaccatttacatttaatggatgactgatatggcttaagtgtgcaatcttatttttgttttctgtttgtcacatttcttctttatttctgacttcctatgggttaaacattttttaatcatttacatttattcttccatatatatatatatatatatatcttttttttttttttttttttgagacagagtcttactctgtcacccaggctggagtgcagtggcgtgattttggcacactgcaacttcttcctccagggttcaagtgattctcatgcctcagcctcccgagtagctgggattacagatgcctgccacatcacacctggctaatttttgtatttttagtacaggcggggtttcactatgttgcccaggctgatactgaactcctgaccacccgtcagggtgatccacctgccttggcctcccaaagtgctgggattacaggtgtgagccaccacgcccagcctctcacgtatatcattcttaaatatttcttctacatatatttagaatcacgttagacagtgttacaacttttctttcaaccaccaaacatatttcagaaaactctttgaaagagaagggaagtctatcgtatttacgcacatttttagatttcttatttttgttataatcattccctttctgtttagagaacttcctttagccatactgctagcaacagatttttagccaaaaaaaatttttttcattcataatgaaagggaaatgacattgtcaaatgacagaaaatgggtataggattctgggttcacagttcttttctttctttacttgaaaactattgtgccacttttttctagcctccctggtttctgatgagaaatccattgtgttcttatgtgttttattcccctgtaggtaaggtttcatttttgtctctcaagactttctttgcgtttagtattcagaagtttaactatgatgtgtcttggcatggatttctttgggtttatcctgtttgagtttgctcagcttcttgaattgataggtttatgtcttttgctaaatttgagaagttttgactgttacttcttcaggtacttttcagccccattctatccactctttccagacctttgttgacactaatgtgagatctttaattatagtcttgtaggtccctgaggttttgttcttttttacccacagattattttctttctgttgtacagactgagtaatttctattgttttatcttggaagttctctgattatttcccttgtcccctctattctgatgttgaacctgtttttatttcagttatatattttagttaaaaatttccatttgcttcttctttatatcttttatttccttgcagagactttgagtctcttccatttgtttaagcatttttagaattgtggtaaaacatacaaaacataaaatttactgttttaaccatttttaagtatacagtttaatggcattaaggacattcacattgctgtgcaatcatcaccagcatccatctccagaaccaccttcattttcccaaactgaaactctgtactcattaaccaataactccccatttacccctccccacagcctctggcaatcaccatttattttgtgtctccatcatctgacaactctagtcaccacatatatgtggaataagaaactcctgtccttttttgtctagcttattttacttaggtctttaaggcttatctgcattgtaggcgtgtcagaatttcatttccttttaaagctgaataattttccatcatatgtatatatcacattttgtttatccattcatcaatccatggacatttgggccatttccaccttttggcttttgtgaataatgctgctgtgaacattggtatgcaaatatctctgagcctctgcttttaattatttttgatatatactcagaagtggaattactagatcatatggtcattcaatgtttaatttttttattaaatactgtttttactaattaaatactgtcatactctttttcacagtggctggaccattgtacatttcttccagcagtacacatggattatcatttctcaacatcctcaccaatatttgctgtgttttagtaatggccaaactaatgagtgtgaggtggcatcttactgtggtttttatttgcgtttccctaatgattactgatgggaatctttttatgtgtttgtgggccatttgtatatcttctttggagaaatgtctattcaagtctttgcccatttttagaattgaagggtgttgttgttgttgttgttgaattgtaagagttttgttttttttgagacggagtttcgcacttgttgcccaggctgcagtgcaatggtgcaatctcggctcaccgtaacttccacctcccaggttcaagcgattctcctgcctcagcctcctgagtagctgggattataggcatgcaccacctgtagagatggggtttctccatgttggtcaggctggtctcaaactcccgacctcaggtgatccacccaccttggcctcccaaagtgctgggataacaggcgtgagccaccacgcctggcccaagttgtaggattttgtaccagtaccccactatcttgattattgtagctttgtagtaagttttgatatcagttagtatgagaactccagctttgttcattttcaagattgttttggagatttagggtcccttgagattccatatgaattttaggatggatttttctattactactaaaaacactggttcattggtttatgtcagtcatatcaaaataaacacatcagtttcagtagtactgattacattaagcttattagacttcactcatcccatataacagttctcagagtcctaacaggaatcctatattttcttgtaattgaagttaaatagagaaagcaagtcagaaagaagaggacaaaaaatctaaaagggagtccagtgtcacagaaatttgttgaaggatatgaagtataaacttttcttttgccacaaaattaatttgaaacatatcctaagctttttggtaagtcattggacttcatatttgaactggtgatagggttgtatgtaaccaaaccttgagatcatacagtgagctgtgtttaattataactcattattgtaattaatcttacattgtagaacttgacgtctcgtttttctttttaaaaattgggcaagtagctgtgcagtggctcatgactgtcatcccagctacttgggagactgagcaggatgaatcccttgaggctaggagtttgaggctgcagtaagctgtgaccatgccactgtactcaaacctgggcagcagagcaagtccccatctttaaaattttttcctttaatttaaaaaaaagtaaagtttttatgatttttttaaattataatacatttctaagaaagacattgctaggctactgctatgtctttttccagaattgtttctagttttataagcttagtcttgtcaaaataaacattttggtatatgttttggatagacttagaacaacctaacagaatcatatctgttatttttttgtcttccagaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactcttt

SEQ ID NO: 38179 - DNA, 62035 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggtaggggggcgcctcgcggagcaaacctcggagtcttccccgtggtgccgcggtgctgggactcgcgggtcagctgccgagtgggatcctgttgctggtcttccccaggggcggcgattagggtcggggtaatgtggggtgagcacccctcgagttaggaggagggtagctgggaacggtgcagggctgagttctcgacaagctgctggtaggacagtcactcaggttgagggtagaactgagagaacctgaaactgggcgtaggaaggttccaagtgctggagccctgcaagacagaggaagttttttttttgcttttgttttgttttgttttgttttgtttgtttgtttgtttttttacctctctgtgcattctttcttccttggaagtaacagaggcaagcttgggaactgtgtgaaccaggtcagcaatctggacaggtctttaccagcgggtcttttgctgtttttcctgggtactgatttgcagacttgatccaactttctaagaaaagcagaaccacacaggcaagctcagactcttttattaaattccagttttgactttgccacttcttagtggccttgaacaagttaccgagtccctctcagcgttagttaccctattttatgatgaggataatattatctgcaaattattggtaatagtaaataatatagcatgtaaatctcctagcacagtactgggattttcgccactttatttcttcttttaccaagatactcctcattggactttaatacacaggactagtctaaggtatcaccaggtagtccactcctgctcggaattcttgaccctctttcgggatttagaagaacagggcatggaccagatgggtttaaacaaattcaatatcttccactagcttcaccttggggttgttaaaagatttttgaaccacacactgtgctcataacaatcttcatctcttaaaaggattttattcttcctggtattgccctcactctcatccctgtattccgtgctcagtggctgacacagaagagttctttattgatgtccgccccccacccactaggattctctgctctcccctccccctacaggcctccatcctcttcatcctgttcatttttcagatctcagttcaagcatctcgtcctcagtgtggtgtttcctgatccctcactctaatccaagtctttctgttttatgcacaggtggaatcttatttccgtttgcgtgcaatcatgtattttaatatgcatgtatatatgtatgtgcatttgtatgcatgcgattaagaactagaataattaataattggaaagctccatgaaagctggttggggactaattttgtaactactttattcccagatcctgtaatttctctaaataaaccctggaatcttgccttatctccttcaggttaaaagccaactgcaaggtctaatgactgcaggatctagctatccattgtttctggccgcctatgcgtgcactgggtgtctggcagagaggctgggtaaattgtagtttcattgtagctgtctgaacttggatttctcacgcctacttcactggaaacgcaaactctcacagcattttgttttagtttcagaatcagagcaaattagaagtctgaatttccttcaacacttggaaataatttatttatttgaaatatattcataattaattcgttataaaaatgtattaaatgcttatttgagtcagcagaggaagatagaaactttatgaaagtagaaggtggatctcctttttgccttcattttcagaacatctcgtttacacccattagttgaaacattaatgtcattttattttcgtcctgattatctcataaaacatttcttagaataacagcaatacctatcattgaagttggataagaaatattttgcaattggtttgcaacttaaaaatctgtttgcatgactctttttcagtgaaagtaggcaagagaaattaaaattcagaaatatctcacctaatgtcagaggtaatattgataatttgtgttttacaaataatacatacaacaataatgaaaaataagtcctatctataggctcgtatctcatgcctatttttggatgtatttttcagggtggtttataaaatcctccaatgaagctactaacattactccaaagcataatatgaaagcatttttggatgaattgaaagctgagaacatcaagaagttcttatagtaagtacatcctcgaaagtttatatggacaagttgttagaaaaatttatcattctgttttggtccaatattttatatataggaactggacttttttcttaaaattttatttattaaagatcttggatcacatttcatctgaggaggactatactttcagctaaattttgtcattacagaggtttagagcaggagtcagcaaactttttctgtacaaggaccagcctttgtaggccagctgatctgtgtcacatctagtcagctctgctattgcagcacaaaagaagtcatagaaaatacataaacagtcagttctgataaaactttccttatgggcactgaaatttggatttcatataattgatgtgtcaaaaatattatttttaaaaccaatttaaaatataaaaaccattcttagcttgtggactgtacagaaacagttagtggtccagatttggccagtggaacctagtttgctgattaatgctttagagaaagatattgcatttcagttaaaaaaatggactttgagttagaattgagtttgaattccatctttgcctattaatactttggatgaatacttaacctttctgagctctcttttccacatctgtaaaatgggaataatgatcttattatgatatggatgaagtcaaagagcatatatttagcataaatttggcatattttaaaaactagctccctacttcctgaaatagctatttccagtgtaggacgaaagagataaataagtaaatttaaaaagcaaccaaaaagaaaatacttatatagaattactatatataattgattagaatacttgtttttttttcttttcttttctttccttttttcttttgagatggagtttcgctcttgttgcccaggctggagtgcaatggcgtgatctcagctcactgtaacctccgcctcccaggtacaagcgattctcatgcctcctgagtacctgggattacaggcatgcaccaccacacccagctaattttgtatttttaatagagacagggtttctccatgttggtcaagctggtctcaaactcctgacctcaggtgatctgcccgcctcggcttcccaaagtactgggattaccggtgtgagcccccacacccagcccagaatacttgctttttttttaagcatgagatccttttgtgaatttttacaaattgagttagctcatgtgtcctaaaatacttgaagtccctctaatgattgcaggattcgctggtgaataaaggttgtaattctaaattaaaagaccattacacacacacacatgcacataggtatgcatagatgtgcacacatataatcatacaaacatatatatgtttgtattaattacaacagaattaaaagtataaatacaaattgataggatacctctcaggtctttggaagggccgttttaaatgtgagactctgaagctcgaacttctttatctttgtggaaaaccctcctctgcctgttgtgcttattccactctaataatgtatagtaggtataataaaagtggaggtctggcaaggtatggtctttactccttgacagagctgctgttccagctttcttcctttcccaatattagtggtggaagagatccaagttactccaagttatcagcagcctatccataaggtcagcagcaacttcagtccttgcctcttcagaagaaagaattcaactgggggcaaaagcagaaaaagagaccaaggcaagtttcagagcaggaatggaagtttattttaaaaggccttataacaggaaagaaaggaaggtgtgcttggaagagagccaagcaggcacatgaaggtgagagaaggccaagtgccccacttaactgtgatcgtaggacttctttacgcttgcctctttcccatgattcttctcttagggtgggctgcccagccctcctaacccttgggaaaagagcacccgcaatgtgtttagggaagtatacacaggcccatctgagtctctcttcctttttctggtggagtgtacctggaagattatactataccatttttgtctctaacacgcatgcccaggaagttgcttctccctggagtctgcattcagttaacattttggtgttaacaggtgtggaccatcaagagctggcctctccctggcactgctaaatcatttttagagaggcaatgcgatcaatgctgaactgaaccatcacctgacattctagagggtggggggagagccccctcctgacttgctcctgtctaactacttgtaacactaacttgtgacatagattgaccaacaaagaagaaaaataaatgcctttatttctctttttggaccctcagcaagattaagcagtcagcttcttgtttattctccatgtctctaaccaagctcctctaaccagaacacagggggatattcagcataaacacacaaaagaaagaaattgaaagaattccctctcattcctccaaggaccacagaatctccagaagcctcctaaactctccagattttcaatttgccatttgtccatcagagagctttcaattaaaatatacccatgggtcagagactattaaaacctctgaccttccatctggtccccctttaaaatcttttgttctgctcttaaaagcccccactgcctctgaaatatctgcctcagtagtgaatgggaagattaattaggagcagctttttttcactctgccttgatgtacagggttgtctgtgttttcccttctttgaaaacacccagttgaattcacagatctgtttaccattttgcatctctctagagggattcttccttttccacattgttttgcaagataagattgttttaaaaggtgttttagacttttggtctcagaattttactggtctgtatttgaatacataggtctgtatttgaatatataggcccaatgaaatcacatattaaactacacttcttaatctattaatcacttgagatgtgtgtcacaagtaatttgttgatactagaatatcaaattttgttaaaaagaaaaggtaagaataagaatttacacattttccagaatagcaaaaatccattcatagatctctctcagactggtttaaatatattccaagtatcgtcacattatctcaattattattatcattattattttcagacaaggtttcactctgttgccaggctggagtgcagtggcacaatcatagctcactgcagcttggagctccagcctccccagtaggtagtactacaggcacatgccaccgtgcccagctaattccaccttttactaaataccttcgtcatcttgaagtcttggaaacactgccaaattatttgtaaacaagatgaaatgtactgaaacagaaacaacagtagctcttttaaaggactgagataatgtattcgggcatagtggctcacccatgtaatcccagctctttgggaggacaaggcaggcagatgccttgagtgagactctgtctctacaaaatatttttttaacttatctgggcatggtggcatgtgtctgtagtcctatctactcaggaagctggagttccaggttttagtgagctatgattgcaccactgtattccagcctggcaacagaatgagactctgtctcttacaaaaaaaaaagagataatgtgacaatactagaaacacatttaaagcagccctacagtgatatataaacagaatttggctatttgggaaaatttgtaaattcatatttttattcttattcttgtttattttttacaaaatttgatattctggtaggttcaacaacttgtgacacacatctcaaatgattaaaatcattgagaagtgctatttaatacgcaatctaattgagcctcaagtctttgtgaagtagtgagacagtgatgttctccccatatacagatgagaaactcaagacacagctagggttacatactgagttaatgacaacacctgtattataccacgtacatgatttatgctaattaatttatttagtgtttgcaatggatctttttttctcctactaatcttttccaggatgtgttttgttcaaatgagtgagtcccaaccctgataatagcaaaatgttgtttcctagttggtagtgacaagactgttacaagaaaattcacttaatagtagcaaagccttataatgattttctcccacttttttgtgagtaggttcaagattccccatagtaattccttttgcttatagggacagaggcatagctggcacttcaggatatctgcatcctacattagttacattgcagtttgtgatctttgtaatattcaagaaaatagcgatatgttggctgtttttctgttttccctgcaggtgctcactgataagggatagagactccttagctgcctcttatgtttgtgtcctttttgttacaatattttccatattagaaattctgtgtaagatattttgcccctaaacatttaccaaacgaggattttaatactatttttataaatacaatttaaataactttaatataattattaaagtaaacaagttacaggaaattccaattttaaaaaattgagttactttaattcattgttgattcatcaaataaaaaaaattaaaatacatggtagaatgaaacttgaaactggaattatcatagtcatgttggttattagtttttttaaatcaccataaggatggaattatgttgattttataaagctacatatttaaaactagaaatttatgaagttccaaaagtttatgaactatatatatatatatatatatatcttttcatgctacataatatcttgtcatgtatttaagggcttaagttaaaaatacttaccaatgagctcttcagggaaacaagaaatttcccaggagggagaaatttaaaacaatcaaaagcaccagaatctaaatatattaaatgagaaattagtctactcctgaaaatatttctggtagccaaattttggccacataatttctttgttaaagatattcctcttcagactaattattgtcattgattttaagtgtgtcactctgtatgatagatggagtgcaagagattcattctgaacttgtatcggtatgttcagattattctttgatgaagatactttataaatggttgctaatcaaaaagtttatcacttgtctataactctcagtatttaaataaatgtaattattagtaattcttgccatgttacaccttgatcttttggataaaatatttttgtctgtttcaatattttacacagtgatataaacagataattccatgtaagttccaagaagtataggtcttaagaaagaatatgataatctaccatacgaggttatagtaataggattacacataatgatacaaaaatcagtttctccgatttttctcttgatttagtacaaattagagcataaaaatttcaaagcagactttgaaaatctatttcatgcaataatactaccactttaattttttaacgtatcacacttcaaagtacttttgtgtaactctgctttactttgttgatttggaataaaagttgattaaacattaatatctaaccactttcaatttttgttcaccagtaattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgaggtaaaaaataaataaataaataaaagaaacattccccccatttattctttttcaaataccttctatgaaataatgttctatcccatctctaaatattaatagaaatcaatattattggatcttgtgaatacctttaatatctcattatccgtgtcaactactttcctatgatgtttgagtttactgtgttttagaaagattcgagaaattaatgcttgataacagctgctgttttttagtttttagtactacacaccaatatcaaatatgatatacttgtaaacctccaagcataaaaagagatactttataaaagagattctttttttcttttttttttttccagatggagtttcactcctgtcaggcaggctggagtgcagtggtgccatctcggctcactgcaacctccacctcccatgttcaagggattctccttcctcagtctcctgagtagctgggattacaggtgtgcaccaccacacccagctaatttttgtatttttaatagagacagggtttcatcatgttggccaggctagtctcgaactcctgacctcaggtgatccacccgcctcagcctcccaaagttgtagaattacacgtgtgaggcactgcgcctggccaggagatacatttttgataggtttaatttataaagacactgcacagatttggagttgctgggaaatgcacggatccagtatgcagtttgacccagcaagtttttattggtacttaatgattatgtctcaattgatcaggttgaactctgtgcgaagaatttgtgtgtggacatttggagaggacaagtttggaggcaaggtattttagcatggtatttaaagaatttgcaatcttgtttgcaagttggggcatatacttgagaaagagaagacaatgcagataaattgatatatttattatgatgtatgttcaatatgaaagatcacaaaatataacatacattcatccttacttaacatacctcagttttagagctaccgtatgtagaagagtccatttctatttaggtaagttcctttagtccttttattactgggcactcttaattacatgtagcttgaaatatgtccagtttgatcagtgaactgaaaatgtcatgtgatttaagtacatatataattttttttcatagtaggtcaataacctccttttattgactaatgaatcagtctcttcttaatgattaatatgttgttatgttttacagtcagtgatataattccatactaaattttctaatgtgattggagcttttcatattaactactgttctcaatcatagtagttaacaatataactttaaaaaatattattaagccaggcgtggtggcatgttcccctaatctcagctacttgggaggctgagataggatgattgctggagccaggagttgcagaccagcttgaacaacatagcaagactccaccttaaaaggaaaaaaaaaaaaaagaaaaacaaactaaaaaaaccctaaaatatattatattgaaaaggcaataccactacacgtcatatagtctcagaatgtttgttaaataagtggtggcatatctatacagttaaataccgaggggtctttaaaacatgttcagaaaatttatttaaagaaataaaatattgacaatgttaaaatgtatacatatgcttaaacgtctctttgatctatcaaatttgagaattgtctaggtacaatgtggaaaagagcagacatataatatattttagtttttgtttttgttttttttgagacggagtctcgctttgtcgcccaggctggagtgcagtggcggtatctccgctcactgcaagctccgcctcccgggttcacaccattctcctgtctcagcctccctagtagctgggactacaggctcccgccacgacgcccggctaatttttttgtatttttggtggagacggggtttcacagttttagccaggatggtctcgatctgctgacctcgttatccacccgcctcggcctcccaaagtgctggttagtttttttttaagatggggtcttgctatgttgtcgtttttttcttcttttttcgttcctcctcacttcccagttttgactataccattgcttattttatttcattatttacttttgtattacaaacatgcataatgttaccaaagcctgttacataatacaaaatgaatcatgtaaaagtttcacttgggagattttcctgaatagtgttagatacctagtttcttaattttttaaatttatatcattagttcttttttatttttatccaagttatatatgtacataaccacataattttcctgagtgccttgctttttctctattttcctctttccagaggcaatcattattcaactataagttaattctttttatatttacatctatttctataaattacatgcttatatggcttttatttcagatgcaggcattatctattgacattgtgacaagtcagctccctgttcatcccttggccccaaccaccatgttctcttactacctcccatctcccagtacaatttaattgttatgaataacagttcacagctgagctatgtggtaaactatgatttcttttatacccctgcacaaaacagacaagttctccatccgtaggcaacaaatatgattagtattttgtggatcctatgagaaatatttttaatgtatacagagacattgtttcacctttgattatgcagaaataacatcccataaagatttaactatatattgacttttttatgtcacaaaatgtaaacagaaattataaactaatattgttttagttatactcagaatatataatttgaggctaccagtgcattttggaaagtaaaaaatactctaagactgaaatttaatctaactttgataaagtcaaccaaaaaggcatttccttgacattaaaaacttttcttacttgttagaatagctcataaacttgctgtaaaattcagtgtggcatagtggtgctgcaaaattgattaccataaaggcaaatcaagtgagacaagtttgaatattcccttgcctgaaagacatgcttatataatgactttgttcctttattgatttttattgcacctcagcataatttttcttttaatcttacctagtgattcagatgagttcatttctcatgtgaatcacagaaaaaaatatgggaaatttggaatatgtggggatgtggcaagtcgtagttgatttggtttcattttagcttctatccatgtcagaaaagggaaataactactgctctagtcagtacaatgtaaaatctgcccagatcccctcctcatctccaaatccctcccatttgtattactgcactgaccaagacctatacaatataatgttgaaaagaagttttgatagcagatatccttaactttcttctggtcttgaaggaaatacctttaattctttctcaccattaattatggtatttactgttttctttttctggttatcttaaagtacatcctttccacatatactaaaattttttgctgtatggatttatattaaacacatttttctttaagatgagcatgcgatttttctttcttgatctgaagatgacattcagtgtattctaatgttagaataatcttatattttttgaacttgtaatattagcattagggttttaaattcatatattgatatatattatgtttatactcatagcatgtttagtctgtgtttttgcaatctatttgttgggttataatttcaatattctacttgccttctaaaatgagttgggtttttaatattttctgaagtaggttttattgcaattaaattattttttcctttaacctttcaaactcaaggaaaaccagttggccttgactctgtttgtggaaaattttaaactactggtttaatttctttattggttgtaatatgactattttacgtcatataacaatttttattgtttgttaaatgactttattgtttgtcatatgataattttatgtcatagaacaatttttattgcttgatatatgactttattgttatatggctatacaactagatttttttgttgtttttgaccgagtcttactctgtcacccaggctggagtgtaatggcatggtctcagctcactgcaacctccgcctcccgggttcaagcaattctcccacctcagcctcccaagtagctgggactacaggcatgagccaccgcacccggctaatttttgtatttttagtagagacgtggttccactatgttggccaggctgatctcgaactcctgaccttgtaatccacccgcctcggcctgccaaagtgctgggattacaggcgtgagccattgtgcctggccgattttttaaaaaatgtattcttatgtcagttttcataagttttatttaaaatgcattttccatttgatgtaagctttcaaatttatagtatagttgttcctagtattttcttatcttttgtaatctgttcagcgtctgtagatgtgcctctttttaataaataatattatttgtttgcgcttttgctatttttttttcttattgctcttgagagggatatgtcaaatttactagtgtatccaaagaataaactttggctttggcaatcttttctcatctatctttgctttatattttattaattctgttcttgttttataattgcctcttttatcttctttgtgtttactttgctgttctttgtaaaatcctcagtagaatgcttaacttattgacattcagtctttcttcatttctattatgagtatttagagccataaatttcccctttaacttccctttccacttcaactacatctcacaaatttggattaggagtagtttaattatcattagtatctaaatattttttaatttctgtattttcttctttgatcctgcaactatttacaagtattttttaaaatcctgaatataaagattgttattgttatttgtttgatctgatctctaaattgaatatattgagatcagataatgtggtttgtaggacactaatcctttgacaattgttgaggcttcctttggaacctaatatgtgctcagtttttatagacgttctgtgtttctttgggaaaaacatgtatttgatggttgtttggtttaatattttgtatttgtacattagtttgagtttgcttattatttggctgaaatctccattatccttaatgtgctctctcattttgtctgcttcctttattaattagagataaatgttaaattatctcacctcactatagtgatgtctgttttatactatatatataaaatttataattccataaatttatgttatgtataatttggagacctattatcatatataaacagaattgttgatgaaatgacagacttatacttatgtagtagccttttttatctcgtcataatgttatttgactttgtcctaaaattttttttaattaatatttgtttggtatttctttttcagcgggtttatgtcactgcttgtcaattggtacacagctgattttatttagacatgctacgctttttaattattcttttttccattttcattttttataattctgatatacaatatttaggtcacttttaccttcctctagtgtgaattttactcttccttttttcccctaaagctttggtgtcataattcaatcaatatttctacaatatagaaaccttagaacactttcacttttgttatatattaccaatttatatgcataattttaattcagtcttgtttcataaacttgataaatatgtttattaatatgatagtaataagaatttgggaattctttaaggctaatttgaaggctgattcctcctgatcatttctcttaggccccagggagcactacaaacctggcactgctttaaaataaatattttcgcttgaggcatactatataaacagtgaatggaaatttgtagggttatgaattatctggaacccttttttcctgctttacgctaagccattactttccatggagcaagtttattttgaatttatccttaaccctgaaggatattgttgttctttttttttttttttttttttttgtcacccaggctggagtgcagtggcatgatctccactcactgcaagcttgcctgctgggttcaagtgattctcctgtctcagcctcctgagtagctgggattacaagcacgtaggcccggctaatttttgtatttttagtagagacgcggtttcaccatgttggtcaggctggtctcaaactcctgacctcgtgatccacccaccttgggctcccaaagtgctgggattacaggcgtgagccacctcacctggccaggatattgttgttcttagaccagctttatgcacagtcttctgctagattccattatgtgaaccagctttaaactaactcctgaatccttttcatggggccataggctttgatagatccatctaaggcaaagccaaatttcgtgctacctctgaggattcttgctttcattttatttttttgcttctgaatattccttactattttttttccaatttaattttaaacttaaaaaaacatatatttggttcagtgtttttcattcttttcagtgcatatgttgttcagagaatctagataaggccagttgtggattccccaatcatgtacttttttttaaagtaaatttaatatttaatttgttcctaggtaattatctaagcactattataatgattgagattaccaaacaaaggtactttttatttggtgattaaaatctttctccaaaatcgaaagctagtccttacaagttctctcaagaaattcatgaggttaatttacttctaaccttctgtgaagcaactacatatttaggcttgtgttcacactagcttagtatgtatgccacttacaaaaaataaatttctaattcttccttctatcagtacacagtttacagtatatagtattccttttggaagagtatctttttacctcctctgagcttttctttctatagtacttacttattttatgattgttgtttttcatttggttgatttttagttattggtggggtttttttagctttgtttccttgaatagatctaaccattttgaggacagaatctgtgatttattcatctcgtgaattcttcacaacttctagcatagtgctgggtatctgatactatcatcaaaatcctgaaggattcattcaccctctactgacataaaagataatattcattttttttgtgtttgattacagtaatcaaactttaactgttttattttgattataatattttgtttctctagattttcaacacatcattatttgaaccacctcctccaggatatgaaaatgtttcggatattgtaccacctttcagtgctttctctcctcaaggaatgccagaggtaaaaacacagtgcaacaaataaaaatgacaaaaagaagccttccttctcttcatatgttcagccgataattaaagggtcataaagggacttttaatgtaatccaattcatttttccacatttaagtaatgagaatgtcttagtaagaagaaggaatattgattatattttattaatggtatttttaaagatacaacttactgcaatgagatgcacaaatcccaaatgcacatttattgatttttgacaaatgccaacatctgggtgatccaaatcccatcaatgtacagcatatgaccttcacttcagaaagttcccttatggttcttcttaatcaactctacataccccagaggatatctttctttgacatttctgccaccataaattagttttgcctattctaatttttcatctttttgttcactctgtgttttcctttgttgaaaagagatccttaattttgacgttgtcaaattattttccttatgtttttgcactttgggccttctttattaatattctccttctttatgatttacagtgatataacttcatgacttatgtataccaaaaattaacaatacatttttatttaaaaatagtattaatattatcagattgaagctaaatataaaagaccagatagtatatgatagcagaaagtataatgaataaatttaatttaaaatagctaaaaaaatataaaatatactttaaaaatcttaaatgaatgtgatctattgaagaagttgaagtgtgaagtgtgaaattgaagaacactgaaatgtattgagcagtgaaaagactgtgtataaaaaaacaggttggccgggtgcggaggcaggcagatcaactgaggtcaggagttcgagatcagcctggccaacatggggaaaccccatctctattaaaaatacaaaataattagccagatgcggtgacacacaactgtagtcccagctactcaggaggctgaggcaggaggatggcgtgaacccgggaggcggagcttgcagtgagctgagattgtgccactgcactccagcctaggtgacagagcgagactccatcttagaaaaacaaaacaaaacaaaagaaaaaacagttaaaccgtttatgtttctggctgagaagacatcatattataaggagaaaattacacctagattagtttgtaggtttactgcatacccaattaaaatcttccaaataatttttggactttgacattactattaatcgtaagaaagagttataaagaccgttgtctcttatttccttcaaatagacttaaaatcttccagatcaatggctaaatacaaagagcacacatgttgtatgggtttgctgtttatgttcaaatatcagatgagtttgctgatcggtgttcctcactggatcatctgtaacccagccagtggaatgtcaattctttcaaaactatgtatgtccatatgtgtgtttaaaacgttttacaggccaggcgcagtggctaacgcctgtaatcccagcactctaggaggccgaggggggcggatcaagaggtcaggagatccagaccatcctagctaacacggtgaaaccctgtctctactaaacatgcaaaaaaattagccgggagtggtggcgggcgcctgtagtcccagctactccggaggctgaggcaggagaatggcgtgaacgcgggaggtggagcttgcagtgagccgagatcgcgcctcctgacctcaggtgatctgcctgcctccgcacccggccaacctgtttttgtatacataatcttttcactgctcaatacatttcagggttcttcaatttcacacttcacacttcagcttcttcaatagatcacattcatttaagatttttaaagtatattttatattttttagctattttaaattaaatgtatgcacttcagcctgggcgacagagctagattccgtctcaaaaaacaaaacaaaacaaaaattcacgatcagtaatctttgaatttacgtctgaatcctgtggaatatgaaatatgggactctgctttatgctatttaaaattagcaatttgcgatgttcataaaatatagtctatctagtggttctcaagctttagtgtctgtcacaataatctggatggcttgtaaaacacagattctagtttccactccctaagtttaatggggtggagcctgagagtttgtgtttgtaacaagcgtgatattgtttctgagggtccaaggaccatctttgagaatcactggttttgcctcccaattctgtctctataaataagagttagggagatggaagcttaaggaaacaaagaaaattccgggctaagagtgcaagattctatttattcacagtcatagaacaatggatggtacagtgtaagttgtacaagaaggtctttgtctaaaaacaaagctcttttctaacagtgacaacttgcatttgagaagtgctgagagggaatatctgtcacacttgttttcattttcaaagtttactctcatttttaagctaatatgtttttcagttttctctccctcacagtttgttttgtgaggattgctgatatatcaaaagacagccacatttagagacatttaaaggtacaatctcctcaaagttacttatattaagggtaaagaaagtaggatatttacactaaaaaaattattttgctgaaatcacattggttaatgactttgtagccacagttaaaatagaatgagtgtgctccagagagggttaacaatgataaatcagacatatagtgttatgattaatagtgcattaatattacattggtcttaggaagaaatacaagagctaaatgtaatccttttacagaggcaaagattcaaatgtcagtttcccaattagactttcctcattttatttaatattacacccacttaagctctagttcaccatttgtatactctatttaaatgctttttaattttttctatactacttatcaccttttaatataatgtatgctttgcttagttattaactttaatgctcattattgtattatcccatccacattacaggaaacccccaacttaagatggctacttaaaattttttgacttcatgatggtgcaatagccatactcattcaatacacttctcaacttaccatgaggttatgtctggataaacccattataaattgaaaatatcctaagtcaaaaacacactttaggtgtataattattttcaacttaggtgagtttagtaagacttaattccattgtgagtgaaggaggacctgcagtgtaagttccttcaagggcagagatttgttgtattacatagggcactgcctaacacataatagatcttcaccaatttgtcaaattaatcctagaatcagcttggaaacaattctattttaatatcttatgtatatttgtcgtgtacatgctatgaaaaatgtagtcaaaaaggaaaacaataaccaaaataaaatgataggatattggaaatcatctgggacaggggtttcaaactaggctgtgtaaagactttcgaaaggcaagcatgacatggttttaaagagatcagtttgcagatcatcaattaccctgtgcgctttttcatggtattgaaagctagcctgtcgtgaggtcctgctccctatttacaagcattttcatcttattttataaatgaaaaacatctcctacccattctaagtcaatatgaagcatatatctgtgttgtaaaaatctctggggcttcaaaaaaagagacaattagaaatattgttttcaatgttaagatagtgaatggttctaatagctatgtaacaaattcttagcaattcaaatggtttacaattgagcaaaattaaaggtaaacccaattgagtttccagctaatatcattaaaagacacttgaatgatggatcaatttgtgattttcagattataacttgaaagaagtttaaataagttagtaacaattccataacaaatctttcattcctatccaagttttctcagaacttactgtaaaaacaagaaatgtaaattgaactgttgttgctgatcccagtctcattctagcaataatttgttcacccactgaacaaatgtgttaagataacgcttcactgtcccactcattgcattcaaagatatatttctaatcaaattttatggttatgcattatatataagaattgcaatgatgttgttagacttaatttgatactgctagtaattataattataacttaatctatcttttttttttttttttgagaccaagtcttactctgtcgcccgggctggagtgcagtggtatgatcttggctcactgcaacctccacctcccgtgttcaagcaattctcatacctcagcccccgagtagctgggattacaggcggtgccaccacgcccagctgatttttgtgtttttagtagacatgggttttcactatgttggccaggctggtcttgaactcccaacctcaagtgatccacccaacccagcctcccaaagtgctgggattacaggcatgagccaccatgcctggcctataattataacttactcttgaagctgtttcttaacacaatctgtcacaaaaataaattttttaaaaaatttgacttataaagatatactgattcaaggaaatttgacagtgattaataaaagactttcaagcatacccatatttaaggtaatagattctgaattgaaatttagaatgctagttgataattgtggagtgttctcttgggatcaacatctgtgaaaagcagagctggattaggcagagggagaagtcaccctgcaatgccagctgaaggatagccttggctaagcccataaggaggtctggaatagtttctcagaattgtcctacgttagactgagatgtccaggtctctgtaccctcacatcaatcagtcactgaatgtgtggcattctagaaagggacatgaccttgagcaagggggctgtctacagctgaggcaatccttgaaggggctgacagatgaagattgtctgcagagagccttccctgcagctggagcaaaaagtccttcattgaccgtgaatctggacagctcatctggtgcccagcacaaatatattttactttagagtaaaattctgtgggggaagatggacaatatacaagttcaagaaaaaaaaagagatgacaaaattttgactgtaaagaacagcatgttcatgtattttttaaaattgatgatgttgaatagtaaataaatacagtatttaaatcatttggatcaatataaaagttgtatacaatttcttctaaaaatattaatatttatagtaagctagatattgcatgctttgcagctacttaaaggtatgataaaaaattttaaattttagatgaagggggacattgtcaaaattaatttagggaataggtgagcaaaaaaggttggaagatcactgatttaatctagcagatcattgagccaatgagaatatcgagactcaaatatgttataagatttgcacataatcacttaatgattgaaatcagacctgtgaagcaatgatgttacctgtgcatttttctttacttggtggttgttaagaaccattaagctactccctgtgaacacacactgaagagagaaaaggtctcattaagggcttcttagcctagggtatctggacaccttcaagttgcgtgcagcaatgtgtacacgtatatgcttttctgtgtgtgtgtggggggggtgcttctgtagcttcagcttcgtagccactaaatatgggacaaatacaaacaaatattactttattcatgtgcttctagcccatctaattccattctcaatttaaattcatttttcccttgaatctcttctttggagctcatgcatttctgaccttcctgtgtgctctgacctcttccctctttcaaaaatgtccaacagtccccatgcagaaaaacctccttgttttatatctgactcatattaagtcattcccgatctcaacagggcgatctagtgtatgttaactatgcacgaactgaagacttctttaaattggaacgggacatgaaaatcaattgctctgggaaaattgtaattgccagatatgggaaagttttcagaggaaataaggtaaggtaaaaattatctctttttttctctcccccaatgtaaaaagttatagtgggttttacatgtgtagaatcattttcttaaaactttatgaataccattattttcttgtattctgtgacatgcccaccttacagagaggacacatttactaggttatatcccggggttaaattcgagcattggaatttggccagtgtagatgtttagagtgaacagaacaaatttttctgtgcttacaggttatggctgtggcctacaaagaagcatgcactgggtttattattaactttcagtatctttgttttaaatattttctacaaaaatgtttactaaattaaattgtagtatgaattgttataaataatgagggaaaacaatttacacatagcaaatttaaaaattactgtcatttgatttgttaatatatttttctctttagtgggaaattaaattttaaaaaattccctttcgactgtagaacaaataggaatttggcctgtggggtctacttgcttattatatttgtaagctagtggtaggaaatagcaaatgctcactaccactaataagaacatttctaaatctgatgttctgaggatttttagagcttatagtagcaaaaagaaaagggaaattctatccgagatgtcctttgttgtaggcctaatgagaaaaggttgaagataaagttctggtactcatttaagtgtaatattgaaaattgatattaccgaatctggaacaaccaatttaaaataaggaaagaaagacactgtgttttctaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatggtgaatgatcaatccttgaatatcataggaaacttaacatttgaaagagactttattaaagaatttcctttggtacaatggactaagcatgtctttttttattctctttgcatttaagaatgaaagaattttgaactctaaagtgattggttcaggccccttacccccttattttgaaacttgggcctggtgggctttcaaattcagacttattcagctatttaaaaaacattatggtgttacacatataccataacttgcataacagtgacatagggggctgggacagaatatggggaaaaagtatataaatatttttgttgcagagtgtatgaatacttacgctaagtagtaagtggggggcggggaataaggaatataaacagacttatgtctactcaagtcaaattttgctttcaaatgagttcaggtcagatcaggttttgctgttaaataaattccccccagatttacagatttcacagtgtgggtaagggacaggagagcagaagttccataaactttttaaatggccaatttaggatatagggcccaggaaatgcatattgcttcatttctgtaagataacagagataactttcaaagagtgtttcctaaatgccagcattttacttgcattaacaaccctaaagctagggggtgttattatctcttattcacagggaggaaagtgagactagaagtcagcccaagatcacccctcctctgaatgggcagttggattcaaattcaggcagtctggctcacagagtccacatagtagtcttatgctgaaaggctcccctgtaaaacattaacaaagggagctaatttattttgaatgtgctcaactatttaatgatgtttacaaaaatctgtgatcattaagtttgtgtggtttaaagctaactaaatttttaaaacttgtataaaatactttgccaagttttctatgacatttatgtcttcatctggttttactcttaaattgtagactcctgtaaagagtatgtattttttttggctttgtaaatcttcttagaacataatacattgtcagagatttttttcttttttaaaaaatgacacatattaccctatagtaaaattatataaatctacctgaacttcatttgctccacctttttatttccaagttttaaaaaatgcagcttagcctaagctttattagttatgcaaagtcaaaataatgaaaataaaatgagattaactggaatgtttctgttgattttcttcaaatttgaatgatggtattttagggagaaattatgttatttctatggggctaatgtttattgaattatattttgtgctctatacatttttattttctttctaattttactttttattatggcataattctaacatatacaaaagtagagacagtcatcaacatgttgtcaatcttgttttatttgtttatctctccaattttattttgctattattctaaagaatttgaaaacaaatcccacacagcatatcattgtgtcattttacccataaaaacaaggatttgcagttacctaagtttcttattagattgttttaaaaacagagaaaaaaatggaaaaacaactctgatttttcttaagtctgaagaaatgataggatgtgtgtgcttattttgaggtacagtttacatgcaataaaatacatagatctcaagagttcagttcaataaattttgcaaattgcatgtgtttatgtcacttaaaatagaatataagggcctttccatcactctggaaagttcttttgtacccctttctggtcaattttctctgtgtcccctagaagcaatcactatctagtatctagcatcgtgtattcgtttgcctgggtttgaacttcaagtaagtggaatcaaacagtagatttttttttaaagccttgcttatttcagtgtagtaatttgagattttctatcatattgtatgtattagtttttttcttttgatgattgagtagcattccattgtgggattatactacggattgtttattcattcttctgttgttagaaacctagactttgtctaatatttggctaatataaatgtggctgttatgaacaattttgtacacgtcttcttgtgggcatgtgctcatctttctagagtacccaggagtggaattgctgtgccatagtgcacatttctgcttgacattgcttttcaaaagagttaccttaagtgattgtataattttagcctagattatcacaagcaatgtatgaggatttcagttgctctgcattctcgctaacatttgaattgttaatctgttttactttaacaattctagcaaatgtgaaattagaatgtatttaatgtgatttatagagaaccgtttgaatgaaactgagtttttactggaaatatggcaattttttttttcagaatatgcttataggcgtggaattgcagaggctgttggtcttccaagtattcctgttcatccaattggatactatgatgcacagaagctcctagagtaagtttgtaagaaaccatggatggctatttgggtaattttcttattgacagttttcaaatgttaggcttttatctccattttttagtacttaaattttccaacatgggtgttgcttgtaattttatcagtataaaatagaagagtggttctgttctggaatttagtatatacatgagtatctagtgtatgacagccatgaaaatgaacctttcagatgtttaacttcagggaacctaattgatcaattgctccagacattgtgctttgaaaccccactatatttttgtcaagaccatgcttcctgtaggtgttctcgggcaatgactcagtgtggcaaggatactactgcaggcctgtttctggaaggcactggactcctctgatgcaaaactttggcccagggactccttgatagcctcgcttaaatagatgctgcacccaacactcctctttcttttcctcctccctttttcctttattcaatattagacctaccttgcagtctaaggactttctcagggtttcctagctctctcctcattttccacacatgcttttccctagtaaatctcttactcatgtattcctcttactggctacgtctgggaggacccagaataacacactatgagagcaacttccattttgtttttatctctattcttcttccccttctgctttcattattgaaactttctgctttcattattgaaactttcccagatttgttctgcttaacctggcattggaactgtttcctcttccctgtgctgctttctcccattgccatgtcctttttttttttttttttttttttgagacagtgtctcactctgttgcccaggctggagtgcaatggtgcaatcttggctcactgcaacccccgcctcctgggttcaagtgattctcctgcctcagcctcctgagtagctgggattacaggtgcccaccactatgcccggctgatttttgtatttttagtagagatggggtttcaccatgctgatcaggctggtctcgaactcctgaccgcaggtgatccgccctccttggcctcccaaagtgctgagattacaggcatgaggcactgcgcccagccaccattattctttagaggtgagagaacactggcttttctaaaagtgaaattgatagagaccaaagcgtctggccaggtagtcccttttcttctttaagttcaagcctttcttactaattttattccagtatctatgaggaagcactttttgaccaagggcaaggcactcatttttagaggtgaggaggctgacgtctggggagtaggacacatctgttcaatttaagggcagattaagaaagtaccctggtctttcttccttggggctataagatttactgcattggttaagattcaggaccaggcacaacttttgatagcaccatagactatgcatttgcctaaaaatatgtataaataaagactaagtattcatgacatttaaaagataaaagtgattttagcattacttgtaatagtggaaaactgtagacaacacaaatcttcaacaatttatatgtactcgaataatacattaattactctgatagtaaatgaagtgattaaaagatattatatgtagtaccagaataattaataatatagaaaaatgcttatattattaagtgaagaaaagcaaatttcaaaactatatatatatagtattatctcagttttataaaaaattaaaacatggggctgggcgcggtggctcacacttgtaatcccagcactttgggaggccgaggcgagcagatcatgaggtcaagagatggggaccatcctcgccaacatggtcagtgaaaccccgtccgtactaaaaatacaaaaattagctgggcatgctggtgcatgcctgtagtcccagctactcaggaggctgaggcaggagaatcacttgaacccgggaggcagaggttgcagtgagccgagatcgcgccactgcattctagcctgggcgacagagtgagactccgtctcaaaaaaaaaaaaaaaaaatttaaaacatgaacctgtattatctttgtaattacaaaagagggatgcataatattatggaattagatgtgagatttatttagacgtctacgatttggtctggtttactaggtcaatatcagctgtgctctgattgtgtaatggaattatctgattgattgaaaaataacaaacacaattcatctgacattactgtgtcagcctctgtaagccattttacaaatacaatcaccgttaataacataactttcatgaaaaagtgcattttacattcaaaatttcataattaaaaatagacactatttatccacctatactttctaagccataatgaaacagtccatataagtggaatttagttttaaaaaattgtttaaaagaacatatggtttgtttatgaatttcactgtgaaaatttactctcttggcacacgtaccttgggagtgtgccaagatactcaattctgaggttctctcaagtggttagcagtttagcattgtgcactaattagaaaagacagtgttttacaaatggaatatatcatgaaataaaagtttattaataaatgtgtgagtaaatgaggagagatataaagtcatataatggccgaagaatgctgagaacttaaataaaaagttgatgaaatgtgagtgatgttaaaaacttcaatgttgacttgagtgggacagaaaggggacaccatatatactgtttcctatttttctttacatgtaccctgaacacagtgtgattatgtggttttaatttgccttctacagtaacttccaggacgataattatagtgccaacggcaacagtaatagcatgtatcctgcatggagggctaattacgctttagcacttactgttgtgctaaatgctttacacacatctcctcaattaacctataaaacaacaatatgagttagtattgtgatactcattgtaaccaatgttcagagagtaagtgagagagccggggcccaaattgatgtctgatgcaaaagacactttggtaaacactacttactctctactcaatgacgcaagcatttagtagccacctctgttgattatagtattggctcattcttatgcctctgctcgggagacctttaatggcgtctcacagcccactcactcaagaaacatttatagaatgacttttatatttcaggcactgtggtagaagtaggaattaggtaaagtcagtagtaatgtcctatcttgtattcttgattttagtaattactttttaaacttggtcagtttaactaatggtttgctgattttgttgatctttttaaagaatcacccttggtttcattgattttctctatttattttattatttctctttcaatctttgtaatttcctttcttatgctttagagtttagtttagttttctttgtccagtttcttaaggtgaaagcttagcttaatgatttgagattctttctatataggtgtttacagctatgtattttcctttaagcactgtttttgctgcatctcataaatattggtatgttgtgtcttcattttcattcatctcaaagcatttttaaattgtatttgcaagttcttctttgacccattggttatttaggagttagttgtttaatttccatatatttgtgaatttcctaaatttacttttgttattgattgctaaattccttttattgtggttggattagtaaaagaagtatatgagtaataaaatgattgtataatttcaaccttttaaatttatccaggctcgttttacagacgtgatttattatgaaaaatgctccatgtgcacttgagttacactatttttcaatttctttctcaaggaatcttagtcattttatatcccagccagaatagtcatcatgccttacacttgctctatgcttgcctgcctctgtgcctggaaggctcttcgccctcatttttccatgcccggcccttattcatctttaaaatccagatcaagtgaaaccttctttagaaagtaattcctgatctcacaagctgattcaagctttcttttgtccaaattttttagaattttacctttgctctgtgatgttctgttttatattatgattggttttatatgtattttcttctgagtgatttataaactctttggtggaaagactgagtcttgtatatatttatattttttagtgaataaaacacagtgccttaaacatagtagacaacaagtcttctccaaattgtcaaatcaaaattaatatgctacaagatacagaattataaactcaatactgtctatacattaattactggacatctaccatctaccaaatatgttcggagacattttccaacatttaatggtactttctaatatttttgtggtttgaaattttaatattcaactattaaatatttgtggaatttattttttatttataaagtgagaaaatgacctaaagagatttatttctaaagagaacctaaagagaacctaaagagaaatttcagtaacatttttcaactgaaacttctccatgtatgtgcattatttttttcattggtatattagattcttatatataactattattatgttctcttctagttatttgtctacctccttgtggggacactacaatcgtggttttatattgtgttgttttatggaaatatggactattaatttttattctgaaaaggaaatacatttacaaagttcacaattcaaaaggatttatagtaaagttttcctctcatccatttacacccccaaagcaactgatgttattagtttatagtgtattagcatagttctctgctgcagagagaggtcccggaaaaagtgtgttgctggtccactgcaaaatgcagagggttttatagatgagctggtgaagaggtagtgtctgatttatataagtcatggacaaactggttagaccaggtgtgtcatttgcatagggtgtgaatttctggtggccccaccctaatcttttattcttcaggtgagttctctgcctgagctgcgtcatagtgctcatttctctgttactgtgcatgtgataacaaaaccacggaagatagaccctctatgtgtacatgcctggcccccaggtagccttttttttcttttgtttttttttttttgagactgagttttgctctttttgcccaggctggagtgcaatgacgtgatctcgcttcaccgcaatctctacctcccaggttcaagtgattctcctgcctcagcctcccaaatagctgggattacaggcatgtgccaccatgcccggctcattttttgcctttttttttttttttttttagtagagacggggtttctccatgttggtcgggctgatctcaaactcccgacctcaggtgatccgcttgcctcgccctcccaaagtgctgggattacaggcgtgagccaccgcgcccggctccaggtagccctttactattggcacagctgccagcattctcccgcactttcagcttgctaatctatgtttgcagctcgatttttcaggctgctttttgttagaaaaaaaaaataatttattgggctgctttttgttagaagggaagctctgctgaggactctgttgcccccattatctgcttactaaatttctttctacctcctgtatcaatattttatgtataattaagtatatgtatattctttacttgccttttgcaaattttctgtttatttaatactctgctgttttggctatgtattgtgctttctaccaatgtaaaatgcctcttcatgttgcttgatgctttatacgtggcattttattgtaaatagtttaaataaattttataatacattacttgaaattctgtttaatatacaaactccttagtgaaaaagggaaaagagagaggaattatttacactttgatagagcattttaaaacgagatgttaattctaatgaattttccacgagaaagtgatcttactgattgtttccttattgcatgtgcagtagattctaggttaagttgagctattcatatttcctcaaacaggtagacagggaacaagcacccgtgtacaggcacagaagaaaacaggacatgacagagcatgctgcaccgcacagcctggagtgcatgagggtgcgtgaccgcagagaaagccttacaggacagattgaaattctccacttttgatttcataactaaacatctcagtataatatcagataatgacatttatttttccaggccattatttaagtggagctgggtttaaggtttggagtattgttaaggaacaaaatgcccgtggtaggcccaaagaagtctgtttttgccttacagctggattttcataaaaatatagttacaattaaggtcgagattattcagtttgaacactcagtctcttaagtttgtctggaaacacatttgtctctctgtagctgtttagtaaaagtatattgttttacatgcccatatcaagaataagttaatccatcatcttaatacagtaaaggcagatatgttgaagtgaaactacaagaaccccaccatttcataaacattaccatgttttctttctcagtcacctgctgaaagataaccagggaccatggcatatactgggtggtctgcctgaatctttatttctgaattttaaaaaatagcgtgaagcttttaggggcttctgaaatgaaatcctttcttttgatcctcctgtcttcttagtaggtgtgtatgaaagtactttgtaaaaaataactatataccagtgagacaaataagaatggaaaatttcagagagttagacatcaagctctttcttcagcacatgctctggaaagcacttttagatttactactagatactggtaaggcagatcaaattcttatcaataatttgaatcttaattataccatttactagttgcatgactttgggcatgttatctaagcctcctgtgccccatctgtgaagtggaggtagcaattcctcagaattatggtaaggtttaaatgacgtattatattcaaagcactttgcactcattaaagatattatgagcagatgctcaataaagtgaatccattaacattttaatgcgttacttcaaggtttttttgtggctaataatgtttttttgtgtccaatagaaaaatgggtggctcagcaccaccagatagcagctggagaggaagtctcaaagtgccctacaatgttggacctggctttactggaaacttttctacacagttaagagactattttaattttaactcttttaagggggagacttaaagaaaaaaatactatagaggatgacagaaaaagtaaaatttatgtaataccagcaggaaacaaaactgcaagttagaaccagtgtaatttttgcctgtgaacaattagaaatctttaagcaagattgaagatttaaaaattatgagtgttgctggaactcagaaaatgaataacccaaagtatggtgttttgacatgctgagcactttgaactaaaggataaaagtccttagatgcagcttcagaatcaataattctgacctcttacttcaccccacaagagcagagtgtaagtttctctctgaagttcccttatctgaagctcctgcagaaggaagacaatgactttccttcccctccctgaaattttattaaccagggaagattgaactcatgtagtgggaaggaagactgaggcatatcactttatctgcacaggctttgtcacaagctgttgactgttctctagttccattcaagttccaaagagaattatttataaactattgcctgctctttgggcccatttaactctcttgaaaaccatttaccacccctcaaaaccacctgcactcccccacttccccctcctctatgaagagggtgctagttaaactttagccatttggcctttgtttgagtctcatattttgtttggctcctgtatacactggtgtgttagtaagtttgtatgccttttctcctgttaatcagttttcagtttattttaccagacttgaaccttcaaaggcagaggggaaaattcccttaaaccttatagtgttaatctgttaaccagtttttttttttaagaatgtcttttatttttgcattagaaaagtcaagatgcacatccactctaccaatgaagtgacaagaatttacaatgtgataggtactctcagaggagcagtggaaccaggtaaaggaatcgtttgcttagcaaatattgatcaagtaactgttatgtgctggatactaccaagctctgggagtgcaaagtgaatcaaaacaaacaaacaaacaaacaaacgaagaaaatcggtggaactcacctaaaaacaaaggaaataagtatgaaataattttgtattgtggtacaggtggtgaataaaagtgaatgtttggtgctaggctgggcagatgaccaaggtgaatgataaattgtgcaggcctcaattaaaggatcaagggaagcagggtagggaaagatgtgttttcttccgagttttctgaatttttttttaccatatttttgcataaatatcttcatgataactataaacatctatataaaatatcacactcttagaaaattaagataatcttgtattaatgaatcctttcatagttttattttctaccactaaagccactgataaaatatatggacatatgatttccatagaagttcagatgatctactgattaatacattttatacatagtcttagttcatgaaggctcagtttcttatgaactattttgttctgtatttcttaccaaaacagatactattaaatgcatattaaacatattaattgcatgtttcttacaagcagccagtgatttattttagatcaagaatattgatatccttgttgtttgcatattctaaagagtactaaacaatatataagtggctactgttgaataataccgagtacctattttgtgccagttccatgataagcattggaaatggggagataaaagaagacacagacccaagacaaacaactgacagtttgtgaagggagccatatgcttaagggtgatcaatgctttatcactcctgagagctgggtaggcaaagaaattccctcttctatagaaaatacttgagctgtactttaaaaactgcatagagggagaaaatatttgagctgtaccttaaaaactgaatggagggagaaaatatttgagctgtaccttaaaaactgaatagaaagaataggaattggagaacttcctatgtggccactatgttctcttactttgaatatattagaaagtggtaagttaggtaagagaagtaatagagttacaaaaaatgtgaacaaggataaccttaaactttcttaattacttaatgtagtacttataattatagtaatacattgaaatatatatttgctttatcacatttatgctttctcagatagaagaaacacatattaaaatcagaaataacatattttcacaaatcttggggaacctagccttttttttttttctgaggcgtgagtgctttgtatttagatgctattgagtcatttgcaattttctcttttattgacctgaaatgacaaataatcttgtatctatgctttctagacagatatgtcattctgggaggtcaccgggactcatgggtgtttggtggtattgaccctcagagtggagcagctgttgttcatgaaattgtgaggagctttggaacactgaaaaaggaaggtaatacaaacaaacagcaagaaaaaaaacagcctatctgagtctcagtttagtcttctgtaaagggagtataaaaatactacctcaaccattacatgtgtttggtaaaaatactaatacaattttcagtgttggttggttaattatattgtttatttatttttgcatttatttatataacacatatattattgatatttatgtattaagtgataatctgaaataaaggaattatactgttaatggttgttcttggcaactaagaagatgaagatgggttacatcactagagaaaacacactgaaattagattataagccaaagcttcctagtcagagactgtaagcagacgttcctccgtctcttctaaccccagacctcagattacgtgtacaaagtaattaaggagatagatgctctattcagagaaatacaggtcttaggtctaatgggattctgtcaaaagtttggaatctgtgttctcacatcctgagccctggtgtgctctcacaaaaattaggtttacactcgtaacatcaccactttagtcattttagaatcttcatatgaaagccaaagtaaaatttagttcaaatgtttgctttttaaaataataattacacattgagagcaggaagttcattctctttattgaccctgcaaacaaggtgtctggggctgtaaaatgtaatctatatatttttatcaaccataaaaacaataatgtatgttgtttgcatagtatttactttttttttgagaaactttttatatgtcctatcttctttgaagtcatagcaactagggagaagacatatttacttatcttctcatgttacagataggttaaccaaggtttagagaatcaagtaatttccccaggattatgtagctagcatgtggcagcataagagaatcagggctgaaactcaaatttctcactaccagtcctcaaaaccatgatgtctctatttaaaataaaatgtaaaggcgctcagttcttttttctacacagctatcttatatttgaagaaaacaaacaatggagacctaaatttacataattcatgaagtaggtagtgtttaattttattacaaaaatgtttcatgatttttctaggaaattcctgtggtaactatacaaaacatcactgtgacaattacagaatatgccaaagaaatggaatgctgatgaataataataggaaatttgaataatactattgacaaaaacaaaagactcgagttaacagctatagtatacacattcttaagcacacatgaatatttactaagatgatgactactcgcaattttgaaagcacctactcagtgctttctaaacattattccatttaatcctcccacaatcaagtggtgtcttcatctttactctcttgttccttgtatacagatgaagaaatggaagtttagtaggtttgaataactttccctcagtcacgctgctagtgagagaaccagggtttgaaacaagatcttgccttaactccaaggtcagtgtttataacctccgagacacatcacccctctgctgaattatgtggttttcagcaacagcaaacattgctgttgctaactgagcccttgttgattaattctggcagagaatggtgtgaaatcatacggaccagctgatattgaacaattgttcatttgatgtcagaacaacaggaaagagttctaaaggattttctttcagttatatctgctttcagaataccaaatgcatctagaaatttctttctttgttctaggcagttgcagaccaccaatgacttcctatgcatagcgaatcattataaacctattagaatgttttatgatcttgcaagatttttactgtcacatgtccccccttttctatgtaattgtgctattttgtattgacaactttaaaatcttacaaaaaaagttacgtaagtaaagattttttactacaatttgcccttcccaaaccatcaatgacttttttttttttttttccaatctgggcttggtagtgtcctgggtatattatgaattttttttctatcatttatatatacacatacattttagggtggagacctagaagaacaattttgtttgcaagctgggatgcagaagaatttggtcttcttggttctactgagtgggcagaggttagttggtaatttgctataatataaatttttataaaataaagtagccaggacttatttgccaagcacataaaaataagaagtgaatataatgagaaagtattcaaagttttttccccaaaatctgaagtaacatattcttgttcaaaaatcagcaataaaaatctctgttgctaaagaactaagttttgtttgaaccttttagagccacttaatgtcaattgtcaaaattaatttatctttatttcctgggagtatgagagtaaataagtagatatgctagaaaccaaacatcaaaacaaggagttagtttcttaatcatattgtagtttattcttcaaaatattgtcttagcaaacatgaacgacttaacagacttttcagtgaatatcttgccataaacatgtcatttaaatggagaatcttgtctgattcaaagggaattaagctatttcaaatttatgaaaaatatgaagttaaattgtctctatttcctgaccatgaagccaaattttcctgtatcatgtttgatttctatcatgattctattacgctttccaaaatatctcctaaagctaactatacagagtctcgctctgttgcccaggctggagtacagtgatgtgatttctgctcactgaagcgtcagcatcccgggttcaagcaattctcctgccctaggctcctgagtagctgggattacaggcatgtgccaccacacctggctaatttttttatgtttaatagagacagggttttgctgtgttggccaggctggcctcaaactcctgagcttaagtgatatgcctgcctcggcctcccaaagtgctaggaatacaggcgtgcgtcaccatgcctggccgtaaggtatacttttcatttatctttcttaattcataatgacctgctctatgttaaattatgctaaaagtaaggcagaaatttccaccacagaatatttactaagccatttgaaaagtaattttacctgcatgtattgttggctttatataacagaaacgttagctataaagtaaatatatgcaaagtcaatgtttattccattaatttccagtcatgctgtaaatatttactggctcctttcatactccagatattatgtgaaaccctgtggactttaattttctttgaaaaaaaaaatggtgctcctgtagacttagtcaaagttttataagaaagaattttgccactatctggaagaacctaatattttgacggtgtaatttgtgtctttcaaattatttttttcacttacagttgtatttttttcattttttatcttatagtcagaatgcttaggaaattatgtattttagagactcagaattcacattgatatctcaaaaaaactttgctacgctttgttctaaaagtgtgcaattatcaatattgaccaggagatggtaccatcctacaggagagcctgacttctggtcaggagatgatttaagttcacttatttttcgtaacatgaaatttaacttaaaatttcatacacttaaaataccttcattccatatgaatcagacaagattctctgcttaaataatgagatgtttataggaagattttcactgaaaagtctcttaggtcattcatgtttgctaagacaactttttgaaagataaactacagtatggttaagaaattaactcattttccacttaccataagtatatggacaatttcatcttaaatattagcttttaacaagttttgcttgttgtttcctacgagtaatctttattgaaattctttcaaagcagctcttttatgagaatttcttatgtcaaatttgtcgttaatatgggtcagctcaattagaaatctacatacattaaatgtagatgtgcattttgtgggggagggggagtgggttataactttatatttatagttttcctttttattataggagaattcaagactccttcaagagcgtggcgtggcttatattaatgctgactcatctatagaaggtgaatatcgttggtctcataagaaaagatgtgattaaactaggagcagcagtctagttaataaattatgcactaacaaggaaggctatgcattaatgtgtggttagggaatctactgcaacctctgacaggaagcagtgtatgaaccctagttgagagttgggtgagccctaggtgaacaggtgtttcttttcttctttcctttccttttgttttcttttctcttttcttttctttcttttcttactttttttttgctttgaagtatagagtactaattcagaaaagcagcattctttgattagcttcatctggcagatttctttttatatacagcaggaatttagtaagtatctgttgaatgattaactcagggacctaaagagttctataatttagaatggtgtagaaaaaaagtatcatttgtggggtgcggtggctcacgcctgtaatcgcagcactttgggaggctgaagcgggtggatcacttcaggtcaggatttcgaaaccagcctggccaacatggtgaaaccccatagctattacaaatgcaaaaattagccgggcgtggtggcgcactcagtatagataatatactaaatcaatcttgaattataatgtatgcaggtactttagaaagggtaggataaaaccactctgggagttcagaggaaagaataatagaaacttcaggaaaggcttgagaaagggaataggcatttgaggctgactttgaagaatggaaatatatttaataagcaaaggaccaaactaaaggaaatctcagattgattttcatgaaaatgaaagagtccattttcactacaatccagctccactaatatatctatatcttgaccatatgcaacatcccagccattgctctcctgttctctacactcagattgctcttcaacacctctttatgtgtttaatccttatccttagaccctcctttgaaatgttactttttcagggaagacatgtcttcatggcactcatcactgtcattattaagtaattatttgttttacaagtaatagactgtattctttaacaaggaacagacagtatcttgcttattcactcctagattcctaacgtcttattaaataaatatttgtggtatggttgcaaaaaaaaaaaaaaaggactaaatgaatgaagggggaattttttagaatattttctttagtgtattagtaaatttgccatgtcaacacttggaacatgagaccttgatggagtcacgttggcattttctttttctggtttttttgtgtgtgtttttttgtttctgttctttttctgttttttgtttgtttgttttttttttctgtttctgttcttcttctgtttttttgtttgtctgcttgtttgttttgagtcagggtctcactccgcagcccaggttggagtgcgtggagcgatcatggctcactagtcttgatttcccaggctcaagtgatcctccaacctcagcctccttggtagctgggactacaggcaaacgctagacatccagctaatttttgtatttttagtggagatgacatttgaccatattacccaggttggtctcaaactcctgggctcaagctgtctatccacattgttctcccaaaatgctaggattacgggtctgagccacagctcccaaccttccttttcttctttgtcaatgcctctgagctacactgttctgaaagttagtttacacagtgcatttggttattcttttctccttctcttagggtagtggctaagagcttgacctttggcgtcagatgcctggattcattcctggccctgcaacttcctatttgtgtgacccaagctacttactttctgtgcctcagttttctcacttctaaatataacttctaagagctcctatctcaaaggctcctgtaagggcaaaaaaagttacatttgcaaatctcccagacctgtgccttgcacagagtaaatgtcaaaaaaagttaactttgattagtatcattacacctacttaaaacacataaggtgaaatatatacatgtatatatatgtatattatatgcccacccagaataaatactccaaatatattttcttgaaacatagaataacgttctctttattgatagtttttttctgtttttttttgttgttgttgttgttgttattgttgttttgaaatgagatcttgtagtattgtccaggatagtttcaaactcctgagctcaactgatcctcccccgtcagcctcccaagtagctgggaaaacaggtgtgtggcaccatacttggccatagttttttaagatttgatattttaatgtattttaaaaactcattaagctttgctacttatgtcatccctggcttgaaattgctccattgtgtctctataattttcaaaatcgagaacaaaggacaggaggtactatatgattgggacaccattcatctcacttgttttatatttttacattgtattaatgtttctttctcaaataatacaaataatcatagattctgaaatttctaatgttaaaatgtaaaatgtacaaataaagcgaaactccccaatgcaaactactctcaaacttagtcctctctccaaaggtattactgtcctcagttttgggtgtttccatcatgttggcattaatatatagaatttagcttcacaaagcaccaagagcgtagtgggtgctatctcaggtgctttacacgtaaaaaaattattcagtactcacaataactctctgagataagtaagtaaatatttttattatcccttttgtataaaagaagaaactgacactcagagaggttaagtaattttcccaaggccacacagctagtgaagggttgagcttagactcaaatcagactggtctgttccaactttacccctctaaccactacactctattgtctctcaccaccttatacaggtatttggtatcatattacagctaaatgcttctacaacttgcctttttcattcagcaacacattatgaaaaactttccatatcagcacatatctcggtttcacttaaaaaacaaacactaccaccagacaacaaaaatctacaatgtattcaataggacaaattttgtatcagttttctagctgctggacagcttgcttcagtttgttgtggttaatattattttatttgcatgcttttttggtataatgtgaggagagggtagagagctacaagtatatttatttggtcttcagatgtgggcaattaaattgtaataaatgctgccaaactactccactccccaatttccactcttataagcacttctgttttaaaaattacattggctgtttgtacatatttattcttccagataaattttagaatctaaaatcaaatctttaagttccataaacaattctgttgtggtgtcactattttaaaagcctcaacttttgctgttctcaaacatggatccgaggctttgggataaaagctagttgccatcctctgagtgtttcatgtgcttttacatttctgggcattcgcacaggctatgcctttagctgcaaataccatttttccccccaactgtgtcctggttctagaaaacccagttcaagagtcccctctccaagtttgtgaatttgtcttgacttccctcccccaaaactcctcctgagtcagcagcccctccctgtgctgtgttggcttcccaagaacacctctcctgggtgcttcacttgattgtcacaaccaccagccccctcctgaggaatggggactgaaactctaagaagagcacctggttcacaaattcattgttacaacaaatattgattggttaaatgccagattctaggattgttctaaacacttggggtatggcagcaaacaagagagtgcaccttatcccaggggacttatcgtctagtgggagggccaataataaaaagacaagtacttaatatgttttatgttaaatagatgagtaatatagagaaacaagagccaaggttaaaagagagagtggctaaaattagggggtaagagagtgctattttaggtagggtgatcaggggaaatctctcagaaaaacatgacattagaccagaggaggaggagtaagtcatgcagatataatgcagaatactgttccaggctggaaggacagtgtgtgcaaagatgctgagggagtattcttgggcagaatgtaaaatgcagattttgagaggtgacctagggtttcatatatggcagtgtgggccatggtgagaatgatggactttacagagttagttgggaagccattggagagttacagttgaaatcaggttttaaaacaatcattctggtaggaatttagcagtggtctttgaagaaaataataacagaaagaaattaaattttaaaatctattcttttcttatttttcaggaaactacactctgagagttgattgtacaccgctgatgtacagcttggtacacaacctaacaaaagaggtatataattacatataatttaagaaaacccaaattctacaaatgatgttttcttgaggtattatgttaaacataggtggtgttttataacttcttgtcttcatttcatataacatatatgacatcacatcttcacagaccatcacatctagtaaactgtttacacagattgcctcatttctcaccacaccagtgtgaggtagcccattagtagcatcatgtctaccatctccattcttaaaacagtgaaactgagctcaaagaacattggccaccaaagtcacacacaacttgtacggtagccgaaccaagacttggtcctatggctcaactccttaattaaaaaacttgtttatactcttcagtatagtgataccaattaattcagaacacaggaatcattaaatgttctaactgattgagaaagaatattcataagaataccaggtgctggcttccagggacagaggctagatgagatcacaattacattttttcagatagggattataaataaaatttaaatgccattaagctttggtttcaaaagaatggaatggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatctggccaggtgtggtggctcacacctgtaatcccagcactttgggaggccgaggagggcagatcacaaggtcaggagatcgagaccatcctggcaaacacagtgaaaccccgtctctactaaaaatacaaaaaattagccagacgtggtggcgggtgcctgtagtcccagctattcgggaggctgaggcaggagaatcgcttgaacccgggaggtggaggttgcagtgagctgagatcacgtcactgcactccagcctggacaacagagagagactccgtctcaaaaaaaaagaaaaaaacattagaaagatctcaagttaacagcctagtgtcaaaactaaatatactagagaacaaaagcaaacaaaccccaaagctagcaaaagacacaaagtaaccaagaccacagctgaactgaaggtgttggagacatgaaaaacccttcaaaatattaacgaatccaggagctgattttttgaaaaaaattaataaaaaatagagtgctaactagactaataaagaagaaaagtgataagattcaaataaacaccgtcagaaatgataagggggaatattctcactgaccccacagaaatacaaacatcagagaacattataaacacctctatgcacataaactaaagaatctagaagaaatggaaattagctgggtgtggtggcaggtgcctgtaatcccagctgctcgggaggctgaagcaggagaattgcgtgaacgaggttgcagtgagcagagatcgcgcaattgcactctagctcaggtgacagtgcaagacttcatcaaaaaacaaaacaaaacaaaaacagaaaaaaaaaaagaaaaggaaaaagaaaaaaaaggataaattcctggaaacatacaccttctgaaggctgaaccagaaagaaattgaatccctgaacaggccaatcatgagttctgaaactgaggcagtaataaatagcttaccaaccaaaaaaagccaaggaccaaatggattcacagcttaattctaccagaggtacaaagaagggctggtactatttctattgaaactattgccaaataattaggaggagagactcctccctaactaattctatgaggccagcatcatcccaataccaaaatttggcagagatacaacagcaacaaaaattcaggccagtatctatgatgaacaatgatgcaaaaatcctcaataaagtactggcaaacagaatccagcagcacattagaaagcttatccaccacaatcaagtaggcttcatcccagggatgcaaggttgattcaacatatgcaaatcaataaatgcagttaatcacataggcagaactagaaacaaaaaccacatgattatctcaataaatgcagaaaaaagctttcaataacattgaatatctcttcatgttaaaaactatcaataaactaggtattgaaggagcaaacctcaaaataataagagccatatatgacaaacccacagccaacatcgtactgaatgggccaaagctacaagcagtccttttcaaaaccgacacaaaataaggattcttctctaatcactcctattcaacatagtattggaagtgctggccagggtaatcaggcaagataaaaaaataaagctcattcaaataaaaagagaggaggtcaaactatccctgtttgcagatgacattattctatatctaggaaattccattgtcaaagcccaaaagctccttaagctgataagcaactatagcagtctcaggatacaaaatcaatgtacaaaaattgctagcattcctatacactaacaacagacaagccaagagccaagtcacaaattaccactcattcacaattaccacaaaatgaacaaaatacctatgaatacagctaactcaggaggtgaaagatctctacaaggagaactacaaaccactgctctaagaaatcagagatgacatattcaaatggaaaaaacattccatgctcatggataggaagaatcaatatcattaaaacggccatattgcccaaagtaatttatagattcagtgctattcctattaaactattgttggcattcttcacagaatttgaaaaatctgttttaaaattcatatggatccataaaagagcccatataaccaaggcaatcctaagcaaaaagaacaaagctggagacatcaaactatactatgaggctacagtaatcaaaacagcatgatactggtacaagaacagacattgcggtttattgtatattattgaatgactttggcaaccctactggcaagaaacaatattaaattgaatccttacccttaaccagcttacttctttttattttctttgttgtgagatgagaaatagttttgactgtagtatcttttaattcagaaaaatagacaaaaagatcatatgctatgccattcatctaaagacaatggcttggtatgaatttggtgtagcctgtttatgctatgcacttcatacatttatttttataatatagttcacctatatataatcacatgagtattttcccacttgtcagaaacttataattcttgatgactgctaatgtatggatagcatcccttgtttttgctgaattgtggcttagttactcacttctggttaatggacatctagtttttaatatatctgatttgtaagtattctctttttttcttttaatttgtgtagctgaaaagccctgatgaaggctttgaaggcaaatctctttatgaaagttggactaaaaaaagtccttccccagagttcagtggcatgcccaggtaaacaaatgaatgaagtttccactgaattcagtgtgggattgttttgaaaataaaagcacattttctttcaatcattaagtgaaaaattaagtttcaaaatggtctaaaatctgataaagaaaagcattactttggttcacaaataaaatattactatgtgttttgtagttaaatctgcaggatatcaaaatgtgatttctctttagaatatgtaatatatacatatggaacatttcagcagattataaagattggtcatttcttatatgaaatgcgtgggatgagaagtgttttggactttggatttttttaagattttggaatatttgcattatacttactggttgaacatgcctaatctgaaaattcataatctgaaatgcttcagttagcatttcctttcagtgtcatgtaggtgcttaaaaacttttggattttgcagcattttttaaaatgttctaatctttaatttttgtgagtatgtagtaggtgtatttatttttggggtgcatgaaatgttttgatacagattttggatttttggattagggatactcaacccatgatagagataatggtgaaaagtaattttcctcgtttttctgccacctcatcaccttgtaattatcctttttctgaatatcatatagttaacaaatattttgcttattgcaataaaaatgcaagcatcatttcaacattggttgtatcttcacaagcaagggaagaagaataaatatctcagtgctctgagtttatcgatgtcaacagcactatttatattattaagggcaaaatttatgtccaaattatctgaaaaatatttgcttttcactctattatgtacaacaaataaagatgataaatggaatgaaataatcttaaggaaaatgttttccaacttcagaaacctttaacaaaatgtgacataaaatagtcattcctacacgaaatagtctcatagaaggagatattttgtgatcaaaattaatattcttttcatgtttttgctgcatgtctaaagctgtatgtttaaaattacatttataatagtaagaatggggtttagtttaatggacatgtaatctgtgcttaatgaacaaattactttgaaataattctgttgttttatctctaaaaggataagcaaattgggatctggaaatgattttgaggtgttcttccaacgacttggaattgcttcaggcagagcacggtatactaaaaattgggtaagtgaatctcaaattatctaagattatttatgaatatgttttaactaaacaaataattctgactccaaaaagtgactcaagcattagaggaatagagaaatttgaaagcagagggagaagtctcaatggttgacagtatcactactacgtaggataactcctatatcttgtattccaaccctaaattcaagtgtcagttggtatcaatactcatgtctgcaaatgtgaacttctgtgtactcctttaaacatattttctgtttcatttggtggcattgcattcactcagtcatttaagttggaaatgtaggaattgtctttgatttcaccctcctccttattcaaaattagtatctccccattatcattcaaaattaatgagtgtatttggatttccatctcttactgtatctccaattattaaacaaataacaagtcattaaacaaatgaaaaatgatatatatattagtctgttttcctgctcctaataaagacatacccgagactgggtcatttaaaagggaaatatgtttaattgactcacagtttcatatggctggggaggcatcacaatcatggctgaaggtgagtgaggagcaaagttacatcttacctggcagcaggcaagagagcatatacaggggaacttccctttataaaaccatcagctcacatgagacttattcactatcacgagagcagtgcaggaaaactcgtcccccatgattcaattacctcccataaagtctctcccatgacacgtggggattatcataattcaaggtgagatttgggtggggacacagagtcaaatcatatcagtataatacactgtgtacgtgtaaaagtcatgattccctttcttttgttgttgattatatatatatatatatatatatatatatatatatatatatggttttcattttcttcaaagtaaattgggtacatagtttataaaatgtcaagtagttttataagaacagtggtttataattaaaaacagttgtttcttatttccatttcatattcataccacccctgatttctgttcatcagatgaaacctttgtcaacttttatgatacatccatatttataagtaatattttaatcctgatactttttcaattttaaattttatgttataaagaaaaatcattctcacagttataaaaatggtaaggaagagttcattcaaaactattccaataagaatattgcaataataagagatcgagctcaactccaaatacagaaaagacatttggtgatttagagttgacattaagtttctgtaagcctttcctcatgggctattcttcccagatggaaaatcttcagtctcctgtctgtgaggtaggaggttaggcagagttatgcaggaggtgatagtgaggataaatattaatattgtctacattttactacgaaaaaattacaacaaagaaaagtcaaatgaccacctaaagtttttggtagtaagtcctgaagcctagattcaaaccctggcagggtaattccagaatcccagtctcttcaacacatcagtacataaaatgtccttttatattaataataaaaaataagcatcttaagatgatcaaaagtgataaaccagcaattcacagtttgaaaagtccttccttctacctatacttttggttttcctgacacctgtctgggcctcccttctctctccttagtgagattttggatccactactgcacccctcaccactcagactctccagccttcagtacactgcttgtcagacaatcatttatccatggaattttagtgattaagcaatttagtgtcttctcctatataatattgtgtaatacttatgtacttgcctttaacaattcgtcttctttttatccaaatgcaagattgtcttgtcttttttttcagattcttaaaacatgaatctaagaatgcaatgttctgcattcttagaggcaagccagtttggtccctttcaaataatttttaaataatatttgttatatcatatacacatattttaattgatacaagcctggaatgtgtttatgtatcataatattagccatttaggatgtagcttattgagatgcttaagtactttccttgatccatcactgaccaatcttactaatactaatagtaaatatggtgctaatcattttttgtaagctatcctataagagatatgttttgttgttttttctgtaggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttggtatgttacccttcctttttcaaattcctcatctgtatggttctattaatctcctaaatataatgggctatcttaggtcatttattatttattgctatttcaagtgatccaatattctgtttatgtctataaatgtattttccattttatggatgctcacgtcttataatataaaaatataaataccttgtaaaacacaaaagatgatggcttctatattgttccttttcttgaactatagagcagtgccattagaaattatgttctttaagcatttgatgatcccaatttctatttcagattcacttttttctgcagtaaagaattttacagaaattgcttccaagttcagtgagagactccaggactttgacaaaagcaagtatgttctacatatatgtgcatatgtgtgtatgtgtgtgtatatatatatatttaaaagtaaactaacatgactgttgctgaactagctttgggaatttcttgctgttttcttttttttaaatttgttttactttaagttgctggatacatggacagaacgtgcaggtttgttacataggtatacaagtgtcgtttcctgctgttttctgtctttccactctagcacgtcctatgtagggctgccccatctcaaaagacctactttcgacattctgagtggcaattgtgccgctcagaaatgtcagtccctccctcctgacatttgatcagttacaaaatactctgcttaacattgaaggtcctctactgtgtgaccccagctgtttccagttttatttcttgctttttcagtatctgtacatcataactcagccagactatttatttttcaaaacatgatttctttctacctcctttgtttttgtcattacctccacatagagctccttatttccacttccatctggcaaaattctgtttatccagaatagcaaatattgtgaagccattaattttggaaatgttaaacatttaggattaattctgtgtaagattacacaagtacaacacaatttgaacaaaattttaagatggaaggaaaaatacttggtgagaatactaaggtaatttttttaaagtataattttgagggcagagatctgtgtattaaatatagtatcatgatataaatatcaaatccccaggagctgatgtaaggacacataaaaagattacagtagatgatgtagaaataggcttggtgatctataaggaaatattagtaataaatgatacagcaaaaattaatggggaaagattactcaaccataatattatatgaactatgttagtacctgctataactgctataaaagtaaattcagaatcgcacttcacattgtatgctaacataaacaacaggtgtaaagaattatttagtaaaaatggaaatttcttgaaagatgccaagtttagaagcaatggggaaatgatgcaatcagatttgagaccatttgaaatggttcagaatacgaaaattaatattcacaagaaaaattaagaaagttgaaaacttattttctagcaaaaatggagagtaatatatacattataaaaatattttttgaaaattaatttaaacagtccaaaagaaccagctgaaaatatcggtaagaaacaagacaaataattttacaaatgttgtcaaagatacacctgcaaagaaacatggcaaaatattgcagttcactaatgcataattcagaaatacaaatgaaagtaatgtgatgttatttttataacacattaataacaatttaaaccttggtttgcccattgctgtagctggtacactgaagcatatgctctccatgcttttctgatagcattatgaattattttagcctttttgaaaaagatagatacatattgctaatgtgttcaagagctgtcacagagtcctgtgctttgacatagtatttccacttcttggattatttcttaggaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaatacaggaaaaactttaagggaattaatgaattattataataattgtgctatcctcagggaatattggaagaattgttttcctattcttttcaattctttataatttttatatgtgagtaaaaaagtcaacaataagaaatacattttaaggagatcccaaacaccatgtatcctataaaactggttttctttttgtatttaaaagaaaaaatgttttctccctctgacaaaatgtctcatggtttgaattgtggtttgtttaggacacttattgtttggcacactcagcttccccttcctttagtatttctatatttgttttattttctgtaagtgatagtaaagatacactctgttccctatatgatacttacaaattctgaaacacctgagcagtgctttgcacataatagtaaattctgactaagtaaattaaactgaatgttgaatttctcaaccaaaactttgaaatctaaggaagagacatgactttatcctgcttttcttgtatcacttcttgccccatcaaagaatataagacgttaacacaggatacagagaaagagaagtgtgtgtgtgtgtgtctgtgtgtgtgtgtgcacgcacgcgcacgcgcgcatttacgtgtgtgtggccacgagtttttgtacttgtagcaattctttgtgaatttgattccgaaacccattgcatcttattgaaattatccttcattcgattgtctcaactgtttatcggagttgctaacaggtattctgtgtttcatttacctttatactatcacagaatctgaattcatgatgccaaatacataaatgttaaaaatagctcaaatccaaattatgggagtttaagttgttcctattttccttttgtcggcaaggtgcagttgaaagaacaatatcaatctcctatttcactctaaaactttctagtgtgaatttaggcaagttatttaactcatgatcctttgttatctcatctacaaaatggggctgttaccctacccaacttgcagaattgctctgaaaattaaaaatcacattttgtataaagattcagaacagtaattggcacataggaaatgatcactaaatgctcttttagtaaaactaaattatgaaaagcaagaagtaaattaatgaacaagatgattcatgctttcttattgtaatgatttttctcagttaattaaattgtgaaataattggtatattaaattcagtaactcattgttgaagtattcagagcttgctgataaactttcaattatattgaatcattcttattataataacaaccccaacactccttttagaatgtaagttctgtaaaagcagggagtgtttgataaatagcaggtatccaaatattgttgaaagacttaagtaatcaccatctgttgtgttcataataggtttagctttaaaaataaaaggaatattattagttatcacttggtaaatatttataatttgccaggcatcttactaaacattagcaagtcatcttattttaatattgatattacttcagtgagtagattgctaggatacctaaggtgaagaaaatcttgcctatatttgtatatctgggttgatcagttaattatgccaatgtaaataaaaatcactattattttttccatttgcacatacaactgtttctgtgcttttataagcctgagcagtatagtattttataagattttaaagatgtcatagctatgtatgttattgttcttaatttgcatattacagaatgttaaaatttacaattgacatttgaacaacagtgatttgaactgcacaggtccacttatttacgaatttttttcaattaatacagtgagccctctctatccatagatttcacattagcaagcaaacacagatggaaaattcagtattattcactgtaatcccaggtactcaggaagctgaggcagaggaattgcttgagctcaggtgtttaaggctatactgagctatgattaagccactgcactccagcctgcgcaacagagcaagactccatctcttaagaaaacaaaataaaatacagtattgaaggactaaaacccacatatatggagggctgactattcttgttatttttaaatatggaaaactttttattttgccaaattaaatcttttattttcaagcttacatttgaaaatgttagcattgcatacataaaatgatttcattaaaaatatctaaaagtaggatggacataaatctagaacaaaagtattttaactgagaaaattcatttatgtggaaaaaatctcaacaagcatctttcttttagctttgatatattagaacttttatcacagaatgatgctcactctacaagcttgaatctgagaaactcagatgtagctaatgaaaaactaatgaaaaatataaagtaagagaattatagaaacttaaaaaaaaactgttacattccatttggactactagccatgtgttccacaaacattttctattttatataattgcctatctcattgtcttaacaacatgaagactaagatgtgaaagggggattaagcatgtggtaagagttatactgggggcagctaacccaagggagatcagatgtggcttcagattccacatacacagctacatttcctcactgaggcagagcaagttaatccagaaagtcatatcaggctccaagaacgctgtacttaaaccattctgaaaatcacttgaaacgatataattttaagtaacttttagacttaaatctggatcattataccgagagatcaatttaatttgtttggtagtttgttcattttcaccctgttaattccacagaggactcgtcatttacattaggtatacctcccaatgctatccttcccccctcaccccaccccacgacaggccctggtgtgtgatgttccccaccctgtgtccaagtgttctcattgttcaattcccacctatgagtgagataacgggtgcagcacaccaacatggcacatgtatacatgtgtaacaaacctgcacgttgtgcacatgtaccctcgaacttaaaagtataataataaaaaaaaattccacaaaggaggagggccgacttttcacatacatgtgtcctccttgcaggacttgagtatgcacaaattttggtgtagagggtggtcctgaaaccaatccccggagataactaaattcagttttgttctgaaatttttattttctgagtagaaacatattttcatgaagttataattatattcattttctttctcagcccaatagtattaagaatgatgaatgatcaactcatgtttctggaaagagcatttattgatccattagggttaccagacaggcctttttataggtaagaaaagaaaatatgactcctttctgtaatatcactttttcttctaattatttttatttttttcactgtggaaaaaatattgtagttgatttcttgcaagcaaatagaaaatttcaaaatatatgtagtaagtgatagttgtattgtttcttcatataatgtaatatgatttttgcatatctttattttgagtatctttgttctgattataaaagaatataaatttattttagaaaatatagaagatccagaaagccatgacaaaaaataaaaatctccccaattttatcagaaaaatataaaatcattgttatattctggtgtgtataattttagctccttttctattttaaatatatttttacttatgtatacacagaacccaaacatctctctatatataatgtatataataaatatatatttatttattcttttccctaatgttgatatttagatattttatttcctcctaaatcctgacagttggatttttttctgccaaacattgactgtccccaggttgatcttctaaatattgcagaatgagatagatcattggacagccagaaatggccctaactttctttctagggattatcaaagggtcgggcttgggagtaagagcatcttccaagcaggttgactggatcagatcaccagtagcagcatatttttatccatcccccaccccccctttttttcctaagagacagggtcccactctgtctcccaggctagagttcagttgtgcaattttagctcactgcagcctcagacttttgggctcaaccaatcttcctgcagcagcctccaaagaagctaggactacagtcacatgccaccatgcccagctaatatttgtacgttcatttgtagcgacagggtgtccctatgttgcgcaggctcgtctagaactcctggcctcaagcaatcctcccaccttggcctccctaatatatgggattacaggcatgagctactgcttctggccttatttacatctttactatggagtttgtccttctcttctgtgggctattacatgaactgtcatagcccattctataaaacattttctgccttggtcacatggaacattacaaaattgtttttgatgattcttcaaactctatattaagtattctaacatggtagtgtgactttttaaaaaaagacaaaaaaaaaaccacaatagagggttggctgatcacaagcaagactgtaatgattacaattgtgctataatatagggggtagcatgatatattaaaaaatcagcagttacttgtcgtgtgccttgagacaaatcatttagttacttgatctctcagacctcagtttccttctctgtgaaatactaatatcaactgtgtagagtttatttctaaacatcagaaaaattgcaagtaaacattaaataccaagaatgattgctgtggttactatcatcattgttagttttgtagcactgaaccactttaatttatttgtttgaaataaaaatataattaattactatagatttcatataatagtcttcagagatgattgaacttggaagttcagttgacaagtggcttgttcaaattgttataggaatatgcaatccaggaattgcagagtgctcttgtgtttctcttgtatatcatttgggcacctaataaacagcaaacgattttatcaacaggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 38180 - DNA, 25070 bp, Homo sapiens
aggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggtatgcggagggggcggcgcgtgagcgggcggcgtcggtgccccccaggggcggcggccctgtggttctgcccacctcgagcggcactgacctagcctgcgttgtgccaggtgctgagcccgggccgggggctgcggcggggacctgacagcaggcagggaccgcttcaggtcctgggtcgatgtctgtctatggaataaagccccgtcaggtctgtatcactccacaccccaggttcagtctctttgcgctttgcgttgcgtcagttctgggaaattaaaattgaacttggctttgttaagtgggtagtccccaactagaagcgtggaagcagagtggcagacgctagccttcaaatgatgcaagcctggaggaccctgtaaaagttttcacccaaatgaggaaaattagttccgggacacgtgtgtgtgtgtgtgtgtaagttagttacgggacacgtgtgtgtgtgtgtaagttccgggacacgtgtgtgtgtgtgtgtgttttctgaggtggggacggcgactttctcaaaggatgtccggagctgtgtttcgttaccagcaagtcagagttcttttaaagactgtccaggctgggcgctgtaactcacgcctgtaatcccagcactttaggaggccgagatgggaggattacttggagccaggagttccagaccagcctgggcaacaaagcaagacccccgactctaccaaaaaaaaaaaaaaaaaaaaaaaaaaaatcgaaaaatgagccaggtgtggtggcacgcacctgtatttccagctactcaggaggctgaggccagaggatcgcttgtgattgaggctgcaggtgagctgtaattgggccactgcactacagcctgggtgacagagaccccatctccagaaaaagaaaaaaaaaaaaaactcgtcagttcaaatgcttgggaactggctggatttaattttcagggagctatgtgtctgcagatgtgcaaacctttatttcttacaagcattggtgtattacagattagctctaggaaagaaatatggagacttgagttttcataaaaattacctggtgctacttcagatgtgacttattgactatcgaaattgccttctgactgttgggcagtatttgcacaatgatgagataattcctgttattattttaaatagagacgaggtctcacggtgttgcccaggctggtcttgaactcctgagctcaggtgatcctctcacctcggcctctcaaagtgctaggattacaattcctgtttttctaaaaccggtttttctttggttttgtcattagcatgtgcgacacaagaggtcgacactgaacttagcgttttcaatagctaagatgaaatgtttctattcatgatgtgcttctgtttcctcatgtttcaggaggaaaataagattttattttatcatccaaatgaggtagaaaagaagaagaggccgggctcggtggctcaagcctgtaatcccagcactttgggaggctgaggcgggcggatcacgaggtcaggagatcgagaccatcctggctaacacaatgaaaccccgtcaatactaaaaatacaaaaaaattagccgggcgtggtggcgggcgcctgtagtcccagctactcgggaggctgaggcaggagaatggcgtgaacccgggaggcggagcttgcagtgagcggagatcgcaccactgcactccagcctgggcgacagagcgagactccgtctccaaaaaaaaaaaaaaaatagaaaagaatgagaagattagaaatgtcggattgtgtgaagctattgtacagtttacaaggtaatacctctaagtgtgcctttagagttcagtgaattcttaaaactgctgctggagaattgtcccaaacatatttttttaacctttgtaggacctttagcccatcaaaacctgcaaaatctttacatacgcagaagaacagacagttctttaatgaaccagaagaaaatttctggatggtcatggtatttacatacacagtgtatctttctgaaattgtatggtgaagttatgggtgatctttactattcagaatttagcaaagttctctggctattgcatccaagtaaaattaaaataaaattcgttgcagttttaaaatcaagttcttcctgtttgctttattcgttcttggggctgctttaagaagctgtgtttctggtgctgtagcatgtgcaaagtttttaaactaaggcaaaataaacatggtctaatgaattcattgtataatttcagtttatcaaactttgtaggttgttcggaatcctataattgaaaaacagtaaagatggaaaaccagttattgaatatcaagaggaggagttgttggtaacgtgtcattgtttatttatttatttatttatttaaatgtattgctgagtatgttgaatgccttccttggtcagatttaaactaggtggcttttgtggaagtttctcggggtatatagcacaggtttatgtttatcatttacatgagcataatctttttaaaatgtatatgcaccctatctcactaataccttctattcctcatctgtattgaaagccctcctaaagtaaggcttactgattcacaaattagagtttaaacacttctggctgggaacagtggctcacacctgtaatcctagtactttgggaggtcgaggcaggcagatcacttgaggtcaggggttcaagaccagcctggccaatgtggcggaaccctgtctctactaaaactacaaaaactggccagggatggtggcgcacacgtgtcatcccagctacttgggaggctgaggcaggagaatcgcttgaaccggggacgcaaaggttgcagtgagccaagattgcatcactgcactccaacctggacaacagagcgagactccatctccaaaaaaaaagaacgcaaacactttttatcagcacacgactatggtgggaccaagtttgtaaacattatcctgtttggccaagagtcagtgtacctttgccatctatccagtagacattgtttttcccttgaactgatatgtgtgctatgttttcgtgtgtgtaggacaaggtttatagctcggtgctgcagcagtgctacagcatgtacaaggtaagcatggcattctttctcaactcagagtccaaccacttacgcctatctctaggctcagggttgtttaaagagaaatctgtaaatgactgcaaagtgactctgtatttgtcttagagaagaaaataatgaggcctttgaaacaggtagtgaggtttatgcctacatttattcagtaagtattgaactcccttctcttttctcagccttatagtaggaatgtgtccccattgatgaaaaagtgtgtctatgtgctcaaggaatgtacagaatgcagataattttatgatttaaaagtttcagcgagacagggcactgtgaatcacacctgtaatttcagcattctgggaggctaaggcgggaggattgcttgagcccaggagttcaggaccaatctgggcaatataggaaggccccatctctacaaaaaattttataaaagttagccatgtatcatggtgcatgcctgtagtcccagctacctgggaggctgaggtgggaggatcgcttgagcctcagaggtcgaggctgcagtgaactgtgattgcgccactgcactctaccctgggcaacagagcgagattccatctcaaaaaaaaaaaaggataaaaagtttgatgattccattcattgagaggaaactgaaaaataacaaaaatgtgggtgatattctgtatgtaaattgaaacttcaggataagttgaaatttttgaaagatgcctaaagcaattaggtggtttcataaatgagacaacatcacttaatggtagtttttgtaacatatttttaacttaagttttctcatgtaaatagtctctgtattgaaaagaactgggagatttaataagctgaattaataattccctagagcctatatcttgcttggcacataggagatagccaaagtcaacatctatgtgaattcttgaattcacacttccttggttcacaaaaattggctgtcataagtgtaactttgacttacttgattcctcttgtttttttgttttttgagacggagttttgctcttgttgcccaggctggagtgcagtggtgtgatctcggctcactgtagcctctgcgtcccaggttcaagccattctcccgcctcagcttcccgagtagctgggactacaggcgcgcatcaccataccgggcgaagtttttgtattttcagtagaggcggggtttcgccatgttggccaggatggtcttgatctcctgaccccgtgatccgccctcctcagcctcccaaagtgctgggactacaggcgtgagccaccgcatctggccaaactttctgatgaaaactctaagtccacctaagctaaggacaggagttacagcttccatgaattttaaaaccagacccaccgatttgagtaagcaattactctcttgaaggagaaaagtcagaaaacataatgatgaaatcactaggacctaactggcatgtggaattattttctgcttatgaactatcaactttaatttcatttccagatgacatggtctcagctgttctacagtgtttataaatgttctaaatcaagggaattcatcaatctagtagaataaaatatttgagttcttaatttcctttaattaggataacctttttcttcaagtgaagagaatggttttattacatagttttcttcggaaaagataggctgtattttctagcagttacgaatttgttatgtatgatgatctggttcttggaacattcttgaatctagtgtctctaaggcaggtgtgtacagcaagaagtgaataacacagaaatcaatgatgaaagcattagaagacaattgagtctgtcagaactgcaaaatattgctgagtgtggattgctctgaaatctgaaaacattacttgtgaattgcttctattcaaaatgcagacacaatgccaggtgttggtttacttgtttcccatttttcaaccctcgtttctaggcaaaggtgtccaaattatgcagacccacagaatctaacagatgtctctatattcctcctcctagaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgactggtttgtagccatctgtcacccgctatatcattcaccatcatgaacccgtgtttctgtgcctttctagttttgttgtctttttttttctcagtcttttagactcccagctgcacaacttgattgccttacaagtgacctgcttcaaggatgtggaaattcctaatttcttctgtgacccttctcaactctcccatcttgcatgttgtgacaccttcaccattaacataatcatgtatttccctgctgccatatttggttttcttcccatcttggggacccttttctctttctctaaaattgtttcctccattctgagggtttcttcatcaggtgggaagtataaagccctctccacctgtgggtctcgcctgtcagttgtttgctgagtttatggaacaggcgttggagggtacctcagttcagatgtgtcatcttcccccagaaagggtgcagtggcctcagtgatgtacacactggtcacccccatgctgacccccttcatctacagcctgagaaacagggatatgaaaggtgtcctgcggcagccgcacggcagcacagtctaatctcaatatcttatctgttccattcctttgtagtgtgggttcaaaaaggcagcaaggtcaaataatgataacacagggtgaacacctactgtgatattaggagtaatacctccctaggatataaagaatactgtcacacagtatacacaaaaggggtataaccactgtgatattagaagcaatatctccctataatatgatgaaaattatcacagggtatgcccactgtgtgatcttaggagtaatctttaccctggatattatgattaacatcaagggtgtacacacccggggtacacgcactgtgatatcaggagttgtatctccctaggatattatgaatcatatcacagggtatacactatgtgtgtacatccactgatatttcaagtcatatctctctatgagattacaaataatatcaaaaggtgtacacccccgtgacctattaggagtaacgtccttccagggtattacagataacgtcacaaggtgaacacattttgtgacattttgtacaccctttgtgacattgaaagaaacatccccctaggatattacgagtaatgacaggcggtgtacacacacggtgtacaccgtctgtgccatcaggagtaacattcccctaggatattatgaataataccacagcaggtgtacacacatggtgtacaccccatgtgacattaggaggaacatgcccctaggatattaggaatagtatcacaggtgttgaatatgcatgatatacacccctggtgacattaaaagtaacaagcccttaggatattatgaataatatcacagggagtacaccccatgtgacattaaaagtgacatcccccgaggatatgatgaataatatcagagggtgtacatgcattgtgaccttagtaacgtctctaggatattataaatcgtatcacagggtgtacacgcattgtgacattggtagtaacatcccgctaggatatgacgagtaatgtcacagggtgtacaccccctgtgacaatagtaacattcccctagaatatgacgaataatatcacaggaggtacagcccctgtgatttacgagtaacatttctatataatattacacgtcatagcactgtgtgactctgtgtacaccctgtatgacattaggagtaacatcccacaaaacaattacgaataatatcacaaggtgaacaccctctgtgacatgaggaataacgtagttttaggatattatgaatgatatgacaaggtgtacacaccctgtaatgttaggagaaatagccgtctaggatattaggaataatgtcacagggaacacaccccctgtgacattaggataatacgaatgatatgccaagatgtacacgcattgtgacattcgtactaatatccctctggtatactatgaataatatcacagggtgtacatccctgtgacattaggagtaacatcccccttgaataggaggaataatatcacagggggtacacaccctgtgactttaggagtatcagcgccctggaatatgaggaatactgtcccagggtattaaccacctgtgacctgaggagtaacatcctgttggaatattacgactcatatcacagtgtgtacaccaactgtgatattaggagtcctatttatttttaggatattaggaataatatcacagtaggtgtacacaaatagtatgtacgcccacggtgatattaaaagttatatctccctagggtattccgaataacatcacagtgggtgtacacccactgtgatatttgaagtcatatctccctaagatgataaaaaaatcaaagggtggaccctgtctgtgacatcaaaagtaacatctctgtggctattccgaatagcatcacagggtgtacacagcctgtgacgttaggagtagcatccccataagatattccgagtaatatcacagggtgtacaccccatgtgacattaagagcaacatcttcttaggatattacgaacaacctcacagggtgtacgccccctgtgactttaaaagtaacatccccctagaatattaggaataatatcatgggtgtacaccccgtgtgacattaggagtaacatctccctaggatattacaaagaacatcactgggtgtacgccctctgtcttattaggagtaacatccttctaggatatgaagaatatcacaaggcgtacacacactgatattcggagagatatctccctaggatataaggtgtatcacagaatgtacacgcatggtgtacacccactgcgacattaaaagcaatatctccctatgagagtatgagaaatatcaaagggagaacactctctgtgatattagatgtaatgtttaccatggatattacaaataatatcacagggtgtacacacatgaggtacacccactgtggtattatttgtactgtcttagatataattctaatataacacggagagctataactctgtagtatctgagatattacaaataatatcacagtctacacatagtgtacatagtgtacacccactgtgagatttacagtaaaatctccctataagactacaaatattatcgaagtgtgtgcacccccgtgaccttaggagtaacatccttctggatatcaggaatcatatcatgaggcatacacaccctgtgacattttgtacactctttgtgacattcaaagtcacagccccctagtatattacgaataatatcaaaggcggttgatgcacacggtgtacacatcctgttacattaggcgtaatctttttctgtgatttatgaatatcacagaaggtgtacacacatgctgtacactccaggtgacattaggagcaacacccccccaagatattagaaataatattaccagggttgcatacacatggtgtactctccctgtgacattagcagcaacattcccctagaatattacgaataccatcagagggggtgtacacacataatgtacgcaccttgtaaaattaggagtagcatctccctacgatgttatgaataatatcacagaaggtgtacgcacatggcctataccccacgtgatgttaggagttacatctttctagtatgttaggaataataccacaaaggtgttcacacatggttaacagcatatggaatattaggattaacatccctcaagaatattacaaataacatcacaggggctgtgcacacatggtgcacatgccctgtgacattaggagtacatttccctggcacattgcaagtaatatcacagagtgtacaccttctgtgacatttggagtaacatcccctaggatagtatgaataatatcacagggtgtacatcccctgtgacctgaggagtaacatccttctaggacattgtgaataacatcacaaaatgaatgcacagcccctgtgacacgaggagtaacatccacctaggatattctgaataatatcacagagagtacaccccatgtgacagtaggagaaacctcccccgaggatataacgaacaaatacagaggatgtacacgcgtcgtgtcactagcattaacatccatttaggatattacgaatattatcacagtgtgaacgccccctgtaatattaggagtaacatccccctacaatattgggcaccatatcatacggtgtacaccccctgtgacattagaggtaacatttcattaggttatgatgaataatattacaaggtgtaaggcccctgcgacatttggagtaacatttccataaaatattacgaataatatcactgtttgtacaccacgggtgacattaggagtcccagcctccaaaattattatgaataacttcacagggcgtacaccctctgtgacattaggagtaacatctttctaaaatatgacgaataaaatcaaaaagtgtacaccccatgtgacattagaagcaacattgcccgaggatataagaaataatatcagattgtgtacgtgcattgtgacatcagtagtaacatccctttagggtatgacgagtattatcagaatgtgaataccatctgtaacattaggagtaacatcaccctacaacatcgggaataataccacagggtgtacaccacctgtgatattagtggtaatatttctttaagatattatgaataatatcacggggtgtacagcccctgtgagattaggactaacatatccaaaaaagcttgacaaatcatatcacggtttatacaccaagtgtgacattaggagtaacatcccccaaaactattatgaataacttcacagattgtacacgctctgtgatattaggggttcacatcttcctagaatgtgaagaataacatcacaggaggaacacccccgtgatatgaagggtaacatcactctaggatattacgaataatataacaaagtgtacccaatttgtatggtaggagtaacatcccctgggatactacaaatcatagcacagaaagcgcagcccctgtgacaacaggaggaacatccccttaggatattatgaataacatcacaaggtgtacacacattgtgacattagtaacaatagccagctagtagatggtgaataatatcacagcgtgtacacatttgcaacatgaggagtcacatccccctagaatatgaagaagaatatcacagggtgtacacaccctgcgactttacgataatcatccccctggatgactacaaataatttcacaggatgtgaaacccctgtgacaataggaataatatacttctacgatatgacaaataatatcacagtttgtacacccactgtgatattaaaagttatacctccctcagatatggtgaataatatcacagggtgtaccctctgtgggatactagcagtcatgtttaccatggatattacaaagaatatcacaggtgtaaacacatggggtacgcccactgtgatattaggagttatgtctctcgaagatattagaaataatatcccagtgggtgtaccccatgtgtgtacacccactatgatactttaagtaatatctctctataagattacaaataatatcgaagggtgtacagctcccgtgacattaggagtaacatccccctacaatattgggaacaatatcacatggtgtacacccctgtaacgttaggggtaacatccccccagaatattactaataatatcacaaggtgtacacgcattgtgacattagtagtaatatccagctagcatattttcaataatatcacagaaggaacacacgtgtgacattaagagtaacatcccccgagaatacttagaataatatcacagggtgtacaccccctgtgacattaggagtatcatctcgctagaatattatgaataatgtcactgggtgttatcttctgtgacattaggagtatagacccctggaaaattatgaatactttcacagggtctacacccctgtgacattaggagtaacatccttctagaataccacgaatcatatcacaatgtgtacaccccctgagtcattaaaagtaaaactgtcctaggacattacgaaatagaacacagggagtacaccccgtgtgacattagaagtaacatccccctaggatataatgaagaatatcagagaatgtacctgcattgggacatgagtagtaacatcttaggataatacgaagaatatcaaagggtgtacacacattgtgaaattactagtgaactcccgcaaggatattacgaattttatgacaggtccgactcgccctgtgacattagtagtcacctattcctacaatattatgaagaatattaaagggtgtataggacctgtgacatacgagtaatatttctagagaatatgacacgtaatatcaccgtgtgtacaccccgtgtgacattagcagtaacatcccacaaaactataacgaaaaatttgacaaggtgtacaccctctgtgacattaaaagtaacatttccctagaatatgacgatattatcacagagtgtacaccctctgtgatatgaggagtgacatcttctaaaaacaatacaaggaatttgacagggtgtagaaaacctgtgacataaggagtgacatcccccaagtatattaccaataatatcaaagggaaaatacaccgtgtgacaataaactaacttccccttaggagactaagaataacaccccaaggtgtacacacattgtgacattctttttattgtcccgctaggatattatgaataatacaacagggtacagagtcctgtgaaatcaggattaacattcccctaaaatattacgaacatcgcagggtgtatccctcctgtgattttaacagtcgcatcttcccaaaatacggaaaataatgtcccagggtgtcaaccaagtgtggcagtagagaaaatctcccaggagtaaggtattaataaccccccacgatgcgggcagtaatatcgcccccctctcccaccctggatattacgatccacatcgcaggggggcgagggtgcccaccgagatgcggtgagtaatataagccccctctccccccctggatattaggacccacatcgcagggaggcggaggcccccctcgatgcgggaaataatctcacccccctctctcccctggatatgacgatccatatctcatgggggcaggcgtccccgccactcggggagtaatatcaccccccattccccacatggatacgaggatccacaacgcaggggggcgggcgaccccccccccatgcggggagtaatatcacccccatctcccaccctggacaagacgatccacatcgcagggggacgggcgcccccgcgacgcggggagtcatatcaaccccctctcacaccctggatatgacgattcacatggcaggggggcgaggcgccccccgcgatgtggggagtaagagccagcccctcttccccccctggtttttaggatccgcggtggactcacagcctgtttaccatattgtgagcaatatcacctccttgtctggagattatgatctgtttcacagacgggtgtacacccgtctgtattgggagtaatatcatcctcttcctccctgaatattaagaagagtatcacaggggtgtttccactccctcggatatcgcgtgtcatatcctcctctcccacgttgcaattagaaacaatatcagtgggggcgtgtccagcttctgtgatattgaaagtaatgtcatcctcttccctccaggatcatgggaacaatatccctggggggtgtccactttctgccatatacgtagtcatatcaccccctccgccttggaatattatgaaggaccatctcacactggggtgtatactttctgcgatattgggagtaatatcaacctctcggcctctgaatattaggaagaatatcacagggtgggtgtatacctcctgctctattatggggagtcatatctatctattatggggagtaatatcatcctctccctttcaggatattaataacaatttcacaggctgagtgaacacagcctgcgatgctggaattattatcactctctccccctcgggatactaggaagaatatcacagaagagttgtacactccctgcgatattgggagtaatatcatatgcttcttccgtgaatattaggagcgatatcactcggtggctgtacattgattgctatgttggcagtcatgtcatactctacccgctgggtattaggatcggtgtcacagggtgagtgtacacctactgcgatatgaaaattaatatcatgctctccatccctggatattaggaacaatatcacaggtaggtgtacaccctctgtggtgttagcagtaataatattctgaattattaaacatcagtcttattaataattatcaatggtaatattaattaacagtataacgttattaatcattaatgattatttcaagatatgattatgcatgattaaaattaattattaatgtcactttttatattagttattaatcttaatattaattattgttttattaccaacatcacttatgattgaagtaacattaattagtgatatcattattttattattaatagtgatattactattatttatagtaaccattaatgtttttcatccgtactaagttttactgtctctactgtaattattaatattgatgattactattaattgttattatatttattaatattaataattaatagaactgttcccgatatccgtgggagagaggatattactcccaatatcgcagaaagtgtacacccctctatgatgttactcctaatagccggggggtagaggatgacattattgaaaatagcgcagtgggtgtacatcccttcggtcatcttgttcctaatatcgtggggtgggagcggatggtatgactcccaatatcgcagggggcagagacctcccctgtgatactgtccctaacatccaaaggtggagaggatgatatttcttccaatttcgccgggggtgcacaacacccttgtgatattgatcctaatatccaggcggcgagaggatgatattagtctgaatattgcaggatgtgtacactccctagggatattgttcctaatatccagggacggagaggatgatatcactcccaatatagccgggggtgtacaccccttgtgtgacattgctcctaaagcgcagcgggggagaggaagatattacagccaatatcgcaggggatgtacacccccttgtgacattcttccttctatcctgggagggagaggaacatactagcggcaatgtcgcaggggctgtacacactcactgtgatattgttccgaatatccggagggggagaaaatgatgttacttccaatatcgcagggggtgtacatcctcctgtgatattgtttcttatattcagcgggagaggatgatattactccgaatatcgcaggggttgtacacacctcctgcgataccgggagtaagagccagcccctctcccctcctggctcttaggagccccatcgcaggggttgaggccccaccccggggtacggggagtaagagccagcccctatcaccccctggctcttaggacccccatcgcaagggggtgaggcccccgcgatgcggggagtcatatcacccccctctggatatgacgattcacgtcgcaggggggcgggcaccccctgcgatgcggggtgtcacatcgcccccctctccccccctggatatgacgatccacggtgatcacacagcgtgttcacgttattgtcagtaatatcttctccgcctctggaaattaccaactatgtcgcagacgggtgcacatcctctgcgctctttggagtaatagcatcctctttccccttgatattaagaacaatatcacaggagtgtttttacccctaggggcattccgtgtagtatcatcctctcccacgttgaaattaggaacaatatcactgggggcgtgtccaccccatgcgatattgaaagtaacatcatcctcttctctcctggatcatgggaaccgtatcactggggttgtgtacactttctgcggtattgggagtaagatcatcctctccgccttggaatattaaggaccatatcacagtggggctgtacacaccctgtgctatgaagaagagtattatcctcccctgccctgcacattggaaaaaatatcacagagtgggtgtacacctcctgcgatgggggggtgatatcatctcttcttctggataatagcaacaatagtacacaggtttgtacactttctgtgatattgggagtaatatcaacctctccacctttgaatattaaaaacaatatcacagactggatgtacaccccctgcgatattgggagtcatatcagcctctcctctccgtggatgttaggaataatatcccaggatgggtgtacacctcctgctgtatggggagtcatatcgtcctctcacttcctggctgctaggaacaatatgagagggtgggtgtacacagcctgcgatattgcgagtaatatcaccctctccccctccggatattaggaacaatgtcacagaagaggtgtacacttcctgagatactgggagtaatagcattctcttcttccgggaatattaggaggaatatcaccgggtggatgcacacccactgctatcttgggagtaacgtcatacgccaccccctggagatgatattcggatcaatatcaccgggtgggtgtacacctactgcgatattgaacgtcatatcatgctctctccctccctggacattaggaacaatatcactggtgggtgtacacccactgaggtattagggataatattcatattaattcttcctcatttataacatgaatatgtattaccaatattaatattaatattaagaaatcattgctaaaaatagtgttcagattattaatattactgttaattattaggagctaatatgacagttttctaatgaataagatcaatatcactctttaagaccaggcgtcattaatcattaatattcatcatttattgttatcgtgagtataactctttaatacgaattatcattattatcggtattgattttaagaattatatgatcagttattaatattgataattatcagtatcaattaataattgagattattaattgcggtaagtaacattgcgccattccacccctccctcggcaacccgtttacgacccaaaacagggatccaaacgcccctgagagagcagcggtatactgggagagaggaggatggtcacgtggtggagagacgtgtttttgtgtaccagcccttcacctttgccgaccttctcaactgggaaaacaataccccgtcctagagcgaaaagccgcaagcactaattgatttgctccaaactgttatccagacccacaaccccacctgggctgatcgccaccggttgctcatgttactctttaagagagatgaaaggcaaaaggcggagagggctccacgtagcaactaagtggctagaggaacatacaccagctgattatcaaaaaccccaagagtatggaaggacccagttaccaggaacccacccccagttggacccacacgaaagagaggatatgcaaaggctaaactgagacagggaagctctcttggaaggattcaagaggggagctcagaaggccacaaacgttaacaaggtctctgaggtcattcagggaaaagaagaaagtccagcacaattctaccagagactgtgtgaggcctatggtatgtatactccccttgatcctgataaccctgaaaatcagcgcatgattcacatggctttagtccgtcaaagcgcggaagacgttagaagaaaactgcagaagcaggctgggcttgcagggatgaatacatcacattgatgagaaatagctaagcaggtgtttgtaaacagggatgcagtaagccgcgagggaaagtgcaaagagaatgaaggtcaggcccggtgaaacgctgacctgtttgttagctgcagcaatcagagctgtcccctcaaagaagcaagggaaggggggccctgggaaagaaactcagcttggctgtcagagtttgcagcgtcactagtatgcttattgtaaagaaataggatagtggaagaacaaatgccctgagctcaaaagaaaacaaggtgactcagagcaggaggccccggacaaggaggaaggggcccggctcaacctggcagaagggttatcggactgagggaaaccaggctcaagtgttctcaaagagcctctggtcagaatgacagtcgagggtagagacattgtttttcttgtagatagcggtgctgaacattcgctagtagccgccccggtcgcccccttatccagaaagactattgacgtcaccagagccacgggggtttcagcaaagcaagctttctgcttgcctgggacttgcactgtaggaggacatcaagtgattcatcagtttttgtacatgcctggctgtcccttgcccttgttgggaagggacttgcttagcaagctgagagctgctctctctttgacagaacacagctctttgctgctaaagttacccaccacgggagtcattatgacccttacggtcccccgagaggaggaatggagacttttgtgaactgagccaggccaagagagaagaccagctctggctaagcggtggccaagagtacaggcagaagacaaccctccagggttggccagttaagactggggcccagccgcttaggcaaaaacaggacccggtccccagagaagctcttcaaggtatccaggtccttcttaagcacctaagaactttgggtatgatagttccttgtcagtctcaacggaacactcccctcctgcctgttcccaagccatggaccaaggactacaggccgggacagcattcacgcttgcttagtcaagctaccctgactttccatccaacagtacctagcccgtccacattgttggggttgctgccagccgaggacagctggttcacctgcttggacctgagagacgctttctttcctatcagattagccccggagagccagaagctgtttgcctttcagtgggaagatccggagtcaggtgtcactactcagtacactttgaccgagcttccccaagagttcaagaactcccccaccatcttcagggaggcgtgggctcgagacctccagaagtttcccaccagagacctaggctgcgcgttgctccgctaggttgatgagcttttgctgggacaccccacggcagtccggtgcgccaagggaatggattgccctacgccaacacctggaggactgtgggtgtaaggcgtccaagaagaaagctcagatctgcctacagcaggtacgttccttgggatttactatccgacaggggcaacgcagcttgggatcagaaagaaagcaggtcatttgtaatctagcagagcctaagagcagaaggcaggtgagagaattcttaggagctgtgggatttgtagactgcggatcccaaactttgcagtattagccaagcctttgtatgaggtcaccaatggggcggggaccgggaactttttgaatggggatcccaacaacagcaagtctttcatgagttaaaggagaaacttatgtcagccccagccctggggctaccctatctgacaaagccttttacatcctatgtgtcagagagagagaaaagatggcagccggactttgaacccaaactgtgtggccctggctgaggccggtggcctacctctccaaacaactagatggggtctctaaaggatggcccctgtgtttgagggccttggcagcaactgccctgctagtacaagaagcaaagaagctgactcttgggcagaacctgaacataaaggccccccatgctgtggtgactttaatgaatactaaaggacatcattggctaacgaatgccagactcaccaagtaccaaagtttgctctgtgaaaatccccatataaccattgaagtttgtaacaccctacaccccgccaccttgctcccgctatcagagagccctgtcgagcatgattgtgtaaaattgttggactcagttgactctagcagacctgacatccgggaccagccttgggcatcagtagactgggaactatacgtgcatgggagcagcttcttcaacccccaaggagagagagttgcagggtatgcagtgataaccctggacactgttgttgaagccagatcgttgccccaggccacttcagcccagaaagctgaactcattgctttcattcgggccttagaactcagtgagggtgagactgtcaacacttacactgattcttggtatgcctttttaacccttcaagtgcatggagcatgctagaaagaaaagggcctattgaactctgggggaaaaggcagaaaatatcaaccagagatcttccatttattagaagcagtatggaaaccccacaaggtggcagttatgcattgcaggggacaccagcgagcttccaccttggtgggcttggggaattcccgcactgactcagaggctcgaaaagcagcatctgcccctttccaggcatcagtcacagctcctctgctccctcaagcacctgatcttagacctgcttattctaaagaagaaaaggactttctccaggtagagggacaagtgatggaagaaggatggattcggttaccagatgggagagtagctgtgccacagctgcgaggagctgcagttgtactggctgtgcaagaaaccacccatcgaggtcaggagtcactgcaaaaagttgttaggccggtatttctacatctcgcctttctcagcccttgccaaaacagtgaggcagtgatgtgccagctgccgacagcatgatacgaggcaaggtctagccattccacccggcatacaagcttatggagcggccccctttgaagatctccaggtagacttcacagagatgccaaagtgtggaggtaacaagtatttactagttcttgggtgtacctactctgggtgggtggaggcttatctaacacaaactgagaaagctcgtgaagtaacccgtgtgcttcttcgagatctgattcgtagattgggactgcccttctggatcggctcagataacgggcctgcgtttgtggctgacttgctacagaagacggcaaaagtattggggatcacacggaaactgcatgccgcctcccggcctcagagttccggaaaggtggagcggatgaatcggactatcaaaaataatattattgtcttccccgctggatatgtaaaacaacaccacgaggggcatcaaaccacctgctacattggagggaatcttatcctctccccacctcctccggtcccggatattagaggcaataacacaggggtaatgtacacccactgctttattgggagtaatgtcatcctctgccttcttggatattaggaacaatatcacagtgtgcgtgtatgcctgtcgcgaaattcaatggaatgtcatcctgtgcctccctggatatgacgaacaatatcacgggggatgtacaacttctgagatattgggagtgatctcatcctctcccctctggaagttagggacaatatcacaggggtagtgtacaccttctgtgacgttgggactaatatcatcctcccgcctcctggatattaaaaaccatgtcacaaggggcgtgtacacacacttcgatattggtatgaatgccatcctctccctctttggatattcggtgccatgtttcaggtggggtttacaccacccgcaatattggaagtcatgttactttctcccccccccggatattagaaagagtatcacaggggggtgtgaacaacccttgcgatatttggagtcatatcttcacctcccctcaagaatattaagaacaatatcttaggggtgggggttgtacaccccctttcatattcgatatcatcctcttcccccctggatattaggaacaatatcaggaagggacgtacagaccctgcgacatttgctgtcatgtaattgtctctcccctagatattaggaaaaatgtcactggggatgtgaacacctctgcgatattgagagtagtatcatcctctccccccttgcatattgggaacaatatcacaggtggggcgtactgcctctgtgatattgggagtacagttatcctctcttcccctggatactaggaagggtatcagagggggagggtgtacattccctgcgatattcaatgtcaccttatcctctccctcccagggtattcagaacaataggacaggggggtgtacaccctctgcgaaattgggagtcatatcatcctctttcgctctggatattaggaacaatatcacagggttgtgtaccccccctgcgatattgggagtcatatcatcctctctccctgtggatattaggaagagtatcacagggctgtgtaaaccccctgcagtactgggagtaatatcatcctctcgccctctggatatgaggaaaattttcacaggggtgtgaacactccctgcgatattgggagtaagatcatcctctccacccaggaaatgactaacaaggtcacgggggggtgtacttcccctgcgatattgggagtaatgtcgtcctccccaaacctggatgttagcaatgagatcacagagggggtgtacacaccctgcgacattggaagtaatatgatcctctccccaactggatactgggaaagataccacagcgcgggtatacgtttcctacgctgttgggagtaatatcattctcttcctttctggatattagggagaatatcacaggggtgctgtacaattacttcgacattgggagaaacatcatcctctattttcctggatattgggcacaaaaacacaaaagggtgtacaacccctgcgatgttgggagtaatagcatactctccttccctggatgttagaaaacaacatcataaaggctgaacaccccccgcgataatgggagtcatgtttactctttcacaggccatttggaacaatatcatcaggggtgtttacaaacaggggtggtgtacaccccctgtgatattgggagtaacatcattctctccacctccggatattaagaacaatatcccggcgggaggtggtacacccccagtgatattgcgaataatgtcatcctctccttccctggatattaggaacatatcacaggggggtgtacaccttctgtgatattggaagcaatatcatcctctcccccgctggatattagaaaaaaatatcactcacggtgtacacccactgtgatatgaggagtaatatcttcctagggtattatgaataatttcactgtctgtacacacatggtgtacactcactgtcatattaggagtaatatctacctagtagataacaaataacatcgcagtgtgtacacccactttgatattagctgtaatatttttctaagttgttacaaataagatcatagagtgtacaaacatggtgtacactcactgtgatatcaggagtcatatctctgtaatatattatgaataatatcacagggtgtacacccactgtattattaggagtaatatctctgtaggatattacaattaagatcacagggtgtagagccaccgtgatattaggagcaatatctttctaggatattacaaataatatcacagggtgtacgtccactctgctgtcaggagcaatatctccctaggatatcaaagatcctatcacagggtgtccaatctctgccttccaggctctaagggattctcctgcttcagcctcccgagtagctagggttacccgccaccatgcccggctaatgtttttttattttcactggagacggggtttcaccacgttggccaggctggtctggaactcctaacctcaggtgatccatcagcctcggccgcccaaagttctgggactacaggtgtgagccatggtgctgggccaagagttatatattcaattcatttggaaacacagctcccatctttgagtgtgcatgtacttttatgaagaaatgatgtcagaaaactgaaggatgataataaatacgaaaagtaacaggcatgtgaaaaggtcttccgattgagaactataaggtttgatttcgttttcagataatgggttcctagctcttgtgtcgtccttttacatattctacatcaatggaagttgtagcacggtgtcagaataaagtagagtgtatttcacggcttcttaatttctttcaattagactgagatctttttcttaaagcgagaaggacattgtcattgcattgtattttttctgaaaagagtaggccgtattttactgagatcacggatttgttatatatgatgttttggtcttctaatattcttcagtggattttctctaaagtagtatgtacagaaagccttgtatagcaaaagagtaaatcacgtaataattctgagattttttggaattgtcataactgagaaacattgctggcggtgtatggtccgcaagtgtgaaaatgttccttgtgaattgcttgcatccagcattaaggactggtttttatcttttatttttccaatcctctttccttctcaaggtgtccaagacacacagagccacagaatctcacagatgtctgagaattcctcctcctgggactctcagaggatccagaactgcagccggtcctcgctttgctctccctgtccctgtccatgtatctggtcatggtgctgaggaacctgctcagcatcctggctgtcagctctgtctctcccctccacacccccacctgtgctgggctgacatcggtttcaccttggccacggttcccaagatgattgtggacatgcagtcgcatagcagagtcatctctcatgcgggctgtctgacgcagatgtctttcttcatcctttttgcatgtatagaaggcatgctcctgactgtgatggcctatgactgctttgtagccatctgtcgccctctgcactacccagtcatcgtgaatcctcacctctgtgtcttcttcgttttggtgtcctttttccttagcctgttggattcccagctgcacagttgaattgtgttacaattcaccatcatcaagaatgtggaaatctctcattttttctgtgacccctctcaacttctcaaacttgcctgttctgacagcgtcatcaatagcatattcatatatttcgatagtactatgtttggttttcttcccatttcagggatcctatggtcttactataaaatcatcccctccattctaa

SEQ ID NO: 38181 - DNA, 25892 bp, Homo sapiens
gggggaagggaacggggggaagccatcttcaccccccaccccaatgcacacacaattaagccaggaagcagcttgcaaccactagcctggggagggtccgcatgtgtcaagggtgagggcaacagatgctggacccagggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggaggtaggtggcatctgtacaccttggataagtaacaggcttcccagaagtaccttatttttacccatgcttctctatctactgggttgtatttttcccagatagcaaatgacacattgccaaagttacactttaaaatgctcatagtctggcagtttagagccgaactccagagtccagtgtgctacttccagaccttaagcacagttgcactttgtgctctgatttggcagtttgtctcatctgtaaaatggggataatagtagaatttatgttgtaaggctatcctgaagatttaatccatagctaaaatactgcctggcataatggtatgtatctaaaatgttattattcaccatagttcattttttaaaatatgaaacttaaaaatgttggttactttttcttcatgttttagtgtttcaggctgataatggatttcagcttttcgttttgtcttttatgataaaccattaggtcactgtaaaaagtcatgatatcaatgtactgagaagtcttagtttcttttgctgaactggatttagacttagaagtgagcagatttcagccaagttaaacagaaagaatgcatttgggctgccacctcattaaaatgtgcaaaacccaacattttggcagcctggacaggctcccagggacaaatgtaaccctccaccctagcctttgccacaccctggcattgattattcatacttaatggcttgcttttgtacaagctaaattgataaattatttatcttctttcaaagaccctcttattgctaataattattttatacattttcctgaaaaatcttcatgtccaaattatatgttcttctagttatagtcagggtaaagtaattccacatagcaggccgaatgcatttcctaagggcgtccagccaacaggctggggcctggaggcagtggatgaagtgttcccagacgagcggcctcttgcgcttcttcacttgctccctcctgagcctcacctccttagaagtgccagaatgatgctcagtcaggatccctctgcatttagcaccgacttgccttgggagtaaagccagccaaatccctgcaaattgtctttcactaccttaagaacttgtcaagggtatgaagtacagactgatccttttatagctatgaatgtggatttgaaaaagacaaggatatgatctgtatagatcttcccaccccagtcctgacctgaggtgaagccaagtcgcaggtggcagtcactgttggccagcgcagacacttaacaatacagtgatagcattcccagcctgagaagccagtgtcggaggggtaggaaaaaagagggtagggatttagggaattattttgggtctctctttctgtctttctcccttcaaaataaacagccttacgtattgttgtttggagcatacatttttacatttgtggatagaattttgataaaccatgccaaatgagctttaagtagacattctctttgaccaagcaatcccatttccattcatttattcttttgttcagcaaatatttattgaatagtattatgtgcttggccctgtgccaagtgctagggacggatattctggaaatctaccttaaaataatctgatgaagatgtaaatacaaaggtttttttttcccttaataatctgatgaagatgtaaataaaaagtttttttctcagcattgtttgaatgacaaaaaattaaaaactatgtaaatgtacctcaaaaagagtctaacagaataaataatgggatatcaattaaatggaatgctctcattaaagttatggtataggtatactttaattagtatcaaagtatgttcacaatatatctgcaagtgaaaaagatgatacaaaacatatagtaaaatcacattttaaaaatatatatttacatatgtatgactaaatgcttgggaaaacttttaaaaactgatatactcaagtatcaatactacctttgaatttaggaattatgggagatttcaatttttcccctatttgatgatgtgtaattttctaatccttttctataaatgataggtatttatattatttgggtaatttaaataacaagcaataatttgcaaatttattttctgactgaagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagtaagaaaactgcatcttttcctagcccttctagggactattatgctcagaaacacacagactcagagcagtcagggagcatcatagagtaatgagagtaagaattggaggtgtgcttttgtgtgcattgctgagagagaaagctatacagagaacaggtgtccaaagagaaatccattctcgcaaagccattctttctttcacacacagtgcctaaagcctccatagatggtgaaggctatagtgccaaaagtcagcccaaagagactacctcctgataaatcttggtttggtggagatgtgtggtcccagattttttcagggaaagtagcagtttggtggattctacatccagtacccaggctgtagatagcatctgcaaatgtaccaagaaacagtcttaaattggaaatggcaacagccaaccctcagggatgggaactgcagtgaatcactattgtgtgtgctgtctgagatggtgatatgcatgggatgtggtctaatcttgtgatccatcagaatcacttccaagccattaagaataatgtgtagcagctcaaattataataaacagtatcaggcaataaacacacaaatgacaaagaaaaattttctgtgcccgagtctatttcattaaaacaatgagggagacaaatctcccacttcagggtttgtattctgagatgttttcattgcaaataggaagactttatttacatgctaattacgtctgttccaattcaagaacctccatcagggaaatgacatataagctgagtgccatcattgtgctaaaagtttcacataccttctcaatgtaatccttctaagaacttcatggtcactataaggaaaagggtcttcctaaatgaggtgacacttggtctcagttttgaacaaagaagttagaaacgaatgagtagagggtacttcaagtcagggcacaatataccaaaggcatgagggtactgtagcaccttgacatgtagacccgcaaatatggctgagtgaaagctttttagagaggtgacagtagggaaactaggttgaagagctcagcaggacccagttaatgagagaccttgcatgctagatgaaggaagttgaagctcactggagaaactatagagaaccattgagcaattttaaacaagggcatgatacgaaggaagaggctaagactagagagaggagaccagtcagggaatgctgcaatgatttgggcaacaagtaatagtgttggcattaagtgtcatgggacagagaacaggtggatttgagagccattgagaattggaatccacatggctttctgactgctaattaaaactaaatgatgagtgagagagatgagtccaggatgtttcccaggttttgggcttaggtcatcgaatggttggtatgaaatatgctgagatggaaaactcaaaaggagtttgggagcacttattactctataatttttttcagaccatttataattttgaaaccatttagttcatttattggctcataggttatttcctacctccctatctgtaatgtcagctctatgagagcttggaaccccagtttcatgttcaatgctgtgtctccagtgcctagaatggggtctattcaataaatagttttcagtgagtaattaaacaattaaaacaaataaatgagtagatgtagggattgtcaacacaggcagaggggttagttaggctttggtgggggggggggcggggaaccaaaaaacatcttatccctgagtcagaagaaagagaggagggtgccctgcctataatatgaagcaatgggtcaagtaagcaatcctttttggccctgacattgtcctgagatgaatcatcctcaaagagggagaagctggcggtaagcacagagtgagggaaggaaatgggtcaaaagaggatgaacaggggcttcctaaaaagctgatggagaggactgggtgctaatgtggcctgagctagaatgtgtccgaactctcacactgggggttcaggcaggacgctaagtctgaatagtggtgctgaattggatccctgagctgtttctggtccctggatactctcagcccaccaggtgttgagactaccctttcccattccagctagagctcagtggaggtcctgagactggacttgctttttcaacccccatcctctgcccctcagatctggtagttctgaaatatcccctctcctagctctgtggtatatgaaaacttatttctgaacctatcagagattgctacatccatgtctgttgcctctggagctcacatttgatgctgtgttggtttgtaaatcagccaatacttgttgcctcccactactggatgggccctgtgctgcactgcagggatggaggactgagtaggacatgtctgcatcctgctgtagcttccttaccacttctcttgcctcccacagtctgcctcctgtcatgcagaccttccacaacacaaaatagatcataattctcctctgtgtagaatgtattttcgtcatttaccatcaattatcaacaacaaaaaaatccattcaaatctcctagctttcttttacataagaaaggccctttacaaagtgatgcaagttgatctccagctccttctcccataacttacccaaatgcagtttaaatatacatatacatatttttatgtatgtgtgtatatatgtattaaaatatatattatatataattaatatatatttatatattttttcctagcaatcctttatgactcaaaaatgctgtgaattctttgtgaagacctatgagggtgaggatagaggtgagggggctgccaggcagattggcctataatgctcctggagcaattcattcagtcctcccagggagcatctcacatatccgaccacacaagtctgtatgtattcaactcctcagtcattccacaaacatactgacatcttcttttctgcattcacagagcctaggtcatgtcctcccatggagaaggccacagaaattgtttacagaagaaataacaatggcagaggcccctgcagagcttagtttaggggaagacaaacctagaaacaatcacaacggtgtgattagtgtctcctcgatttattatttttagaggttctctatctaggagtagactttggaatgtcaatttattcccgttaggcactgttttgtattgtatatattatgcacactcctgcttttttgccatttctgttagtaactatgcctatatcagttctcatgctatacaacaaattaccatagatttagcatcttaaaactacacatttactacctcagagtttctgtgggtcaggagtccatgcatggcttagctgggtcctctgctggtacttgtagggctgggaccctcagctcctacagcctctccttgccataggcactgcacaacacagctattgctccttcaagtagatggagagtgcttctctttaggaagcgcctagtccctcttttcagggcttttatgtgattcagccagcccacccataatttcctattgataacttcaaaatcaactgatttggaaacttatctgtatatgcaaaattccttcacctttgtcttacaatgtaatgcaatcacagagtgctgtcctgtcatacactcacaggtcctgcccacactcaagggaagggaattacactgggcatgtacaccagggggtaaaaatcctggggattgtttaagaaatctgcctatcacaatgctttagtctgataggctcagctggtgctactaattacctgcacccaccttcttcctggaagactctgatcttcctgtcttccaaccatggcctctagagactgtgccagttacagaccttccattaaaatcctgaagactcaagttagcacctttctgtgggcaaaaaccatgggattatgggctaggaaggcattgccagaggtcagatcagagggtttcattcatatgtacgcattgtcttggagagtttgtaaacccctacagaatagatgatgcaacttccttggaaaatttaaccttgtatctcaggagacttccaggaaattctagtactaatcttaatggttctcacttattttaggaatattattcaggcaactactaagggccaagtactgagaataataagataaaattgttctataactaagccattccctagagagctgctcttgtatcttcagcctttattcagagattatccccaaatgacgtccacatgagggtttcaactcagggatgttttgcgggtaggtacaatcttagaatcttaactctgtctctcccactttcccactctccttccctctcttcttctctcatttacacacatacacaatgtaggatgcaaaggagtgaacactatttgaatataatctaacttatattttaaaattattccaagtctttggaactataactattattaaaataaaattttgcattgcacttgataatttatgacaaagaatcattccctcagacaccaagattaagtggtgtcttaatcttggtgtctgatactctttggaagatttatccaactgatactctttggaagattccacaggcagcattcttgtatggatacgagtattaacttctttttaacttgtaaatagtttgtaaagaaaaattctcaaggcagtcaaaacaagccattatagcagattttattttatttcctgttgtcgtccagttccttttattgcaagggtgcacaaaaagttacctcaagtaaccttcaccctgccgaattaaataactcatatcttttgttagatcacgtttcaaataagaaagtctgttgcagcatatttgaagcctctgggatctgtccaggttttataagtgtgcatgacccatattcaaaaccattaaaagcaagacaactaaacaaaaatccccactattaaccaaataaaatgtatctgtttgccaactctcaaggtccattagtttgtcatgagtggaacaaaatattaaaagaggtataactaatttgcaacagatgtgtttaccacaaaagaagggattcaaagtataaatgcaggtgtaagtacaggtgtgtgtgtgcacgtgtgtgtacgtgtgcctgcgtgcacccagctatttcggtattcagggggatggcaacattggaggcgcatgtagagtacagcttaacctgtgctttcccttggaaaggtaatacccatgggtcactgtgctgggttcagaaaggcccacgtacatagcacttcttttgtttatccatctgaaaggtctgtgggctatgaggataccttcagtcccatcactacggattctcacagagggttaactgtggctccaggtgccctgaacatccattcattcttgctataacttatttatttattcaacaaatgtccaactgaattctagaaatatgttggcattgtgccaggcattagagatagaatgttggacagggtaacattcttgtcctcaaaaagcttatggccaaggggagaagctgtccagacaaatctggaatgatgatggctctgatggagggatgcatagggtgtcacaaaagcacagggggcaggcattaagtagatatggtcagggttgccatgtagatggggggattatggaatctggaaagtagccctcaagctgagttttaatcatggaaaagagctaattaagtggagaataaagtaataggcatttcaagaaaatgaaacagcatgtggcagcacaaaggcataattgggctcagtgtgtttgtggagcaagttgttcaatggagctcaggtgaaggaggaagttgtagagaggtgatgaaagaaccagacatgagctaagctcctttgtgttaaactagttcacacttgcaagctgtagggaatcagaataatgtgaacaatggcaattaatattactgaatgcgtattatgtaccacacataatccttaagcattttacctatctcactggactatgtcatgcaatactcacgataaccctgtgagataggtactgtatattatctcccgttttatagatgagaaaacaaagacactgaaaggataggttatttgtccaaggtcacacaactaatagatggcagagctgcactttgacccagacaggctgggtcctgcacaccctcacctctcccattgtgctgtctgcggagcagtgataagcatgggagtgtcggggctcagaggaggtgcattctggccacagggtgcagagcagaatggcagtaggggaggctgagggggcacagaagagacaggctgaactcagtgaagccatctccaggactgccagggaggcacatgaggtaggagccttctgttgagagtaggtgcctgggcccagaagttctagctgttcctgatcttatcatgggtcacagtatgaagaccatgttagttttctatttgatgatgattcctacttacaaacaggctggttttagattcttaaactctggccaagaaggtccaattttctttccctaccctcctgttttttagttccctgccatttcttcattgactttcaaacaataaaactcctgtgttttccccactttttgctcagttaacagaatagtcacacacacactttcctgggctagaaatcttccctttggccctcgtctgacaggtcactatatccagtagattttttcttgtgaatctctctcaagtgtactctttccacctgcactgctctctcaccatctctagtcttgattcctatgaaagcctcctcgctgaccttcctgcctcccatttctccctgtttcagggctttatcctatattgccacagagtaatcttgccagagttaccacatcactgctttatccccttccatggcaactgaaacctgtagggtaaagcaacccccccaaaaataacatataaagaaagtcctttacaacctgacccccgccagcctagctctctttggtttaagtatgaaagtaatactcacgaattaaataaaaactatgaatatggtatccgctatatgtgttgtgcttacttttatcataaaagtggataagaagccaacaattgaacacagcaactttgagtatccctcagcatctcgtgccgctgctgcctatccctatctgtctggtgctctgtccatctcacctgctattctgaaaacataaaatatacctcatgcatgcctgagtcatttatgctgtgcctggaacagagtagagaatcaatcttttctgacctgaaggaatcgtttatttgaaaatggagggaactatttgccagagatagcattcagcccttaaatctgatgtcttgtctgatgaccacaacaaccaacaagctaggtcgacactattacagctccttttcagatgaagaacctgtggcttagagagttccacacagcccatctcttctcctcacattcctgtcacatacagaagtatgcaccaccccagacatgctagattcatctctgcctctgtgtctactcacagtctccaccctgccctgtatcagttatctgttgccacaataatgctacatagcaaaccacgcctaaacttagtgggttcaaacaacaatcgtttatcatttctcaggggtccatagggtggctgggtaggctcacttgtgcacctgcagtcagtggcacgttgcctaggaacagctgggtgaggatgacttcagctggggtgactgggttgtcctctgcatggcctctgctcctgcaggaggctaacctggcctggcctcatgacggaggcagatgtctaagagagaaagcagaagtacacaaggtccctaggaacttagcctggtcactttaacactttggtgttccaagtctggctctgaagctcacccctctactatgacctctagttatacccatataaggcttttcatctcaatgctcatggaaacaggcagcaatcaagactgattttaaaatatgcaaatgtctacatgaaagcagtgagtcaggcattggtgtgattaacagttttgaggaagtatcaccaaagaaccagtgagaagtctgctgcaaagttcaggtccaggaagcaggccctagaccatcacatgttgagaaaggataaaaagaacaggatgaaatgagatgtacttcacaggaagaatccatggggaaacatcaaaatgactttgtgttttctaactatacacaggcaaatggcagtaccacagctagaaattgagagcatttccatccttttcagtttggaatattacaggaaaaaaaaaacactatgcaaaaaaccagctcagtctttaaatgagaaataaataaaaatgagaagttcgtaattataaccttggaatggttacaatgttgttgcagtcagataattggtggaaagtggaaaccgatcagaaattccccagagcagcctgggcaacaaagcaagacaccatctctataaaacataaaaaaaaattatctgggcatggtggcatgtgcctgtagtcccagctacactgtagctggaaggtctaggctgcagtgagccttgatcatgccattgtactccagcctgggtgatagagaaagaccctgtctcaaaaaaataaattccccagaggatggcccattttcatgctttacgtgagtgttgacgagcctggatgctctaggacagttctcaaactttcaggttcagaaaccctttacagtcataaaaattattcaggcctccaaataggttttgttgaggttggttataactattgatatttaccatgtacataattaaaatggagaaattgtaataatatgtaccagatgatattccaggataagacatgcatctgtgaaaaaaaacagataagacaaagcccctgcttttatttttctttcattttttagagctgacgttcttttgagggaggccaaacaataaatatgttagcagataaatgtataatatgcagacagaatataataagtactatagagggaaatgaactaagggaagggattatggagacctggcctcttccagaaggaggcactggaaggaagttgtctatgttgcctgtgttggactccagctgtagggaccccatcgtggagccaggctggactcacactcatacctcacacatcttcccagcttccacaccctccactgaagttctcaacttgatgtctttgggcaacatacatctatgcacgtgaaaagccatgtgtcaagtctgtttctttttcataatttattgctattatcaataaagttgttagggttcaggacagggtgccatggaatactctgaatttagtgctggaaagctagaaaaacctatgatacggatttaataaaggattatgtgtaattcactaaaaccaacatataaagcacttattgtatgccgggccctgtttaagccctaaccctgggttcatagcccttctgcaatgccaaattgccccatggctcactgaattttatacagttcctgttttcctgctacccatccactgaagcactcagcaaaatatcacctgctaatctatttgatttctaggttgacacagtatgaattgggatagcaagtttggaaactgacaaattctgcacaatctgaatctaattggtttctgagtttggagagtaagcagtaagttgactagtgagggcgatatatactgtgtcccaggcacttaggataaatagagtctaaagtgcttgcaaggaaacaaagtgaataatcaattctagttcagcataataactgccctagaaggggttgcacagaatgctttaggcagatgagaatgaccatctaactgctctgcaggagcagaggattttgttttgaataatgagcaggtgtatcccgagttagcaaaggagagctaaggaagtctgagcaaagtctaaaacttgcgggaagccatggcaggtttggtgactagtgactagtgtgatgaggaagcgacaagagaggaagttgatcaagcactctgcatgctatgctgagatatcggaaacttattccatgggcagtatcatgaaatacccctaatttttagaataagtccatgctgacaattttataataatagcatgatattttataactgactacaagtctgagagccatcatctttgtcatctcagtgcctaccgtcctacctatcatctgattagtattgataaatgtttatgaacatgaatacaatccagatggttgaaaaagtcaagttttataacaccatttcaggaagcagtcaaaatactcagggttttaagataattctcttctctttaatgaattcatcactcttcccaagccaacctgcttttccttctctgctgctatctcatgtaccctatcaccccatttttgagtctgatttggtatcagctggttccctcaattgaatcagttattaagacgtgacttctccttttctagctgcttatatccatcactatttggatagctctcatctggatcatacttacaaactcattacctggtttccctctgtccttccccatccccaagccattctccaccagcagccagaccaatgtttcggatccttaactcagattgagtgactcccatacaaaggaataagtctcaccagatttggagagtgttgctattaaatcaggggaaaagtatttaaaagattcaattaagtgatacttatgtatgaatttacaagttatatgaaaagattcaaataagtgatacttgtgtatgaatttactgtgaggccttgcgccaaattctatcctaattgcttgtctgcaattctgcctgagggggaaacccagattctcattctctggtttgccagggaaaccttgcatgtcattgcctctgttaaaaaaatttgcatcttggctggacccaaaggttttaaatttatttcccatccttcctcaaccttttcttcctgctaattatctcttctcaagagaagcacagcagggagttttaacttacccttttacttgaacactgtaaatatattatcctcaaactccaaaagaaaaggaatttataaaacttacagagtatcagccctgaaaactatgtagagagcatccaacctaaacctcttgttttacagctgggaaaaacaaggttgggttgacaaagggacttttggggagacacatagagccaaaggctgagtttagaccactcacatctctgactccaagtgctgggtttcatctacaaaggaaggaataggagaagcagaaggaacatggggggaattctgtttctttttttccagaactatgtttccctgaccaaaaccatatatccactcttgtgttatttctccaagggttctgcattagaaaagaagagtagagggagaaagaagcatgtctgtgttggtttctgctgtattttattttattgactgatttattgttttgttttgttttgctttgttgttgttgtttgttttgagacagggtctccctctgttgcccaggctagagtatagcgatgcactctcagcttactatagcctcaacctcccaggctcaagtgatcctcccaacctcagcctcccacgtagctgggactgcaggggatgtgccaccaagcccaactaatttttgtattttttgtggagacgaggtctcactatgttgcgcacattggtcttgaactcctgggctcaagggatcctcccacctcagccttccaaagtgctgggattacaggcatgagccgctgtgcccagccatttctgctgtattttaaatgaacattttcttacggatgagacattaatatgccttgctcttagacatagtccctctgtagctgggctgcaagcctgctggcttttcttcaggcaagaaggatgggcaggctgggggcttcctagtcaagtcccatagtctgtgactaggtcccagagagcccattgccctcatccacccttctgcacacccagatcctcttcattctttcccgccacacacatacatacacgtcaccatgcccttggggctggctggaggggtcctgactggctgcctcccagctcagactgagctcagaggaccccatccccacgctttatggctgtgtgacctttccaagtaacttatacaagccttaatgtttcctcatttggaaaatggggattaaaatatctaccacttaaacttattatgagttctacattttagaaatatattaaaatatcatagtatcccccaccaatatatataattatttatcaattaaaaataaaatgtttaagaaggtttttttttttttaaaaagaattatacggggctgggcatggtagctcacgcctgtaataacagcactttgggaggccaaggccaggaggattggttgaggccaggagtttgagaccagcctggtgaatggagcaagactctgtctctaaaataataaaataaaaaattttaaaaaaacttaaaaaaagaattatatgagttaatgtaaagtgcctagcccagtatgaagcatactatatgtcagatgtatctgtcagatatttattaacttctctagcccttgtgcttgttccttaatagaaatagcttctggccttttctcacagccaatggaccttccctcttaccccataaaagtcctctatggtcactcacaggcttaaacccttactcgtcctctatgatcagcatagaaccagggaagagcagaggcttcacaagagacaggttaggcttgggaaactgaagaaaggtctctcgggctcaggtggaggggtggccctggcaaacagggcagatcattccccatcctacactgcagcctatggcccccagtagctcagtatggcagggggtccttctgttagcggctcctgcaatgcataaggttccctgttgtcccagacttctccacattccccagggctttcgcttcctataaccgaggctgacccagaacaatgttgacccagaggccacaggaaagcaacccctcaggctgatgaagcatgtcagcaggggagcatgggggcagctgatggctgagagacttctacagcttgcctccaagtctggctctggccacagtgtgagacaggtaaggccactgtgtccctgggagcagccagtgatgtcatgaccactgaaaggactgacttgctgagactcagctcttcccagctagggttgctcccacccccacttctgccatgtgttcccttcatgaaaaccttgggtcagattttttaatggaataatgggtttgaaagtatcttaaaagctttaaagtactttacaagttattatttacttaagataggcctgcagtcagaactctggaagtgcagtaatatttagactttagaaaaatatctgcttaaatgagactatttttttaattcattcaacagatatttatgaacccccaactcactgagttaggcattgggacacaacactatccatgaagttgaaggagtagagactagaagcctaggagcgggagagaaggacgatgagctagtaaataaaacagatgaaataattaagaatatgataagtgatctcaaggaaataagaaaagggctagagtagataattttcgggtggacatatttacatagtgtggtcacaggaagcctcttcaagacataatattgaaagtgagacttgaaggctaaataggagctaactgtgggaagatcaagaaaaagagcactccaggcagaaaattacaagtgcaagagccccgaggcagaaacacacttgacatcctggcaggatctgaagacaaccaatgtaatcacaacacagtgaggaaggggagaaaggtagcagggaaagtcacagagaaaggcaggggccacattatgtagattccttaggccaagggtttaggattttattttaaatatgatagaaagggtttagccaggctagtcacataatttatgttttcaaacagatcactcataccgctttatggagaacatactaactataggtaagtaagaaaaaatcagggagacaaagtagagactattgcagtggtctgggcaaaaagtgatgatgaatggattccagggaaaaaagaggtagtaggttgaaagtgagatgtatatttgagcattttcatgtaacattataatttttctttttcttttttttgctttttttttttctgggacagagtctcgctctgtatccaggatggagtgcagtggcgcgatctcggcttactgcaacctctgcctcccagattcaagcaattctcctgccttagcctcccaagtagctgcgattacaggaatgcaccaccatgcctggctaatttttgtattttaagtagagatggggtttcaccatgttggccaggctggtcttgaacccctgaccttaggtgatctgcccaccttggcctcccaaagtgctaggattataggcgtgagccactgctcctggccttatgtaacattataatttaaagagaagttatactatcaggatttgctggtgttggagaatagaaagaaagaaggatttctaagtaagaaacttggtttatggatcttgcctgaaatgggaaaagtaggcagaaagagagtttggagggtaaaagtaagagttctgctttggacaggttaagtttgaagacatccaagtagggacattgagtaagcaggtagataaatgggtttgggactaagtagatatccagataggggctgaagatacaaagttggtagtcatcattatttagaacttccatggtctcagagatagaatgggatgattcagaaagtgattgtagacaaagaaaagaggaggcctgaggataagagtatttaaaagagggagatgaggagaaactggcaatggacaccaagaaaaaacaatccagaaagatgggaggacaaacgtgagggggatatcccagaatcaagaagagaaagagttttgagggaaagtactgatcaaataatcaaatttggctgtaaagttgataaggatgaatcctgagaattgacccttggatttgccaacatggaggctgccggtgaccttgacagaaactgattcagaaaaatgggcagtggagtttagaccagtggagaactgaagtctgattagaatggcttagaggatcactggaagtgaggaaatgcctctttcaaggagttttaatataaagtggaagagagaaatggggccctgctagtaggtttttccaggatggatgatttactgaatgatccaatagggaggaagagactactgaggtaggaaagggaagataatttcaggtgataagttcttgagtaggtgaaaggggaagaggtccactgcaaaagtaaaggacacgggaaggatggcagagaatgtagggttgggagcagtttgttgatggatttggttgttgaaaattcattattcattcagaaaatatggaactactatgtgccagatgctattctaggaacaaggcatacagtagtgaatgaaacagataagacaaagcttataccctcatggagtttatattttattgaggggaattaagcaataatatgctaataacaaatgtatgtcagacaaaagataataagcactatggagaaaaatgatctagggtaaaggagtccctggagagctggagaagagggttgccttttttatagggtgacgggaaaaggtctaaatgaccaaggaccatttgagaacaggcataaaggcagcaagggaggaagtcatgtagatatttgtttccaagcagagggaacgaaaagtgccaagtccccaaggcaggagtgtgtttggtacaatctgagaaatagcagaagtcagtgtgatagaacaaaacgaacaaggtggagaagttgtaggggacaaggagagggagaacaaagagagaagcagtaggagaacagcttatatgtggctttggaggtaaaggcctgagctttatccatttcactctgagtgaaatgagaagccaatggagggtttcaagcagacacaggacatgatgtgacttacattttaaaagcacgcctttggctgctgtgggaattggactatgggaggcaagtatggaggcatgaacaccatgtaggagactgctacagtagtccaggcaggagatgatgtagttctcctaggattgcttctactttctcacggagtaagtgggaagatctccatgcgagggtatgacagaggcttgcagggagatgagaaagtgtgatagtcatatggaaagcatgataggactgctgcccacacagctggcatatagcaaacagtttgctaacatgcttgcttacctccgaacctctggaacccatctcactatgcatctctcttcctcctgtccagtcttctttccttcatcctgtttcttgtcctctgactccagttgaccttcagtgggctttaagaacccaagcactgattaggaaaatgacaacctgctgctgacacatccagcattttttttttttttttagacagggtctggctctctcactcaggctggaaagcagtggcacaatctgagctcactgcaatctccacctcctgagtgcatgtgaccctcctacctcagcctcctgagtagctgggactacaggtacacgcccccacacctagctaattattgtattttttttttttttagagatggggtctcactctgttgcccaggctggtcttgaactcctgagatcaagtgatttgtctgccttggccttccacagtgctgggcttacaggtgtgagccacggtgcctggtccacatccagcttcttataccaaaccctttcaaaggatttgaaggagctcctcagagtgctcagttgtcctttaaagactctatctaactatcattccactacctcacacccagaagtcaatgagggaggcccagcattcctatgctcttattaagactactctttcctacccataatagaaacctcagcaggatttgaggtagacctgcaagtttcctcatgctcctagcaagaccaccactccctgcttccatgacactactcatctcacaacggatggcctgacaaggcagtcccaacaagaagtccacaactggattggagtggtgtctcatgcctataatcctagcactttgggaggccaaggcagtaggaccacttgagtcctagagtttgagactagcctgggcaacatagtagacctcatcattgcaaaaaataaacaaaattagctggacctggtggtatgcatctttagtaccagctactcaggaggagaaggtggggggattgcttgagctcgggaagttgaggctacagtgagccacgatcatgccactgcactctagcctgtctaatagagtaaaaacctgtctcacctgtcttaaaaaaaatgtccaaaattagaactgatgaccgacttatcttgaaatgaccagtagagctgatcttatcctgattcatatcaatcttcaaggaggaagaactgaccatgctccagaaagatcaagtaaaatatggacacaaaaggtctatttgagttttcagttataaggttcctggtaacattataaagaataatttctatggagttatggtgaagtaaaagaatgggaggtgaagatgtagatacagagtatagcctactctgtaggagaagctggctataaaatgatggaaagagaaatgaagcaactagaaaaaggtgcctagttgaaggtgaattgttgttgttgttttaatataggctagatgcttataagctaagaatctagtaacaaaggagaaattaaagataacagaaaagggataattcatcaaggaagtctagaagaagccaggaaaggatgagatcacagtacaagtgaatatattagtcttggacaggagaaatgacacagtttcttctaagatgtgtgtgagggtagcgacaggggaacaactaaagaaaagtttataagtgaggagaggaagtgaaaagagttcatgtctaatggtatttgttttttcaaaggagttaatctgctgttggtgaagggactggccagggcggggtgtgtggggcagtgtggggaagatataagatagctattgtgtgaagatggtgggctaaccatgaagaccagtatggtatttagggctcagctgacatcggagaccccttatgtgtagtggcaccaacatacaccactgtgagattttctcctccatcaacactcaactccgggacaaggcagatgtttgaactcatcctaggccagggacttgtgttgggtggatatggtggcataactaggggttgatgggtgagaatgctggtgagagagctattacagtggtttaggctgcataggaaagaaagcaagatgaagagagggctgatgacctgggagaaagtagaggccaagggactggaaggcatgagcaaaggagtgagcaatggaagaataactgtggtgagtgggatattggagttttcgatttcagatacggaatagttgtggggaatgggagattcagagtataacccctggaggaggatactaatatggtttaaaagtaagtttccatggaattgaagaggtgggcatgctccatgcatatagggtagtgtcctggagaattgccaatgatttagactgggaggagttgacagcacgagacacaaagcatgaatactaaaaaggaagagtttttgctgtaggtgggaagaatagtagcctgaagtggcactaaggagctagaaaactgtaactccttcgttttacttcatttttctcctttcttccagtttagatcctttatcatcccatttggattaaagaaatattctactaattgatttccctgattttggtctcactctaagtgtccatcatacacaggacttctagcttgaccttgtagaacagtcttgacagcctttacttcactcctgctcgcaaacttcagtatctctctgtggaataaaatccaaatttcttagcctggcccttaaggttccaggcatagagatggcttcaatctactacaattgacccttggataatacagttgctaaggttgctgacccttgtgcgttgaaaatttatgtgtaactttttttttttttttgagatggagtctcgttctgttgccaggctggagtgcagtggcatgatcttggctcactgcaatgtccgcctcctgggttcaagtgattctcctgcctcagcttgccgggtagctgggactaccggcatgtgctaccacacccagctaatttttgtatttttagcagagacagggtttcaccatgttggctaggatggtctcgatctcctgaccttgtgatacacctgccttggccacccaaagtgctgggattacaggtgtgagccaccacgcccagcctatgtgtaacttttaactcctccaaaacttaattactgatagtctgctgttgaccagaagactgactgataacttaaacatcaattaacacatattgtgaatgttatctggtcctttcttatttacaaatccagacaaagagaaagctgcctctgaagtaatgcattacagctggaagaaagagccctgtggctttgttcttaaaataaagtaagctaggaaaagaaaatgtcattaagaaaatcataaggaaaagaaaatagatatacggttcattaagtggaagtggatcatcataaaggtcttcatccgcatcatcctcttcacaatgagtaggctgagaaggaggaaaagaaggggttggccttgctatctcaggggtggcagaggcagaagagaatccacattttaataagaccggcacagttaaagctcatgttcaaaggtcaactgtactttgctttatatatctagtttgaagcaatatcaaacattagcttgtattggtctaaactctacacttctttacctaatcttagagtactttcctgaaagtggttttgtttgctgtctggaatgcttctccactcctctgaatattcaactccatttatccttcaaggaccaaatcaaatacagattcttccctgcatcaaaggacatttcctttccctattcttcttaaaattccactttactccctatattctagttagtcctgtacctaataagaaagaaccatgcccaatttatgctcataaccccagctcataatacttcgctcattatcttgctccttgtaggtatccagtgtctgctaactaaatgcattcatacattcatgaataaataaatagagctcttataacgttgcagtcgtgttaagggtcagaatccttcactagaagataatctcgaggtttagggttgatattatattttttatcctcaatacttagcaccattctggaaacattgtaacctaagtacacagtacaataaaatcttggtaaatggaattgaattagtgtcttcacacctaagtcattctcactgtgtcaatcccaagtgctctagagagtgaacacggtctctgaaacagcaaatagctgttaatatcctgaagtgagtaaaatgctgcctcttagaactggatagcaagtctcttaacagagactatttatttattctttcattcgttgagtcataccatgaattgcaattgatctatatccaataactattatagacactaaggagaaaacaatctgtgaaaataaggaggtgaaagaatgggcttggcttcttgctgggatttaaatgccctttttcttaaggaaacaaaatgcatgcctatgttgcattttcgctctaggattttccaagggaaacccttcttctaaggacggtcatgtcacagtagaactgaaaatattccccatcagtattagacctgaaaggaaacaagatttaccaagcatggggagccttccagaaagcagacagctcatgtttataaagtaatctctcctttttctcctgtttggccaggctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaataacctcatcaggttatatttgcccacataccctaagcac

SEQ ID NO: 38182 - DNA, 81292 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtacgggccagcgaggcagaggccgcggggccctgatggggagagacgctcgctgctcgggctcgcgggcaccggccgcaggcggcggggtcggagtccgcggctggttcaggtctcctcccgccgccgcgcctgcccgccgggcctagcctcagccgcgccccgcgctcccgcagcgcgcggcctgaaagggcggctcgtgggccgcggctccagtagctgctgggagaaccagtggcgcgcgcgtctgcgaccggcccggccccctgcccgccagcccgccgcgtggctgccgccgtgtccgccccgaccttagggggcggccttgagccgtggccgcctgcccggggcgcggggaggtcggctgcggctccgctccgtccggcgagctccggacgcggcggggcgacccgttagctggtgggcgttcgctgtcccttacgcggacagggaggaaggggtggccagggcatgatgggccccgcggaggaggaggtcgcgcggggagcagacaccttgctgccgggtccgaaagctccttagacacccttcctggagggaaccgcagtccgcaggccagggctctgtccccgggctcgcgtttcggggctcctcggctcccgaacccattcgcgcgggttgtgcgtggctagggtgcaagtctagattttcgtgtcaaactggggttatgagccgtttacgagtcacttggacgatagtaaggcctgatcactctgaaagtgtctgtagtgtgaagtcacctgatccttggctccctggttttgctgaatgtgagctcctactgtacgtgtaccaggagcgcccctgccccctcgaagacgcagttgcgttggcagcgcagtgtatccctctcactcataacacccctatttataggagtttagcgtttgatctctcactgtggtgcgaattgatcgcatgaaatcctgattgaaaattttgatggtacttaagaaaggcataaagttttttcaaaggcttataaatagtaaaagcctacgatttggtaagtacggccaagataagagtttattattaaatacagatacgagctcgtgtcttaagatttctttttttacggtgtgtaaaggttttgctggataaaatgtaaagcattttggtatgatgttaaccacaaggactcactttaataggaaagtttatttgaaatatacttcatcattcctggtagttcttggcgcatgtcagaggtgatgacagactggagttttgctaagggaagaagaaaaggaaataaagcttattttattattgtctgccaaccaaaacgcttgactgtttgtacagtggtagcactctgtagaataaaaaactaccaaagaagcagcttcgccttagatgtgtgctggttggatttcttaagtaattaattgttttggaatgcggatggattaatttcgctcttttggttggaccctaggggaagaagtgtgtgttcttttctttctttctctttctttctttcctttttttgaggtaagagttttagatgcagtttcaaaatattctatgtatttaccttattagaagaaacataaatttatacttcagttatggttgtgaacgttgttgtgctgtggtatcttgagaagagatgatactcttcagattgttgttgaaatagggcccaccatttattatttaataaatgcttttgtctgctactcataggtttttgtcctttgttttttaggacggatcagcaagaccttcacttgatagccattcctagcaaatgattgcctaaaacagtccctgtacctgctaatttgctccgagtcactcattaatgagttaaaaactaaatgagcttggtaggatttgtgtttaaagtgagaagaaacagactgaatgaaaaggactcatctatttttgactgtgtagaaactctttgtctccctctgcttcctggagaaatagcttcaaaaaccaagttggggtcaagtgtcacttgagtagtttagtgttagggagaggctttgtgtttattcttttaggaatgtaggatctttagaaagcaaataagtactcattttattggctttttaagttgataggattctgtagatatgattaaatctatttagtaaagtgttttgaaattcttcgaaattatttagggagaagtagctgccttacagtaaagatattatagggaaaagaaaccctgagtgaaaataagattatggccttaagtcgagtgcacataggtgtatttcaggattcgtttttctgtgactgtattgtaactttaaagttttggaatattcacaagtataagtaactttcttgaaattgttagaccttttccaaaattaggctttttccacagttggtattaggcagctagctgctaagagtacggggagactgattaactagtttgataatgctggatggagttcaacatatattttttaaattttgggacttcatagcaagatgtattaaaaaattgttgatggtcatttggaagacctgtttgacacacacaattgtcagcaaagctgtttgtcaggcccttaaaaagttaagagccagaaatgtaaggcataggagtagaagttaaactttttggtaatggtggtttagagctttacagcgcaaagattttctccagataggtgcagggaagcagctttcttcttttctttcttgtttttaacgtgtaatggtattctgattttgtagacattttgggttttcaaagtccaggtgtattatttactttctagaaaatttgagagttatttactttaaggaatgtagatgtgaacatagaataactgaacttgattccacagtgaattcattactttagtagttttcttcctatccgttagtcctccacacagcacatgatacacaacactcgagggctttctctatggctttaaaaatggatagcaggctgagtgcggtggctcacgcctgtaatcccagcacttttcggaggccgaggcaggtggatcacctgaggtcaggagttcgagaccagcctgaccaacatggagaaaccccctctctactaaaaatgcaaaattagctgggtgtggtggcgcatggctgtaatcccagctatttaggaggctgaggcaggagaatcgcttgaacctgggaggtggaggttgccgtgagccgagatcatgccattgcactccagcctgggcaacaagagcgaaactctgtctcccccataaaaaggatagcaggaagaaagtaccaacctgaaaatatgatggcaataggataatacttggtagatattatagaaagaagtagaacaattagtaaaggaagtagaacaattctgtttgttatggtcatggagaagcatgaagtattcagaagtgcaaagccaaaataacttttacagatgattttccaagttatggaacgtgtctctgtgtgcttgggtatatacacatattgctaaacttggatacagttttttaaaaatgtgtgtatttaagtagccaccttcactacctactctgagacaaatggctgtgtggtgtatggtcggatgatagttactagaaacaacttttaagtcataaaagactaacatcctctgttttcccaaggagataatatgtacttttgattgaccttggatttggtcttcggaccagtacaagtagaatgtaggggattcccttgctaagctactagcttaataaaaagtattcatacaactcctgttcatacaactttatgattggtccccaaacaaccacttagaggctagctggatatcctgctggccagtaactctaataacttgttggagaagtatgtaactggtgaagaatacttatctaggttctctagtaacattttatcttttattgcaaagatgctctgattgtggcggcaatgcttctttaatcatagggaggataatgtagtgggaaaagaatgaggaatcaaatgagtgatttcacttaagctctcagagcctggagccctcatataaggtagtgataatccgtaacaaggctgtcgtgggaaacagatgatagggtgcaagtgttttgtagtactttaaagtttgtaaaactgtcttaaggcacagtaacatatatgtaagaatgtaccagtgtgactacttgtgttattatgctattatatataatgtgtatatttgcaataaaaagttataattttttcctgtggacagagatttagtttgggcaagggtggtaggcaagttttaaattttagctgtaaaatgctgataatatgttcatgatagggttattgtaagtatcaaatgtgttaaaagtgcttaacccactgccaaatattctgtcggaggtggttattaccataatgggtggttatttaagatgagactttgaactaaaaagtaattttcaaaataggcaacttggaaggtgtttgttcagttattaacataagatgtgatcattcatgcttcttagctatcttcattttaataaatgtgcattttagacaatcctgtggcaaagtagttcttctggaattgtttatttcaattgcaggatttcatatgagttaatttcatagtttaaggttatggcagtttccaagtacagttgtcccttggtatccatgggaaattagttccagaacctccctctgatgacagaattcaaggatgttccagtccctggaacatggtatagtatttgcatataacctatgtgcatcctcccgtacacttgaatctctacactataatacctaatacaatgtaaatcattgttatactgtatgcttggggaataatgacaagaaaaaattgtacatgttcagtacagatgcagttaaataatttttctattcctggttggttgaattcatggatgtagaacccatagatatggagggctgacttgactgtatagtgcattggcttttcaaacagtaaatctgcaaaatctaacttgggtctgttatgcacaggattgccaaaaaaaaaaaaaaaaacaattaacatgaaaccatactaacagtgaatctcataaaaaccttatttttcccttcatttaatcctttagaatagagtcatggacagtgattagaactacatccatctttaacattttaacttgagttctgcaaacttcctatgatttttgaaatggatttagaatggaggcttggattttaatactaggtctatgatgttttatttttatgtatttatttattttgagacagagcctccctctgtcacccaggctggagtacagtggcgtgatcttggctcactgcaatctccacctcgtgggttcaagcgattcttgtgcctcagcccctgagtatctgggactacagacgcgtgccaccacgtccagctaatttttgtatttttaatagagacagggtttcaccatgttggccaggctggtctcgaactcctgacctcaggtgatccacccaccttggcctcccaaagtgctgagattacagacatgagccaccgcaccctgcctgggtctgtaatgtttttctgtaacatttttttttttccttcccagtggttaatatctaccctagcaaacttacagtaatttttttaaaaattttgttttgtttctatgttttttgaaacgaggtcttgccctgttgccaaggctggagtgcagtggcgtgatcaccgcggttttgacctccctggctcaagtaatcttcctgaatcagcctcttcagtaactaagactacaggagtgtgctaccacacctggctagtttttaaaattttttgtggagatgtggtctccctgtgttgtccaggttagtctcaaacttctggactcaagtgatccttccatctctgcctcccaagtgttgggattacaggcatcagccaccacacccagccatttctttctttcttttttttttttttaattaaagagataaaccctataaatgccatttagaaatttgaaagccttctataaagaaactcctcaaaggaggaaagttggcatggtaaatggagagctttttaaaaatttcagtgaatgaatttgtgggatgccaaaagttggtttaatttcacctttatcagaatgggggagttgatttttgccatttcctaatcttttttatctttttgtatttttttccttatttttttcccccccgagataggggctagccttgttgcacaggctggagtgcagtggctcaatcatagctcgctgcaaccttgaacttctggggtgcaccccccacccccgccatttcagcttactatgtagctaggtctacaggcttgcactaccctgctgggccaggggttgatttttttgttttgttttgttttgtttcgttttgagatcgagtcttgctctgtcactcaggctggagtgcagtggcacagtcttggctcactgcaacctccacctctgggttcaagagattcttctgccccagcctcccaagtagctgggactacaggcacccgctaccacgcctaatttttgtattttttagtagagacgggtcttaccacgttggtcaggctggtctcaaacttctgaccacaagtgatccgcccgccttgggctcccaaagtgctgggattacaggcatgagccactgtgctggctgggttgattttttttttttttttttttttttttttttttttgggacagagtctcactctgtctcccaggctggagcgcagtggcgcgatcttggctcactgtaacctccgcctcccaggttcaagtgattctcttgccttagcctcccgagcagctgagattacaggtgcccgccaccgtgcccggctaatttttgtatttttagtagagacagaccaggctggtttcaaactcctgacctcaggtgatccacccacctcggcccccaaagtgctgggattacaggtgtgagcgaccgcccggtcttgattttctttctttttttttttttttttttttgacggagtctcgctgtcgcccaggttggagtgcagtggcgggatctcggctcactgcaggctccgccccccggggttcacgccattcttctgcctgagcctcccgagtacctgggactacaggcgcccgccacctcgcccggctaattttttgtattttttttagtagagacggggtttcaccgtgttagccaggatggtctcaatctcctgacctcgtgatccacctgcctcggcttcccaaagtgctgggattactggcgtgagccaccgcgcccggctttgattttttttaatgacaaatccgagaggagttttgacgggaaaacacccctgttcttagaattttttcaagatggctattaatagcatcttcataaattgctgttttctttttatcagcactttaatttttattttttatttatgtacttatttttgagatagggtctcaaatatgcagcctccaccttctgggctcaagtgaacctcctgccttagtctcctgagtagctgggacttacaggtgtgtgccaccatgcctggctaattaaaaaaaaaaaattggccgagcatggtggctcacgactgtaatcccagcactttgggaggctaaggcgggtggatgacaaagtcaggagttcgagaccagcctgaccaacatagtgaaaccccgtctctactaaaaaaatttatttattttttctttgagacagagtcttactctgtcgcccaggctggagtgcagtagagcagtctcggctcactctaccttctgagttcaactgattctcgtgcctctgcctcccaagtagctgggattacaggcatgtgccaccacgcccagctaattttgtatttttagtagagatgggggtttcactatgttggtcaggctggtcttgaactcctgacctcaggtgatccacccaccttggcctcccaaagtgctgggattacaggtgtgaggcactgcacctggcctgacatgtacattttcaagaaaaagctagatccattcagaaaggttttacccatttattcatcagggttaggtttgtgcttgtttgcaagtatctttgttcacagtgggtgttaattaaaaataaatgccaacatataggtaaaaatgggcatattacagtttaatttgcaattttttgattgtagttgatgttggaatagtgatatggaaattgaaaatgtgaattagtttatttacttttttagagatgaggtatcactatgttgcccaggctagtctcgaactcctggggttaagcgatcctccaacctccacctctcagtgctgggattacaggcgttagttactgtgcccagctctgacttctttttattaattgctttttaatattttttgagcatttcccagtatttcttttattgttttgtaaaagcctgtttgcatgcaggaaattatttttcatatttgctttttaattttgtatttttttggtgagaattgtgtgtgttggtttctttcatgtttttcttaaataaattggcaatttttttgaacttattagtggtagtcttagtctttaggcatgctattggagtgcttttaaaaagttgttatggctgggtgcagtggctcatgcctgtaatcccagcactttgggaggccaaggcgggcggatcacctgaggtggggagttcgagaccagcctgaccaacatggagaaaccccgcctctactaaaaatacaaaattagccgggcgtggtggcacatgcctgtaatcccagctactagggaggctgaggcaggagaatcgcttgaacctgggaggtggaggttgaggtgaactgagattgcaccattgcgctccagcctgggcaacaagagtgaaactccgtctcaaattaaaaaaaaaaaaaaaaagtccttattttagagtccaggtgcggtggcttacgcctgtaatgccagcactttgggaggctgaggtgggtggatcatgaggtcaggagatagaggccatcctggctaacacagtgaaaccccatctctactaaaaatacaaaaaattagccgggcgtggtggcaggcgcctgtagtcccagctgttggggagcctgaggcaggagaatggtgtgaacccggaaggtggagcttgcagtgagccgagattgcgccactgcactccagactgggagagagagcgagactcctcaaaaaaaaaaaaaagttgttttaggccgggcgtggtggtttacgtttgtaatcccagcactttaggaggccaaggtgggaggatcacctgaggtcagaagttcgagaccagcccggacaacatggtgaaaccccatctctactaaaaatacaaaaattagctgggcatggtggcaagcgcctgtaatcccagctactccagaggctgaggctggagaatcacttgaaccctggaggcggaggtggcagtgagccgagatcgcgccattgcactccagcctgggtgaaaagagtgaaactccgtctcaaaaaaaaaaaaaaagttgttttaaatgggcggttttttttttttttttttttttgagatggattcttgctctgttccccgggctggagtgcagtggctcactgcaagctccgccttccgggttcatggtattctcctgcctcagcctctgtagtaactgggactacaggcgcccgccaccatgcccggctaatttttttttgtatttttaatagagacggggtttcaccgtgttagccaggatgttctcgatctcctgacctcgtgatctgcccgccttggcctcccaaagtgctgagattataggcatgagccaccgcgcccggccttaaattgttaatcatatattgattgtttattcgtatctctttttattgtcggagagtgggcatctgtttcagtgcctagtagcgtggtagaagaaaagcaagcttagaagctaggttcagatctctacaaataagttttagtttcttaaaacctaaaaaaaaacctacctgaaaagttctaagattaaaagataatgtcttggctgtgtgcggtggctcgtgcctttaatcccagcactttgggaggctgaggctgcaggatggagctgagcctgggcgacatagtgagactctgttgctaaaaaaaataataatagtaataaagataatgtcttaaagtgtttggcatgtactaagtgcacaaagttatcatctcttctcttgagggtaggacatgaaggggctggggttagttttcttttgggactagaggccggaatgggacaggcaaatagaggaccatacttagacaaataattagcttttttcccttgatagttttagttgacatactgtgtacctaccttataaaagggcttttgagctgcttatagtgaatacctacaaaaaataatgtagacagatgcttgttctaagctttcacgtagatcatagagactttatgcatatttgtgagttaagtttatcgttaagcttatatgttctgaagtagaaattgccgtgtgctagagttgttgaggaatacttcatggaagagggaggctttgtcgtgctttgaagaatgggtagatcttagagagcaaagtgtaggctatgccactggtttgaagataaaaaagataggcagtattttggtaactttttatgacataatttaaacatttgaccctgatttctgagaattttcaatctaaaagagatgcttaaaaaatacttaaaagcaattagatagaggcaactgaaagaccaaatggtattagagtatgtttaataaaaaaaggaatggggctattttcctgtagccaaatagagcaaataattggtttaagtaactggataattcctggaaaaattatctgaggagctcaaaatgcaacttaaaaactgtgctaacatctccttccttcatcctgtttttgagcgtgtgtgtttatttactacaaggaatcctgtcatgtaccctcaaattgccaaactaagaggggacaaaaggagagtatagtgcgaagctctgactttatctttgttttttttttttttttcaaattagtcacattttatctagttggaggggtgtttatttgtctccttttggcaccattcccttcttttcacggctgctcttgtagtaggaattttgtctgtattgagccaagtctggaatttgagtgaatacttacctctttttttttgagacagagtttagctcttgtcgcccaggctggagtgcaatggcgcgatcttggctcactgcaacctctgcttcccagattcaaaccattctcctgcctcagcctcccgagtaactgggattttaggtacacaccaccacacctggcgaatttttttctttttgagatggagtctcattctgtcacccaggaatgatctctgctcactacaacctctgcttccagggttcaagtgattctcctgcctcagcctcccaagtagctactcccaagggactacaggtacccgccctcacgcctggctaatttttttgtatttttagtagagatggggtttcactatgttgggcaggctggtctcgaactcctgacctcgtgattcacccaccttggcctccgaaagtgctaagattacaggtgtgagtcactgctcctggccaattttttgtatttttagtagagacagggtttcaccatgttgccaaggctggccttgaactcctgacctcaggtgttctgcctgcctcggcctcccaaagtgctgggattacaggtgtgagccactgtgcccggccttctctttttttaaactgctgctgtaacagtcatctgaggtagagagatgtggcagaatggaacttagtgtctaaatttccagagtattggcttaaagctttttgaaatttgtcatagtagccctattcgatctaagtgtctattctaaatttaaatattctaaatttgtgtgtgtgtgtatttgtgtgtgtgtgtgtgtgtgtatttgtgtgtgtgtgtgtgtgtgtgtgtgtgtgtatgattcccttgctaactggctatcccaaatttcagagttcttttatggcttgatactttacaactcttaaagtaatttttttttttttttgagacggagtctcgctctgtaccccaggctggagtgcagtggcgtgatctcagctcactgcaagctccgcctcccgggttcacgccattctcctgcctcagcctccctagtagctgggactacaggcgtgtgccaccacgcatggctaattttttgtatttttagtagagacggagtttcaccgtgttagccaggatggtctcaatctcctgacctcgtgatccacccgcctcagcctcccaaagtgctgggattacaggcgcaagccactgtgcctagccaacaaagttattttttgagcctaaaagagaattcttaaactatatgcctgagtcaaggaaaccttctgtgttttcgattaattcttgatccgtgtgctacaaaatcttggagctcttagagtcattgtactaaaaatacttccggaaataggaatgtagtacattgtcgttttataaggcatgtaagaaaagtgagtgtttcatataacaaatatggaataatttggcctaaggccacagagaatgatgtttaagaactagctcttccatttttactgtcacctcttgactttgggcttctcactttatattcgggctcttgaaattgccttatatctgatttgcgcattacacttcttactcatcactttgagtttatctctgcaacacagctttgactctctctcctctgctctgaaattgtcagtggtattcctcagggttgatgtccaacattctcagactatacttttatttttattttattttattttattttttgagatggagtctcactctgttgcccaggctggagtgcagtggtacaatctcggctcactgcaacctctgcctcccgggttcaagtgattcttctgcctcagcctcctgagtagctggtattacaggcatccgccaccacgcccgggtaatttttgtatttttagtagagacagggtttcaccatgttggtcaggctggtctccaactcctgacctcatgatctgcctgccttggcctcccaaagtgctgggattacaggcgtgagccactgtgcccggcctagactacatttttaaagttagccttaatctgatcctcagggcttaagaggtgcagccgtcttcagaatgtctttattgataaccctagtttagataatccaaaaagggctacttttgtactcaaatagcatttcctttattttacagtatccttttatactttttgtgttagaaccgttaagagtaaagactgttattattgaattatacttctgtctagtatagtgccttgctctctagttaccagtgtgaagtaggtaggatgggaggtcttcctcgtaattcatgacagattggatagtaggtgtcctgagaattgttggagttggtgaataggaaacagtgagttacacatttacttatatttaaatatatgtgcttatcttgccaaagatgggcaaatatacttttattgcatcttatattttaaaggtatgcaatttaatacttgcccttctagaaagtttatgaagaaaaaattgttccccaaatattgggagactgtgtaaatgatttgctgactgtataaatacatattaactagggaatttttggaaaaatagctgtatgccaagatttgttataaagatgataaataacccccccccccacctttttaataaacaacttgtatttttggtagcttttttcaggtttctagaagtactgagcatataagaattcagatctgagtttattcagcagacatgctcatttgataataaagatgctaacagtttggcttagttggaggatgatgcattttgacaattagaaagacctggttgtgcatcctcagttgattacttacaaaatgtgtatcctcgcagattgctttatctgagcttcagtgtactcctttatggaaacaaggaaactcatagctactccacaaagtgattttgaggtttaaagagataataggcacatagtcggcactctgtgtttttcactcttctgtagtaaaagctacaacacctaaaattatttcatacagtgaattattttgagggatgagaaagttactaataatgttttcctcttttcctccagatgtccatgtctttcagttctttgctcaaatgtcatcttgtaggagaagttatctgtgactactgtcttcaatgacaactcctgcctccatttcccttggctcgctttacttttctctgtagcacttaacactagctgacatcacacatatgttttctattgctctgtctttaggatgtaaactcctaagggcaggatttttgttgttgttcttaattttgttttactactgaatctgtagttctcagaactgtgttgtaggtgttcagtgactattgaaagaataaagatttatgcacctccagttctagacctttcaccccttgtgtcagaattagcatggtgctggttagtggggtgcttgttaaaaatgtagatttctggactccatggatcagctgaatcagactctggaggtggggtctaagaatctgtattctgagccagttacccagatggttcttaaactctagtgggtgtgagactcactgttgtacggtgtggctgtggctaattaaatattgacagtattaactcagtcataggcccatgataaataattgaattacaaatgtgttgaccattctttagtaagcagttttttgccccgtgatatgtctggtaaggaagggttatgtgtatttgtaattgtgattattttggttgctctagttttttcctaaacatctagtttaatctggaactttagggagctagaaatctcaaataccagatgttagcgaatccacctttcccaagcaaaaacaagccctttaaacctattcttattctgcgcttgtagttttttactcataagagtcgattagctaatactagggatttattttaaatgataagcatcattatgtggactgatttgagtctcctttctatggctgtatcactggggaacagtgattgatctgtttaagaattatcctataacatcgaatagcagtttggtatagtggaaacagcatgggtttaaaagatagaaatcttgatgcatgcattaccttttaactgtagaatcttaaataatttttaaaaaaacatcttcgaagatccacatttcctctctgtgaaatgggactaatagctaagttactgggttgttgagaggattatttcattgagtcatttcagtaaaggtaagttttcttgcctgtctgtggaagtaaattttgaggcaaattaaaatgtttcattaaaaacaattgtaatgtatttcaaacttacaaaaatgacagagaaagataaaatagatacccaagtagccattgcattaatctaatacataatatttgccatattgattttgaatcctttttaaaagagaaaatgttactgtgcagttgaatggttcacccaataacctttctcttttaccctttcttcgtagatatgcacctgtcctgaaagtggtgtatgctttctggtttttaaatagcttataacatttgtatatttcataaataatatacagtattgtgttgtgtttaaaacatggtgagtggttcagactgtattttgtagcttgatttaatttaaattttttttttttttttttttttgagacggagtcttgctctgtcacccaggctggcgtgcagtggcgcgatctcggctcgctgcaggctccacctcccgggttcatgccattcttctgcctcagcctccctagtagctgggactacaggtgtgtgccaccacgcctggctaattttttgtattttttagtagagatggggtttcaccacgttagccaggatggtctcgatctcctgacctcgtgatccacctgcctcggcctcccaaagtgctgggattacaggcatgagccaccgcgcctggctgcttgatttaatttttttcattccacgttggtgtggaagcttatccatatgtaaatatttagatcttatgcattaatttcaattctctgacttattttttatttatccatgggtatttaggttgttccaatttttttttttgtagttaccaacaatactttggtgaacaaggaaccatgtttcgttcttcttgtatatgtatgcaggaatttctctaggatataaacaacttacctaaaaaatattaaagtaagaaagtttcaatattgtgtactctcattctttaaaaatctggtccacataacaaaagtatgttctccctcatttccccccaaaaaagtacctaagagcccgtctaagacccttttttttggtcttgacttgaggtgagattttcttcaagacttctctgtagaagaaaatgaagagacttgcagaacctgaataaaatgtctgaatttctgtcttgttgattatagagttccccgaggctgggtgtggtggcccactcctggaatcccagcactttggggaggctgaggcaggaggatccctttagtccaggagtttgagaccagcctgggcaacatagtgagacctggtctctacaaaaactaaattagttgactgtggtagtgcatgcctgtggtcccagctactcagaaagctgagatgggaggatgtcttgagccttgggggtcaaggccacagtgagctgtgattgtgccactgtactgcagcctgggcatcagagcaagaccccatctcaaaacaaataagcaaaacacccaaaatcttaaaaaaaaaaaaaagaatcccctgagccatcgcttattctagaatctcctgactagctaacaaagttgacttcctaaattttaacgtcatttaaaataccaaatttaaatttactttagtattctttttttttttttttttttttgaaatggagccttgctctgcccaggctagagtacagtggacgacgatctcatctcactgcaacctctacctcccaggttcaagtgattctcgtgtctcagcctcccaagtagctgggattacaggcatctgccaccacgcccagctatttttttggtatttttagtagagacggggtttcaccatattggccaggctggttttgaactcctgaccccaagtgatccacctgcctcggcctcccaaagggctaggattacaggcgtgagccaccgcgcccggccaactttagtattttttttaagtacacttacatattcaggtgtatgcttttaagaactgggtaatatttgatgacaaactttggggaaaaatacttttgagtttatacatttataaaccattttacatttttcttcgtctattttaataaatgcataaaagtattttttgccttagtgttctttaagtgggaacagcaaaaattctgtgacatcagtggtagttactatggaaacggggtacatttcaagtggaaaatagtatgtgaatcctataggaaaaacaactctttgtttcctgatttaatagtaatgaaggaaggagatgaatggtattatatactctttaaagcatttttttttttttttttgagatggagtctggttctgtcactgaggctggagtgcaatggcgggatcttgtctcactgcaacctccctctcccgggctctggggttcaagtgattcttctgcctcagcctcccaaatagctgggattacaggcgtgtggcaccacgcctggctaatttttgtatttttagtggagacagggtttcaccatgttggccaggctggtctggaacgcctgacctcaggtgatccacccacctcggcctcccaaagtgctaggattacaggcgtgagccactgcagctgccctctttaaagcatttttaaaagtctattttaggatggtcttttgttgttggctagaaagggacaagtctaagggagaaaatatttgataactgaaattgttaataagtcgtttcctggagtctttaaaatttttgtttttgtaatttgcattgtagttctaattttatatgagagaaatatgagtttataagttcttaatgttttacaggaccagattataagttaaaatattttcttgtagtatctgtttgactagtagctgtttttttccttcaaaaaaaatttatcgaagtccaagtttgtgtctttgtcagtacttgtaatacttgtatcccaggctgcaatagtcttgtgggggagacccagcactgttataaaagctcacccaggtgattggatgagctagactaatagtttaatagagctaaactagctgatagttttcaatcctagccgtatatcatgttaacgttttaaaataattttttttttttttcagacggagtctcgctctgtcgcccaggctggggtgcagtggcacggtctcggctcactgcaagctccgcctcttgggtccacgccattctccggcctcagcctcctgagtatctgggactacaggcgcctgccaccgtgtccggcttactttttttgtatttttaatagagacggggtttccctgtggtctcgatctcctgacctcgtgatccgcccgccttggcctcccaaagtgctgggattacaggtgtgagccaccgcgcccagccattttaaaataatttctatagctttttccttttttaagtagagattgttttatgtacctcgacttttttgaactttggtatatcaaacccttgatagcaaccctggagtggttagttgtatcacagtattagcagtctcccaggaaaaatagagcattacagtttagcttgaaaactttttttcttccttgaaaattttattttaatattgttagaaactacatgaaatagaattaaatgaatgacacttacatcctaaacacttgtgaaatagagtgacccttgttagtccatatatcctgaggaccagcaattttggcatcatcttggattgataataatgcagtttcaagctcaatcccagttttattgaatcaggatatgcattttaacaagatactcaggtgatgtgtattcatgttaagcttgactagcactgctgtggaggaaataacactaaataagacctggccttgatttccccccaaacagtggtttaattgtatgtttttcttatttttaaaatgagtaaattgggctgcataatctataaagcctgtgggagtgatgtaatagttttaattttaagtattgaggctaatttttaagcatatgtactagaacttgaatgttgtcatgtatcttgatatatattctagggtgtatatgtatgttctattaatgcctaaaaccttgtagttcttggaaaatgcttttcctccccaatataaaaaagtatctctagaggtttttttttttttttttttttgagacggagtcttgctctgtcacgcaggctggagtgcagtggtgcgatcttggctcactgcaagctccgcctcccgggttcaagcgattcttctgcctcagcctcctgaatagctgggactacaggtgtgccaccacgcccagctaatttttgtatttttagtagagatgaggtttcaccatgctacttcttttttttttttccttaatcccaaatgtgataggaaacatttctgactgagggttctgtaggaagtaaatcataagtatattaaacaaacatatatatagtaactataaactttttattttatttatttatttttgagacggagtcttcctctgttgccaggctggagtgcagtggcgtgatcttggctctctgcaacctctgcctcctgggttcaagtaattgtcctgcctcagcctctcaagtagctgggattacaggcacccaccaccatgcccagctaatttttgtatttttagtagagacagggtttcaccatgttggccaggatggtctcgatctcctgacctcatgatccacctgcctcggcctcccaaagtgctaggattacagatgtgagccaccgcacccagccggctaaaccttttaaattagatttccagcattaaattatgtactgtatacaaggtactccagtttacagcaaacacaaagttttttgaattaaaaaacctgtcgtaaaatactgtttaaacatctgatttagtgtagaattaaagggactttagggtggtaatttaaacatttctttaaaactatctagattgtgaatagaccgttcatacaagaggaaacatgtatagaaatggttgttagtgaaagaaatgagtattaaagcagtttgaatggtgtgactgaagaacttaattttcagttttatttaattttatttacattaacagttttgttagtatggatacaaatatgagtggaaaatgattaatatttgatttggttatactggaaaactttgttggaacaacttttatacatgtctactttttcagttgtaagttttatgaaattaaatgattatgtgtttctgataagcatttagtgtctaagttgaaatgtgctgtaggtgtaaaatacacagcagatttagaagactgtatgtaaagtaataatgggccaggcgtggtggctcatgcctgtaatcccagcactttgggaggctgagtgaggtgggtggatcacttgagcccaggagttcgagaccagcctgggcaacatggtgaaaccctatctctacaaaaaatttaaaaaaaaattagctggctcacgcttgtagtcccaactacttgggaggctgagggaggagaattgcttgagccgagatcgcaccattgcactccagcctggtcgatgagagtgaaaccctgtctcaaaaaaaagaaaaaagaaagaaaagtaaaaaatactgagtaggttgaaatgctaatattttgggttagtaaataaaaatattatttaaatgattttttttaaatgtgacttagaaaacttaaaattacatatgtggctaatttttcttgtgggtagggttgtctattctatattcttaatagtaattttttgttttcttattatattgattacttagagttgttaaactctccaaatgtggccaggcatggtggctcatgcctgtaatcccagcactttgggagggcgaggtggtgggtggatcattgaggtcaggagttcaagaccagcctggccaaaatggtgaaacctgtctctactaaaaatacaaaaattaggcgtggtggtgcgtgcctgtaatcccaactactcaggaggctgaggcaggagaattgcttgtacctgcaagacgggggttgcagtgagccgagatggcaccactgcactccagcctgggtgacagagcgagactcaaagaaaaaaaaaaaaaaaagaaccaaacaaatgtgactatgcatttatctgtttttctttttagttctctgaatttttgcttcgtgtattttgagtttcttacttggcattgttatgtctttctgatgagtacacattttatatgtggtatgcttttagtcttgaagccagctttgatgtttatgtagctactttagctttcttatgattaatgtctgtatagtataccttttccccttttactttgaaactttacttgaaccaagctctgtctttttattaaaaggacatctctaatatacagtatggccaggcgcagtggctcacgcctgtaatcccagcactttgggaggccgatgagggaggtcagaagttcaagaccagcctgaccaatgtgatgaaaccctgtctctactaaaaatacagaagttagctgggcatggtggagggcgactgtaatctcagctactcgggaggctgagacaggagaattgcttgaacccaggaggcggaggttgtagtgagctgagatcgtgccattgcactccagcctgggcaacaagagcgaaactccatctcaaaaacaacaaagaaatacagtatatagttttgcttttattacccagtctggcagtctctgcgtttttattggagtgtttagtgtatttatatttgatgtaattattgaatttagttgggtttaaggttgccatcttgcgtgtttttcattcatctcttttgtcttttgttcttattttttactttgggttcattgaatattttttactattttattttggtttcttattggctttttttggtttttgtttttgagaaagagtttcgctcttcttacccaggttggagtgcaatggcacaatctcggctcactgcaacctccgcctcctgggttaaagggattctcctgcctcagcttcccgagtaactgggattacagggatgtgccaccacacctggctaatttttgtatttttagtagagacagggtttctccatgttggtcaggctggtctcgaactctcaacctcaggtgattctcctgccttggccttccaaagtgctgggattacagacgtgagccaccacacctggccccttattggctttttaagctataccttttttctttttgtttgttttaaagccgttactctagggctaatgatattcatctttaatatatctgcctatttagaatcaatgttttaccactttccactttaaaatcataaccttagggtgtaatttcatttactttgcctcataacatgtcttttaaaattttgtacttctacatactttataaaccccacattgatcaattatcttttagggagattagttggaagaaagaaccagtcttttatatttgtatctgtttactattttggattcagatcaataggaaggaataaagagactttccatttgataatgtttcatttcagcctgaagaacattatatagctctcatgtaatgcacatctgctaatgacagatactctttgcttttttttgagacagagtcttgctctgtcgccaggttggagtgcagtggcacgatcttcgcttactgcaacctcccgggttcaagtgattcctctgcctcagcctcccaagtagctgggattacaggtgcgtgccaccacgccggctaattttttgtattttcatagagacggggtttcaccatgttggccaggatggtctcgatctcctgacctctcgtgatctgcccaccttggccgcccaaagtgctgggattacaggcgtgagccaccgcacccggccatacttttgcttttgctgtctttattttgctttcatttttgaatgatcgtttcactgaatataaaagtctaggttgacacttcttttaaaaacactctaaagctatcaatcccttgtcttctggcctccagtgcttcagtgatgatgtgataagcagcagttatttgaattattctgctctgtataattgtataattattacataactatacaataattacttgaatattctgctctgtgtcctgttatctttggtttttggtttttagcagtctggctgatgtggttttctttgtattaccgtactggaggtttgctgagctttttggacctgtaaatctctgtcatcaaattttggtaacattatgactattgcttcttcaaatattttttcagctccagcctcactttgttctccttctgggattctaaatgcaggttggatagtgttccataggttcgtgagactctcttagtttttctttattcttttttctctctgtacttcagattagaaaatctcttttgatctctttgcaagtttacaaactttcttctgttacctacagtctgctgttgtccatccagtgagtatttcattttaattactgtacttgtcagttctagaattttcatttgttttttaatagtttctatagttttttggctgagactcctcatctatttatttattaagactttattttcctgtaagtccttgaacgtatttacagtatctggttaaaagcatttgtctgctaaattcagcatctgggtcatggcagaattggtactgttaactgcttttctttcttgactatgggctacatttccttctttctttgtatgtctagtaatttctgatttatatactgtatattaaatgttatgcattgtagagattttggattctcttagcttgtttttggtttggcaagcaggttaattactgatggatcttgaccttggctttgcttcatacttcgttagtgtgggtctgtggaaagcttagaggaaatctccctaacttagtgggactaaatttccaaactgtgtaccttgcagatcttttcaagtcttggttttatttaggctttgattggatggattgtcagtaggccttactctagaacttgacccttaattctaagatatgtcgattctagtgtctcagcttgatgcctaaggtatagatgtttctttccactctggctgggccagaactccaaagtgtctcagtaatgtttgacttctgtttctctctcaaccctgtagtagcttccttctgttaagcattgcatagtgttgtgttcccctgcacctgtgatgcttgttgtccttgtccaaggagttctgggctccacctctgcatagatcctttttctctggtatcctgcctcacagattcctactgctctagcaatcttgaattcagatctttgtgctctagttcttcactctatagttaggaaattgttcccaggcagagagctgggagtgatcatggcactcaccttgaaagtgtccttgtgctacttgttgtccattgcttgaaaaacaatgcttcatgtattttgtctaattttatagccacggtcgagggccagtctgataccagttactctaatgactagaagtctcaaatatcctccctcccccaaatacctgtgttttaaaaaatgcaaaatagaattgggggtgatttttactactttgtagtctgcccttttcccacttgattttatggtggtttttttttttttttttttttttttttggttgttgtttttgtttgtttttgaaacagagttttgctctgtcgcccaggctggagtgcaatggcgcgatcttggctcactgcagcctccacccctgggttcaagcaattctcctgcctcagcctcccgagtagctgagattacaggggcctgccaccacacccagctaatttttgtatttttagtagagacagagtttcatcatgttggccaggctggtctcaaactcctgaccttaggtgatctgacttcctcggcctcccagagtgctgggattacagacgtgagccactgcacccggccaattttatgctgtttaaaataatacatagatttttttggctaggtgaggtggctcacgcctgtaatcccagcactttgggaggcggaggcgggtggatcgcctgaggtcagcagtctgagaccagcctgatcaaggtgaaaccccatctctagtaaaaatacaaaagaattagccaggcgtggtggcaggtgcctgttgtcccagctactctggaggctgtgacagaagaattgcttgaacctgggaggtggaggttgtagtgagccgagatcgtgccactgcactccagcctgggcaacagagcaaaactctgtctcaaaaaaaaaaaaaaattaaatatatatatgtataatttttttagagtgtaaatgtgttttttaggctgcataatatgtcagtatatggctaaaataactgttcggccactttccagttttgaggtacgcaacattaatttttgccaccagaataaaattagtgtccttatttccttataataaatccctagaaatatatttaaccatcgtataacctctttaaggctcttaaaaaatatgtgctagaataaacttgaatacttagatactgttttcacttgggtatgaaatataaatgttgaggttcaagtactaggcactaacacgttacttagcttttgtgggataactaatttttttataagtagactgaatagactgaatcaaggttactttccatgaaaatttgtttcaagtttttgtttggaatgtgaataataaaatatacttttcattccttttgaaaggtgaattattctttgttctctttttataagtttagttttgggttgatgtaatctaacattaatgctacattttattataatgaagatttgtagcacttttttattatcttagtttataattaagcttgaaatttgctgaggatctaggtcagccctgaagtgtaaattttgctgttggaatacatgctgagtgtctgaatttggcagatttaagataatgtgtgattagacaacaaaaagacaggtgtcttatttaaatagacttttttggtttttttttttagagcaattttagcttcacagcaatatgaagcgaaattgtagttcacgtactccctgccactccatatacacactgtcccccgccatcagcgtttcacccacagtggtgcttttgttaaaatcaatgaaccttcactaacacatcattatcatccaaagtctatagttttacattatggttcactcttggggttgtatattcaatggtttttttcatagatgtataatgacaggtatcaaccaatttcgtattatagagaatagtttcactgccctaagaaatcttctgtgttatgcctgttcatccctccctatccccctaacccctggcaatcacaggtccttttactaagacacctttcttttgttaggccgtgtggcaaatagatattaggtaggtaccttagtgttaatgtgtggagagatgtttgagaagcaggtgatcatctttaggtgtcttttagctttgaccttgaaagacccatctgggggctagcgtagggaaaactgacttggaactgtgaatcacaaaaatgtgttggggggctgaaatctacttgtcttagtaaatttttggcattgaagaatggaaataaaatcactattctatacacaggacgtaacttcagtttaaaatcttagagtggtgtggaatttagagacttttaattgtaggcaatcactaaatgctagtacagtatttacaggtatcctaatgaaatttacatacaattctcttttattcatttgcttatatcagtgtttgatggagtactttatctgtatttagtccatatttggtagagaaatcaccatggggagtaagtagatagatgcaggtgtatcacatcattgttaggctccattatacttttgaaatctatttgctacccttctctgtaaaaggctgtagactagatatggtgacaaatatgtagacacattctgtctatttgaaaggcctgtctttgtctgtgctaataaacttggttgcatagtgactggccaactaatataggtgaattttcgagttaacaaaggttttctgcccagtggggttttttttttcctattttatttattttttattattatactttaagttttagggtacatgtgcacaatgtgcaggttagtgacatatgtatacatgtgccatgctggtgtgctgcacccattaacttgtcatttagcattaggtatactcctaatgctatccctcccccctccccccaccccacaacagtccccagagtgtgatgttccccttcctgtgtccgtgtgttctcattgttcagttcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgatggacgtttgggttggttccaagtctttgctattgtgaatagtgccacaacgaacatacgtgtgcatgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcgtttctctgatggccagtgatgatgagcattttttcatgtgtgttttggctgcataaatgtcttcttttgagaagtgtctgttcatatcctttgcccactttttgatggggttgtttgtttttttcttgtgaatttgtttgagttcattgtagattctggatattagccctttgtcagatgagtaggttgcgaaaattttctcccattttgtaggttgcctgttcactctgatggtagtttcttttgctgtgcagaagctctttagtttaattagataccatttgtcaattttggcttttgggttttttttttttcttaaacttctaaaaaaccaactaatgctttctttacaataagagcaaaactattgtttgttttagcaaaatcaccaacctccacacttggtcattgtgatattttagcagttattacttttgagttcttttttaaagtgttttacttggttcataatttttttttttttgagatggagtttcgctcttgttgcccaggctggagtgcaatggcgcaatcttggctcaccgcaacctccgtttcctgggttcaagcaattctcctccctcagcctcctgagtatctgggattacaggcaagcaacaccactcctggctaattttgtatttttagtagagatggggtttctccatgttggtcaggctggccttaaactcctgactttaggtgatccgccctcctcagcctcccaaattgttgggattacaggcgtgagccaccgcgcctagccaagcttcataatttttatggaatttttgtgttacgtatacttaatactcttgagttgtcggaggtatttccccaagctatttgattatcatatttgcttataaactaggtaagggcagggccaggcatagtggctcatgcctgtaatcctagtactttgggaggctgagatgggtggatcacctgaggtcaggagtttgagtccagcctggccaacatggggaaaccttgtctctactaaaaatacaaaaattagcttggcgaggcattgggcatctgttgttccagctactctggaggctgagacaggagaatggcttgaacccaggaggcagaggttgcagtgagtcgagatctcaccactgcactccagcctgggtgacagagcgctctgccttaaaaaaaaaaaaaaaaaaaaggtaagggcagatgtaagactcctgagtaaaatgcttaaatttcattcattcaggaaatatttacaaggaacctgctaggctaggtgtcaggcactgttgtaggtgctggtagagaatggttaacagggtgattgggatccttactttagtggcacactcattctgtggagtgggagatatcaggtacacatttaaacgaatgaaaaaaggttgttttaggaattgaaaaaaactatgaataaacctgtttcattaaagtgttaaggaaagggatctgtgatttagattgagtggtcagggagggccatgctgaggagataacatttgagctgaagagctggatgatggagacataagccatgtgaatttctagggacagagcattccagataggggacaacacaggacaaaaattctaaggtgggaaacagggttagcttcatcagggaacagcaagaaggccagattgtccaggctttgggaatgaataggagtgtgttgtaagatgacatgtgctttataaggccctctgctatggagaggaggctgggcccagatcgcatacgactatagaagccatggtaaggtatttaagggctttcttcttttgtttgtctattttctgcttatgatgggaaactaagtggtaaattggcaatccaagaggggagacatttaataaataagtacttacataaatattcaagtgatagattaaaatttggggagtatagaatgactaaacttggttggaagcctcagggaagattcttgttcctggaaagtgtcttttaagctgagatttaaggagtaagtgtgaatttattaggaaacaacaaaggaaagagtactctaggcagaggaatattaaagcagagtctagaaagagcttagcagcatgaggatctgatgaaaggttagtttggctacctagtttaaacctggggttcccaaccctagggccgtggactggtactcgtccgtggcctgttaggaactgggccgcacagcaagaggggagtagcaggcgagcgagcattactgcctgagcttcgcctcctgtcagacccatggtgacatcagattctcataggagcgcgaaccttattgtgaactgcacgtgtgagggatctgggttgtgtgctccttatgagaatctaactaatgcctgatgatctgagatggaacagttttatcctgaaaccactgctcccccttctgtggaaaacttgtctttcatgaaaccagaccctggtaccaagaaggttggggaccgctggtttaaagagaagaatagcaccaaaagaggcaacagagattggcggtgagtacgggaccttatagagcatgtgtaggattttagtcattagtcctctgtaacagtgattttaaggagggtaacctggtcaactttacatgtaactatattatttagttgctactctgtggagattagattggattgggtaagaggacaagagtattaatgaagggaaaccagttagatgctacagtgtgaggtactgtggcagtgacaagtgcaggaatattatcaatagagattcagaaatgaagacaaattaagaaggtggttattgattagatttaggggtaagtaaaagacacgtagacgtatctctatatgtcaaggacagccagcaagtctgtgccagagcagatgggtggatggcagtgtcagtacgcagctacactggtcaagtgaaaatcaccatagcattttggcatttcaaggggaaaataaaagcttctcctgttggattggttattttgaaattactgttaacttacacctatggtgcttactgcgtagcatacatatttcaactcattgaatcctgatgacaaccctatgagttaggtaatgctatgcctgtttgacacacacccattttccagatgagaaaacaggtgcagagaagttaagtgacatgcatcgaggcagtttgctccctacttcatggtcttaaaccactaattaagcttagaaacttataccgtttgcatcctgttttgttatttatctggacctacctaatgagacgttaatttagaatttaactgtattgcaacttttcctggaaagttcactttttgcatgcattcaaatagcatacctgactattgctatataccattgatacaggcagtgataatgtcccctttaactaaatattgattgcttttactttcaaagattctcctttgaagtggcttgctctttataatgcattgtcattgttttcagcacattttgaaatagtgctgttgactttgctatatacagttaaaggtgcctcgtgatgtggaggtagaggctctaatagtctttgcaaatcagataagtgagatgcttcttttggtaataagattaaaaatccactaatgtagttatataatctttgctctgtgaatattggttatgtggataaggtattactgaactgttcactaataatgtaccacgccttagtggactggctttctcctcagagtaggacagtcattgattgcattgaaaacagtggataccgtatgtgtccttagagtggaaactgacacttagtagacaggctcaaggaggggatctcttagaaattttgatgtgggagaagataaggtccccaggagtaactagttgctacgtgggatcaagcagttggtagagaagaaagtcagacaaggtatgtgtcctctgaagctaggtgttttttttaaagaagaacagaaacctagactttggaagtttatctctgctatttacattctctgtacttcttcgtcactattcagtaaagttatgtctgcaaaggttaccttattttaatgtgttgtggtgaacaaaggaagggtttatatggctgttttcgggagctataacagctgtagtgtttggtgagaaagagctccagtgggagatgaaattctgagatataaatgcatctcactgactcttctttaatgaaacattaatcctgtgctttgctttaatgaggaggctgtagtagtactaggttactgttattaaattagggactcattgtaagtatcatttttggaaacttgttagaaccctaattttcccctttaagtttcagaatgaaaaataacatgaataatttttttttgtttgttttttgagactgagactcactctgttgcccaggctggaatgcagtggtgcaatctcagctcactgcaacctctgcctcccaggttcaagcgattctcctgtctcagcctcccaagtagctgggactacaggcgcccgctaccatgcccagctaatttttgtatttttagtagagacggggtttccccatgttggtcaggctggtcttgaactcctgacctcaggtgatctgcctgcctcggcctcccaaagtgttgggattacacccactgcacccagccacatgaacaattttaatatatgtttttaatgtttgtaaagtagagtaatgtttgtgaattttctaggtgatgcttacagggaaaattgggatttgaagtatcaggtgaaattgatttttcccctctttagtttatgtgtgcatacagttggaaaagttatttacagaataatacagggctcagaaacaggtgctgttgacatgaacattctcaatgaagttaagacttcattgagatagaggccatatttagtattattgtttatctgtatgtataatggtgtatgagtccattttcatgctggtaataaagacatacttgagactgggcaatttacaaaagaaagaggtttaatggaatcaaagtttcacgtggctggggaggtctcacaatcatggcggaaggtgaaaggcacatctcacatggtggcagatgagaagagagcttgtgcagggaaacctcttataaaatcatcaaatttcgtgagacttattcactatcatgagaacagcacaggagagagcctcccccatgattcagttacctcccactgggtccttcccacaacatgtggaaattgtgggagctacaattcaagatgagatttgggtggggacacagccaaccatatcaagtgggaaatcttatcagcattctttgtcctgtcacagagggagtgagaaatccaaaggaacattataatgatctataatggggggagggggcaattacttacttgaaattttgctttagttgtggtccttaatgaaagttcgtaatatagggattaaagtaaccagtttctttctttttaaattctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtgaatagtcttttaaattgaacccaattaaaaagaaaaaagtaccaaccatgcctgttaaaaaaatagacaaaaaccagaactatatctttttttttttttttttttttttttttttaatttaagtggtctcactctgttacccaggatggagtgcagtggtgtgatcacggctcactgcagcctcaacctcccaatctcaagcaatcctcccacctcagcctcccgagaagctaggactacaggcgtgtgccaccatgcccaactcttaaaaaaacttttttttttttttttgtagctatgggggtctcactttgttgtccaggctgacagaactgcatttttaattctatagaaatataattctttataggacttcctggtcaatacagtaatgtaagtttgagctcttgattcttcatcgccataattcccttctgcatatactgcatatggaaacatataattgagcatctgtgttccaggcattgtggctctaacccaagttgtctgagtatatcctagaagtctctgaagtactgtttatcttctttccctttttgttacttcttcacactttccttttggccacctttacagtgagtaaagtaggtggatagagacctttgaaaaagtatatctgtgttcctcaaacaagtcagttttagtgactattacctttggagataaagtccagttccttagagtggcttctgcagccatccatgatctctgaatctcatctcttgcccttcatatgtcaaataaactatagtttttgctgttccttgagtatgccatgttttttcctcaaatattatggtattcttggctcatcttttcatgggggccttccctgacatctaggactatattacatcctcttcctaactcatggtacaggttgtatgttttattgatattactttagttgcttatttttttctggctactttaatctctgtcatgggtgggccctctgttgattatcaagcacctggcacaagaactgggtcttaggagatacttacattttaattgatgaatctctttcccttctatacattttcactttgagatggtaccagacaattgctacttacctatctctccctgactctgactttctctcctgaaaaaaaaaagcaaaaaaaattttttcactcgagttggaatgtttttctgataattgcaagttggactgagggaatgggagtttgaaagggaacaggagaaggaattggaaattttggagtggagcacttagtggaattgctatatagggaacttttgacattcagaagccacatgaattattagaaataatactttgacagaattaggtaattgtctaaacacctgtcagggtgctcacctttatgagttctgtgacatttgtaattgggtgtgcattctcttcgaggtaagaaataaggtaaacattctcatttggttttccaggaagcttttcagtaaagttttttcatggcgatcatttcaggctttctcaaatatacctgagtatcaatagcatagtttatattagaaaactttgttttacatgtttgggacattgagaaaggtacatcattttaaagtttgtctcattgattgagacgtgatctcactctgtcacataggctggagtgcggtggtgtgaacatggcttttagtgtcagtttagtagactgcagcccaacctcctctgctcaagtgatcctcccacctcagcctcccaagtagctggcactacaggcatgcaccacaatgcttggctgatttttaaattttttgtaaagatggggttctcactatgttgtccaggctggtcttgaactcctggcctcaagtgattctcccacctcagcgtcccaacgtgttgggattacaggtatgagccaccatgctcagctaaagttttcctatttagacttgatctagaattttacatctgaaatagagaaatgtttaagtagtggcatattttttaaaaaaactgtacatttaaagatgataaaggatttctatattttgaggtcctcttaagtccttaagttagcttgtgtatattgtatctatctgtgtctaagctgtttagtgcaaatgtattttgttccaagtaggtcacagacagtagaaagttagaaggggagggaagcttagatcacttatctaggaatgacagataagtttcacctcaggtgccatttctgtttccatctctgatcagttagtagtggctgttcagagtggagtagcagccccccattgccgtgtatttgcaatctctgcacaaacggaactctcttttcctgggggagttgcagaagccatgcaaaggttatgatggcttgagtgaggttatacatctagttagtggcttctaagctgaaatgtctttattggctttcatttatagtattgccctatagaattcctgatataaatcaccttattctgtcaatcaaaaattgcatttaaatggtatctgatttttggataatgtgcctccacttaaactgatcatgtggtgggtcatgcttttcctatgagatgaaagtaaagaaggagaaataatggggtagttggatttattttattaacctgtatgcctgcacaggtgggatgctagctgaaagaagtagagtagtgacatactgacagtttaagttttcagtgttgacttgagtcaatgtatgtaagtatgcagttgatgaaagtagtgagtagttttataagaggagattaaaatctgtaatcaaagacagaattggtgggtatggttatggtgtgggggatgttggctttcccctcctaaataaatgttacactcaagtattctatgccctgccccccccacttctaattcttatttgcttatttaggggtgtgctttagataaatgtatcttttccttaaaaatttttttcctttgaagtataatttacatgcagaaaaggtgcacaaatcttaagtgtacagcttgatgaaattttacataggtatacacccttactaccaccatccagatgaaaatacagaacaacccccactttgtgttccttctcagttaatgtctaccccccccccccccccaccaaaactaactgctgttctgaacttttcaccacaggttcatttcactgtttttgaactttacgtgaatgaaatcataccataggtattatgtgtttggcttattttgttaacattataactttgagatgtactcatgtttttgcgttatttttgttgctttaatattctactgtatgagggcagggtgttggggctcacgcctgtaatcccagcactttgggaggccgaggtgggtagatcacctgaggtcaggagttcgagaccagctggggcaacatggtgaaaacccatctctactaaaaatacaaaaattagctgggcgcggtggcatgcacctgtaatcccagttacttgggaggctgaggcagaggaatcacttgaacctgggaggtggaggttgcagtgagccgagattgtgccatcatactctaacctgggcaacaagagaaaaactctgtctcaaaaataaataaataaaataaaaataaatattctgctgtatgattatgccacattttgcttatccatttaactgttgatgggtttttgctttgatactacaattttttgtcagctgattttttagaagtgtttttttcatttttaacacaatattagaggtcatatttttttaagttttcaaacacattttttatattggaatataacaaagagagcctgtatacctgaatcctttacctagtttcttctaatgttatcattagtgtgattcatttgcaaaactaagaaaccaatattgattggtacattactattaactaagtccttgacttcgttccggcttctgcagtttttccattggtgctcttctttctattccaggatctctaatacagaatacgattcctagatttagctgtcatgtctccttagtttcttctggtctgtgagtttctcagcctttcccttttttcatgatcttgacttttttttgagacgtagtttccctcgttgcccaggctggagtgcagtagcgcagtctcggctcactgcaacctccgcctcctgagttcaagcgattatctcgcctcagcctcctgagtagctgggattacaggtgcctgccaccacacacagctaatttttgtattttcaatagagatggggtttcaccatgttggctaggctggtctcaaactcctgacctcaggtgattctgcccgcctcagcctcccaaagtgctggtattaaaggtgtgagcctggtgatcttgactattttgaggcatactggtaagctattttgaagaacgttcctcaatttaagtttgtcttacatttctgtcatggttagactggggtgatgggattttggaaagaatactcctgaggtcaagtacccttctcatcacattgtatctgggggtatgtatagtcacgtggtactgctaggaatggtactcttcacctgttggttaagctagtgtttgccaggtttcaccactgcagacttgatattttttagtcattaattccaccccaacctcaaagaacagggaaagaggaggattaagctctaccttctgataggaggaagacatctaaatatattatttaggattcttctgttgggaagaggtgtatcttctccctatttatttatttattcattccatcctttatatcagtgtgggctcatttatacttgagttacaatccaaagtgtttactttaaaaaaataattttaacttttattttagaatcaggggctatatgtgcaggtttgttactagggtgtgtttcctaatgctgatgtttggggtacaattgatcttgtcacccaggtattgagcgtagtaaccaatagtttttcaacccttgccctcttcctccctctcccctctagtactccccgttgtctgttgttgccatctttgtgtacgtgagtacccttgtttagcttctacttttaagtaaaatcgtggtatttggttttctgttcctgcattaatttgcttaggctaatggcctccagcagcatccatgttgctgcaaagaacataatttcatccttttttatggctgcatgattttaaaccttttcaaagtgaaatagattattccagtgtctgtaggaactgttagaaaaatgctgattagattgtcacgtctcgctgttgtagtttgaaatctaggaatcagtttacaatggtcaaaacttaatttagtagaattatataatatacatgaaactaaacacagtgcttacgatattgatgctaagtaatggtgatagctattattactaaattctcctagataaggattcttaattctctatggagttgcttctacttttataccatttcctgttttttctttgtaaaactttattatgaagaattttattaataaatacatgtaaaagtaggcaataatataataaatgcccatatactaaacaatttttagcacttatcaattccaatctcatttcatctataatctaactcagtctacaccttatatattattttgaagtaaatccctgtgatcaattaatttataaatattacagtatgtgtctcttaaaaataaggacttttttgaacattacaataatatagaaataataatcccttaatattaatgtcttttaagtgttcaattttcaagttgcctcaactgcctttttttttttttttttttttttttttttttggagacagagtcttgttctgtcgccaaggttggagtgcagtgatgtgatctcagctcactgcaacctctgcctcctgggttcaagcaattctcctgcctcagcctctcaagtagctgggtttacaggtgcgcaccacgacacctggctaatttttgtatttttaatagagataggggtttcaccatgttggttaggctggtatggaactcctgacctctaatgatcctcccacctcagcctcccaaagtgttgggattacaggtgtgagccaccatgcctggccacctcaactgcttttcgtttttgtttttgttttttttaatagtccacattgtgattggttgtcttcaaagtgttttaatgcattttaggtttccctccctccctctctttttcttggcaatttatttgttgaagatactgattgttggttatagggtttcccactctggatttgcagattacatcccgttggtgtagttttacatgttctgcattctgtgaatcttctgtaagttgttagttgaatctagagacttcatcagactcaagtttgacgctcttttggcaagagtacttcatagatgatgacgtattcttccattaggaagcacatactattttgtgatgtaacggtttttgaatctttactgaattcttggtattttgattactaagcatttagcaggcattatcttacttagtattcagaaataaccctgtgcagtgataattatatttcaacttggtagttgaagaaacgagactcaaagtaagtggcaagacttaaattcgagactaggcaatttgatgccagagcctttattctaaaaactattatgtaaaattatgtttggtcattttcccatatatctacaataagtaaagtacaggttactttataggatatacctacactaaattattcttttataaatatttactttggtttacttcagagttgaactagactgatgggaggatatgtgtgagtacaaatgtaacttttcttgctatgcactggtatctaagctcaataaataaaggatccttgctgtatttgctactcaagagttttgactccttctacagcatatttggtaatggcattttaaaaaaactgtcctttatgtttttattctttgctatttaaagagctgctccccaaactgttgccagagaccaggagtaaaaaactatctttaagaatcatacgcactgctacatataacttgccacaagcacaaatatctcagaatgagccctatgggatgttgaacttgattttaccttcctctttaaggataacagtgtctgagatttcatgggaaatgtgcaaatacatgaagaaaaactgtcttatgttctttctcaagactgaaatgtatttggaggaggaacaatatttttaaatgctgcttccttgggtctttttatttttatttgtttatttatgtatttatgtatttagagacagagtctcgctgtggcgcccaggctggagtgcagtggctcactgcaagctccgcctcccacgttcacaccattctcctgtttcagactgccaagtacctcccgccaccatgccctgctagttttttgtatttttagtagagacggggtttcactgtgttagccagatagtcttgatctcctgacctcattgtctgcctgtgtcagcctcccaaagtgctgggattacaggcgtgagccaccgcgcccggcctattatttattttttattgggtgtaacttacatacataaagtgtataaaccttaatatagccagtgcatttttatatatatatatgttatagtaaccactgtctctcagaacaagacagcatttcctgcattctaggaggctctctaattccccttcccagttactgctatctccggctctcaagggccacctttgttctgacttgtattaatgtagattagttttgcctactatagaacttcacataaatgtaatcatagagtatgtactcctgtgtcttgtttctttcactaagcattaaggctggtgtatgcacattgttacatgtgtcagaaatatgttgtatgttatttttattgctgagtgatatttcattggatgaatatgtcataatttaccctttctactgatagacatatgggtttctagtttttttctgttatgaataaaactgctaatgaacatttttgtaaagtctttgtgatgtaagcactgaattctgttgggtttatacccaggagtagaattgctgggtcacagggggaaatacccgtttacttttagtagggattgccaaaatttttttccgaagtggtttcattaattttacacttccatcagcagtgtgagagacttacagttgctgtatatcttgtgaactgtattgtcaatctttttaatgttagctattctgatgtgtattttgttgatttaaaattatctgtatacgtctgtatacaagttcatttgctcataaactatttgccagatttaatgtagaagtttagcttatttaattatatttattatataaatgttatatattataatatataaatatatttatatattataaataatatatattatatattatataatatatattatataatatataaatattgaatataaattataactataatgttgaatattattattgaaactatagaacttatgtaacaaaatgctgataatttgaattttatattattatttttgccaatgtgagaagcaggcaaactttgaccagatttttttgtttgtttgtttgtttgagacggagtttcgttcatgttgcccaggctggagtgcaatggcgcgatcttggctcaccgcaacctccgcctcccaggttcaagcaattctcctgccacagcctcctgagtagctgagattacaggcatgcaccactacgcccggctaattttgtatttttagtagagatggggtttctccatgttgaggctggtcttgaactcctggcctcaggtgatccgcccacctcagcctcccaaagtgctgggattacaggtgtgagccaccgtgcccggccttgaccagatttttaagagtcaataaggaaataaaaattgtgggctgctgctgcttattattattacctgaatataagataaggggattgggctgggctcggtggctcatgcctgtaatcccagcactttaggaggccgaggcaagtcgactgcttgaggccaggagttcaagaccggcctggccaacatggtgaaacaccgtctctaccaaaaacagaaaaattagccaggggtggtggcaggtgcctgtaatctcagctactcaggaggctgaggcaggagaacctcttgaaccctggaggcagaggttgcagtgagctgagaccatgccactgtattccagcctgggtgacagagtgagactctgtctcaaaaaaaaaaaaaaaaaaagaggattggatacagaggttatgtggactatcttccccttagcatattggggtccctgctgctgagactttgattttggaatcaaaactaagttttaattcttccctatgcaggttttaaattggattagatttgagtcagaaaagcttcatcaaatgttaccaaagctagaggaatcagaaataaacgagatggaagtgtttacaatattgtttgaagtccttattgcagcattttaggagagactttcttggttacgttcctgaacctgttgcctgaaaatactctgtcctttgcagcttttccagctttaagtcccaaatgtatgtattgcctcttttgcagtatcataaatattatggcacccctatcatcacatatttccattttggatttgagagaacataaattacagatcttttttcattccaaactctttgttccagtaggttacattaactgtttctaaagtaactggttttatttaggctatttattgaaaaatacctcaagcaacaaactgttactcataaacactgactactcaaccaccagttttagaacatttagggagttaagccatcttgtataatataagttccttttgtgttaatactaactgtttttggaggagactttttttttaaggtaattaactccctacctccttccctcactctgccaggacaattttgctatttagcttgtacattttttaaaaaattattttaacttttttagagatatcgtctcgctctgttgcccaggctggagtgaagaggcacaatcacagctcactgaagcctcaaactcctgggctcaggtgatcgaccctgaagggcctcactttttagcccagcttggtctcgaactcctgggctcaagcagtcctcctgttttggcttcccaaagtgctgggattgtaggtgtaagccactgtgcgtggcccagcttataaattttagttcagaatttcttttctttctctttttctttttcttttcagatcaagtctcactctgttgcccaggctgtccttgaactcctggtctcaagcaatcctcctgcctcagcctcccaagtagctgggacttacaagacatgtgccattgagcctggcttcagaatttctttgttctcacaaatttctttcctttaataggatacattttgtatagattggagaatgtataccataattctttcatcaagaagcaagttcaaggcataagatttatgtcacattgtactagtatatggacagtcaacagaaacttgagtgggccattcattctcccctggactctggtagtgttatacaagtgggttttgtgtgactaggagtctttgttgaacttgtacactaaaggtatttgattttttgtttttcctttaacagtgttactgagatataatttacttaccatataagtcattcacttaaagtgtgcggttcagtggtttttagtatattcacagagttgtgcaactattaccccaattaatttaaaaatgtttccattggcggggcatggtggctcgtgcctgtaatcccagaactctgggaggccgaggtgggaggattgcttgagcccaggagtttgagaccagtctgggcaacatagggagactccatctctacaaaaatcaaaaaattagccgagcgtggtggtgtgtatctgtagttccagctacacaggaggctaaggcaggaggatgtcttgagcccaggaggttgaggttacagtgagccctgattgtgctattgcactccagtctgggagagagcaagtcacagtctcaaaaagaaacaaagtttccatcatctcaaaatgaatccctgtgacagccctttggctgttacccccagatcctttctccaaaccctcaacctgaaggaaccgctaatctattttctgtctctgtggacattcatgtaagttgaatcttaaaaaatgtggtcttttgtgactggcttcacttagcataatgttttcagggttcatccatattatagcatgtatcagtactttttatggctgaataatattctcttgtgtggatataccacactttatccattcatcagttaatggacagttggtttgtttgcaattttatgactattaggaataatgctataatcatattaatatataatgttaattacataaaatatatttatatatgtatatgtcataataatgatgtgaaagagggttcttccttcattttttggttatgtatctatttgtcccagcaccatttttggaaagacttttcaacacttccactattgaatgctcttgataccttattgaaaaccagttgattatagatatatgaatttatttcttgactctcagttctattccattgatctgtatacatgttctatttttttttttttttttttgagatggagtcttgctctgttgcccaggctggagtgcagtggtgcgatcttggcttactgcaacgacctctgcctcctgggttgaagcagttctcctgcttcagccttccaagtagctgggactacaggcatgcgctgccatgcccggctaatttttttttttttttttttttttcttgagacagagtctcactctgttgctaggctggagtgcagtggttcaatctcagctcactgcaacttctgcctcccgggtttaagtgattctcctgcctccgcctcctgagtaactgggactacaggtgtgcgccaccatgcccagctactttttgtatttttagtagagatcgagttttaccatcgagttggccaggatggtctccatctcttgacctcgtgatccgcccacctcggcctcccaaagtgatgggattacaggcatgagccaccacacctggccagtttttttttgtatgttagtagagacagggtttcaccgtgttgcccaggtttgtctcgaactcctgcgctcaggcaatctgcctgcctcccaaagtgctaggattacaggcgtgagccaccacgcccggccatgtcttgttcttataccagtatcacgctgtcttcactactgttgctttgtagtaaattttgaagtgaggaagtgagtcccattttgttctttttcaagattgtttggctattttgggttccttgcaatcccatatgaattttagaattagcttctcagtttctacaagaagttagctgggattctatcagtgattggttgaatctgaaagatcaatttgggaaatactactgtgttaacaatattaagtctaacagtccatgaatatgggatatttttccatttatttagatccaaacatttttttatagtttttgagtataagttttgcacttttcttcaatttattccttttgttgatgttactatgaatggaattgctttcttaatttcatttttgaattgttcatgcaagtgtatagttcatatacttgacttgcatattgatcttgtatccttgaaacaaattgaatttgttcattagttccaataatttttttagcggattccttcgagttttctatatacaacatcatgtcatctgcaaatgatgattgttttacttctttctttcttacctgggaaccttttatttctgtgtcttggctgatggtcccagctagaacctctggtagtattgagtacaagtgataaataatgaatatccttgtctgttttctaacctagtttctagaaagcacctagtttctcactactatgttagctgtaggattttttgtagatttttttttaattgaagtttttctttattcctagtgtgctgggagttttttttttttttttaaatcctgaatgaatgttggattttgtcaaatagttttcctgtatttattgatattatcatgtgttttttttttctttcttttcttttttgagacagtcttgttctgtcacccaggctggagtgcagtggcacaatctcggctcactgcaacctctgcttcctgggtttaagcgattctcctgcctcagcctccacagtagctgggattacaggtgcataccaccgtgcctggctaatttttgtatttttagtagagatggggttttgccatgttggccagcctggtcttgaactcctgacctcaggtattctgcccgacttggcctcccaaagtgttgggattacaggcgtgagccaccatgcccagctgattttttttctttagactattgttatgatggattacatttattgactttaagttgttgagccagccttgcattcctggagtaaatcccacttgatcatggtgtgtaattctttttgtacattgttagatttgatttgctaatattttgtcaaggatttttgcatttatattcatgatatatactggtctgcagttttcctttatttgtagtatctttgtctggttttggtattagggtaatactttgaattaattaggaagtattccctctgcttattttctaaaagaatttgtagagaactgctaccatttcttccttaaatgcttggtagagttttccagtgaagtcagttgggctttgtaaatccttcttttggaaggttatttattgatcttttttttttttttttttttttttttttggagatggagtcttgctctgtctcctagggtgcagtggcatgatcttggcccactgcaccctctgcctcctgagttccagcgattctcctgcctcaatctcctgggtagctgggattacaggcgcccaccaccatgcctggctaatttttgtatttttagtagagatgggggtttcaccatgttggccaggctggtcttgaactcctgacctcaggtgatctgcccatctcggcctcccaaagtgttgggattacaggcatgagctaccacgcctggcctttttttttttttttttttaaatagatgatctagttctccttgtgtgagtttggtagtttgtttctttccaagaattgctccatttcaactaagttactaactttgtgggcatagagttcttagtattcttttatttttttaatgttcaaggaattagtaatgaagattcttctttgatttctgatactagtttgtcttatcttttttctcccctctctcttcagttaattatattgatctttttgaaggatcagttttttgtttcactgatttgttttttctgttgtgattttctgttttcttgtttcaatttcatcagttcttgctctgattttattcatcttactttaggtttatattgctcttcttttccagttacctgagatggcagcttagagtattggttttagatcttattttctttcctactgtatgcatctaatgctataaattctgtaatcatggtttttgctgcatttcatatattttaataggtagtattttcattttcctttagttcaatatattttaaaatttctattgagatttccttgactcctgtgtcattttgaggtgagttgttttaaactccaactatttggggagttttccagctgtgtttctgttactgatttctagtaatagtttaattctgttgtggtatgagagcatactttgtattatctatcccttaaaatttttaaaggtgtattttaaggctcaggatatggtctaccttggtgaatgttctttgtgagtttgagaagagtatgtattgtgctgttgttggatgaaatatactataatgtcagatccatttgattgttgatgctgttcagctcgactatgttattggatttctacttgctgggtgtgtcagctacctataaagaggtgtgaggtctcccagtataatagtggatttgtctgttactctttggagttcaatttttgcttcacatattttggtgtaatgcaactcttaatctttgttctgaagtggtttttatgtttccttattttgaaaactgctttgtctgtaattaacatagctactctagctttcttttgattagtgttggcatggtatgtttttcccatacctttacttctaacctgtgtctgtctttgtaaagtggagtttttaaaatagatagcatatagttggctctattttttaaaaacccactgtgacaatttctttttttgagacagaatcttactctctcacccaggctggagtgcggtggcacaatctcggctcactgcaacctccgcctctctgattcaaatggttcttctgccttagcctcctcagtagctgggattacaggcacccgccaccacgccccgctaagttttgtattttgaatagagacggggtttccccatgttggccagactgatcacgaactcctgacctcaggtgatccacccacctctgcctcccaaagtgctgggattacagatgtgcactgtgcccggccaacagtttcttttaattggtgtatttaggtcattcacatctaaagtgattgttgatataattggatttgtagctgccatgcttataattgttttctggtgttttttttttttttttgtacttttttttttttatattcccctctttttctgccttctccaattttaattgaacattttacttgattgcgttttctgtactctcttaatatatctgttaaacgtgttttttggtggctgcctggagtttgcaatgtacatttacaactaagctaagtccactttcagatattatactgcttcatggatagtgcagttaccttagcgtattcctaattcctcctctcttttatacattgctgtcatttgtttcccttatctatatactataaccacctaaaagattttattttaccttattatccttctctgatactctttctctttatgtagatttgagtttctgacctatatcattttcctttttgctgacgtattggcgacaacattccttggtttttggctaagaaagtctttacttcttttgtaggataactttactggatacagaattctagtttggtggggtttttttttcttttttccagctttgtcaacatttcaccctatttccttcctgcttgcatgatttttgttttgctttgttttttgagatggagccttgctttgtcgcccaggctggagtgcagtggtgcgatcttggctcactgcaacctctgccttctgggttcaagtgattctcctgcctcagcctcccaagtacctgggactacaggtgtgtgccaccacgcctggctaatttttgtatttttagtatagatggggttttgccgtattgaccaggctggtctcgaactccagacctcaagtgatccacctgcctcggcctccccgagtgctgggattatagccatgagtcactgctcccagctgcttgcatgatttgtaatgggaagtccagtgtaattcttatctttgttcctctgtaggtaaaagtgttttgttcctggcttctttcaagattttctttttgtgttactttgcagctaggctataatatatacctagtgtggatttttttggtatttatcctgcttggtgttctgtcctcttcctggatcaatttcctattttctaattctgaaatatatcatatctgagtctggttctgttgtttgccttgtcttttcagtctatttttttcttgccttttggcatggcttgtaattttttgctgaaagccagacatgaagtatcaggtaataaagactgaagatttaggcttctattatgaggttatatgttaatctagttgggagatgggctgtgtttaacgtgttttttagctgcaggtcctagaggcttcagtttctccttattctctcactgtctttggggtttcccaagaacttttattgaactcaaaatctgtgtcttgcagcttttttatttgtaatccactgtcattatattggagcattgttgatgaggtggtaaagtgtaggagagcagaagcatcgtatgccaccttatggttaaatcttagttttatttttattcttttttgagacacagtctccttatgttgcccaggctggtctggaactcctgagctcagtctcctgaatagctgagattacaggcagacaccactgcacctggctccttagttttttagtgggcctgagtcctggtctatgaccctctttttttttttttttttttttttttaaacaaacaaacaaacaaaaccttaaactagacaggaagcctagatggggctggagttggctaatttaattgctcctccctagggtcagataaagctctggtaaagtagttttctcaggagggcaggcttttgttgtggggactggtgtgtgtgtgtgtgtgtgtgtgtgtgtgtgtgtgtgtgtgtgtgtgtgtgtgtgtgtgtgtactggtgtgtgtgtgtgtgtgtgtgtgtgtgtgtgtgtactggtgtgtgtgtgtgtgtgtgtgtgtgtgtgtatgtactggtgtgtgtgtagatagtggttactttcccagggtgaacttaaaaagtgttacttcccctccccttgtcagtcatgagggaaactttcttccgtaattactttgagaattttgtggagttctttgagataatattcaggaaagtggggtgttttcttagactgagcctctagggtttttagtgcttaaactagttcactctcagcttctgacaattcattgaaattgccatttaagtgttcctaccagttgctgcagcagttgctggtaagctgacctcaactcctgatcctttgtgttagtttgtctcttgtgattttgcagggatggtttgacctgtgatctcaattctttgatctaagaaaggagagtttattgatttttcagtttgctaagcttttctcttgttgtaaagataggtctgatgacttctaaactttttacatgagaaagctgacactggaagtccaatggaagactctaaagtcaaatctcagtttaattacaagacgtgtctgccccttccgttttgttagccctcaagggcaactttttttaaaattgtggtaagatatacataacataaaatttacctctttaaccatttgtaagtgtacacttcagtggcactaagtctgttcacattgttgtgtagccattgccactatccatctccagaactgcttcatcttccccagctgaagctctgtgcccattaaacactaactccccatttctctccccaatcccctggcatccaccattctactttctgtccctatgaatttgactaagcacctcatatgagtagaatcatagaatatttgtccttttgtgtgtggcctatttcatttagcatagtgtcttcaaggtcaaagacaccttttgagcagaaccttttatcaaaatatgttaaattcctcttcagcatgtacctaagtagttagagttgtcctttttctgggctcatgacttgggtcagtcataatttcattgatttgtccagccccagatgggaagagttgggcatggggtgggaatggggttggataagatgttagacagttttaaactgttttaaagttaaatgttttataatttgttccaggacttgcagagtattctcacatattcaaatgaaaacagtaaatacaattggtggttagaatgtgtacagtatttattgtgtccatcactttgggtgctgagtgttcataacctgtctcctgattaggtactagttttatacacatgaagattttcatttgtggtggtgtggggaatgtcatgcaactagggaggatctcgcttattattgtagcactacttggattgttttttttgagactgagtttcgcttttgttgcccaggctggagtgcaatggcgcgatcttggctcatcgcatcctccgcctcccgggttcaagcgattttcctgcctcagcctcccgagtagctgagattacaggcatgcaccaccatgcttggctaatttttttgtatttttagtagagactgggtatctccatgttggtcaggctggtctcaaactcccagcctcaggtgatccgcccgcctcggcttcccaaagtgctgggattacaggcgtgagccaccttaccggcccacttggatcttaatttcattctttttattccttttactcccagttgtgatgatttatggcttttgtatgaacctttattcttccagcctatccattgtgaaagggagtcagcttgccagcagtcaggagcgggtgtgctctgatacatgtaggcctggcaggacaaccaaccctttgatcacttgagcccaggatgtcgaggacagtgagctatgatcgtgccattgctctccagcttgggtgatagagcaagaccctgtctgtgtctgtctgtctcgttttctttctctctgtctaactaactaaataaatggttacatagttgtttcactttgttgctagggagtatacctttcctttggtaaaatatgaatttgtttcttactgtttagaataggtaaggtttcttaattgctgataattatattatgtagaacgtctttttggcaagggctgtatttattcactatttgattatacttaaacttcaggctgggcatggtggctcatgcttgtaatcccagcactttgagaggctgaggtgctgaggtgggaggattgcttgagctcaagagttcaagaccggcctgggcaacatagcaagtgagaccccatctcaaaaaaaaaaaaaaaaaaaaaaaaaacttctggtgatttcagattgccttttgcagttgagttttattctataaatacttctttttttcctatttactttatatgtctggtggaataggattacttttgcatttctgagttttgaggcttttgtctccatagtagtaaatagtatcagattagtgtttttgagtttttaggtttgcttttagtaaattatcacagcaaatagggtctgttatcagcaaggctgcctttagctcccactaaaattctctttgtgggcaggaatgtttattcttgttcactgctgtatccctagaaaaatggctggcacatggtagaggttccacaaatatttaatgaatgaatgactgtattttatgaaagctgtcagtgttcactatgttagagaaattatacacttttacacgttttaaagaatctgattagttctctgatttattttttcatctttgttgttgttgttaaatagaggcagggtctctcactctgtcatccaggctggagtgtggtggcatcatcatagctcactgcagccttgaacttttgggctcaagtgatcctcctgccttggcctcccaaagtgctgggattacaggtgtagccaccacactcagcttctttcatccttttgctgactaatcagtttagtatttttttttaaacatttccattacaaggtaacctaggaagagatgatacatagtagatttttatgagacaccaattctttttaaagtttctttggaagagggggctggcaaacatataagcctatgatttcagtcatctatacttataaaaatttatttttactgtctttttatgattgtattgtttctaggaataataacaaagatcatatttcttctggatttattacccatgctcaaaagggagtacattgaagcttataagtaaacttttttgtttgtttaagaaatacttagagtaccaactacaagccaggcacacttctctgtgatgggaatacttgtaagaatgaaacaaacaaaacttttgtgaaacttaccttcttgtagaggagatagaaataagtaaaatgtagagtaaaaccagagttctcttagaggaattatttgtgtagcctgtaacttttacaaataataaattcattaagtaccagatttttttttttttgacattgtgggggaatgagattctccatgtcagaacttacaacagtgcaaggcactttgataggagcagtttggtgaacaaagatgattgtttgtagcctttgctctcaagagactcacaaaaaaactgcaaaaccatataaaggtaactccttataaatggtaactttttttggtatggtagaatcaggaagatgtgtgttgagatctatggggagtatcaggagcacagacaagaagagtaaattaaagatggattgttatcagcctgggcaacgtggcgaaaccccctctctacaaaaaataccaaaatcagccaggtgtggtggtgtgcacctgcagtcccagctacttaggaggctgaggtaggaggatcctttgagtccgggaggatgaggcttcattgagttctgattgtgccactgctctccagcctgggtgacagagtgagaccctgtctcaaaaaaagaaaaaaaagaaaaagagaaaaaaggattgttatgcagcagatctccagatggtcttattggtagtgcggagccacagatgacttttcagcaggacagtggcacgattacatttcttgtgaacattcagtgactatggaaaaatgggttagaggatagagcaggagttgcatagagaccaatatgaagtatccaaatatgtagtcaaggggcaggatcaccagttttacttgtccggggagtgtcaaaataatcttctgattcctgtgaagggtgcctcctgaaacacaagtccatcatatatactgtgaatggaattgtctcaggtggcagccccttctgaccagcatagatgaggtctttaagttgtaggtattgaaaactgaagaaaaagaaatgaatccaagagaagtttgtaattgataggattggtggcctactggggatgggagttttgtggaataataataataattaaagatggtttgaagtttaaggctatgttaggtgatggtctgaatgatactgtctttttgttttgttttgttttgtttgagacagtctctctctgttgcccaggctggagcgcagtggtgcgatctcagctcactgcaacctccacctcccacaacccacctgaaacccgggttcaagcgattctcctccctcagcctcccaagtagctgggattacaggcatgtgccgccacgcctggctaattttttttttttttttttgtcattttggtagagagggggtttcaccaaggccaggctggtcttgaactcctagcctcaagtgatccacctgcctcagcctctcaaagtgctgggattacaggcgtgagccactgtgcctggctgacactgttttgtttttgtttttgtttttgccactgtgtgtctgcttttcataaattgcttcatccctcattggtcctgtcttaaccatctctccactcctaattcacgctttgtaatttgttttagactagatatccaagcttattagaagtatttctgaaacaaaggcgtttttcctgtggggtacattgagtaaaggctatgtgggctttaagtatactaaactttagggatcttgacgtctgtcaaaggtattcatttattatgtcccacatttaattttctagaaaaattaccttatatgttaacttttgtattatttcataataacaatttagccctgtggttctagttaaaaacttttattatggaaaattttaaacataccctaaaataaagagaattgtataatgaactccaatgtatttgtcaacattttgctggtcttgttttatctgttctcttttttccttacctcccggaatattttaaagcaaatgccaggcatatcctttcactgcagatacttgagtatctaatagataaggactcttttttttcctaaccacagtatcattagcacaccaaacaatcttccttaccctaatttaacaccatctaatgagataaccagtttgggttcatattttcctgttggtttaaaaaagacgttttaaatagatggtttgtttaaatcaggctccaaacaagtcttggggttattttttaaattgattttttttgtttttgtttttgagacgcagtttcgctcttttggccaggctggagtgcagtggcgcgatctctgctcactgcaacctctgcccacgggttcaagtgattctcttgcctgagcctcctgagtagctgggattataggcatatgccacaacacctggctaatttttgtatttttagtagagatggagtttcgccatgttggccaggctggtctcgaactcctgacctcaggtgagccacctgcctcgtcctcccaaagtgctagggttacaggcatgagccactgcacccagcctaaaattgattattttttaaagaggaaatgaaggcagtatgaaaacttactgtaagctattctgagaaagcagtgctgttttgacagtcattctacctggaacttagttttgcttatctgtgtaacaacatgttaaaataattggtgccgagttttttatgatttttaacattttaggaaatatttctctgtctctctctctctctctcttttttttttttgtttttgaggcaggatctcactctgtcacccaggctggagtatagtggcacaatctcagctcactgtagcctcaacctcccaggttcaggtgatcctcctacctcagcctgctgagtagccgggactacaggagtgtgccgccacgcctggctaatttttgtactttttgtaaagatggcgttttgccacgttggccaggctggtctcaaattcctggcctcaagtgatatgcccacttcagcctcccaaagtgctgggattacaggcatgagctgtcatgcccagccaggatatctttcagaaaagggggaaagtgagtataaccccacttatttagaagcctagagagtagtagtgtgagctgatttgagaagattcgagtttggaggagaccacgtctctataagaaaaagaaccccacatgggatttaaggactgctttgtaactacttgtttgttacacagtgttttttttgtctttccgggtttagcttccccatctgtaaaataaagaatgggtgattttttggtttcttttatttcttaattgtgttgtattttacatttatccttgactttaacaggattctcaaagttggattggtggaaacaatgaaccattgacaggctttacatggcgaggtggctgtgaaagagaaacaacaggcatacaagtttggaatgaagtatttgtgattgacagacctaatggaactaaagtaaaattctgtttatacttttctaccctgtattctttcttgggctattttccagtattaaaaatcaaaacaacacagaactattaatgtttgataactttaacatacggattattatgtcaaatgtatgagatataagtacttttcttgatttaattactgcttttcaaatttatcatttgattttttttatagtcatttttggcaactgttttactaaatattttaaactctcaaattcctaggttgctgtgctgcttatggatacccagggtgcctttgatagccagtcaactatcaaagactgtgcaacggtgtttgctctgagcactatgactagctctgtccaggtgagacacaagattaagtggtgcgatcagttcacgtaatcatttggccccttttttttttcttttttgagacagagtttcactcttgttgcccaggctggagtacagtggcgtgatctcggctcactgcaacctctgcctcctgggttcattctcctaacccgagtagctgagattacaggcccccgccaccatgcccagctaatttttttgtatttttagtagagacgggtttcaccacgttgggcaggctggtctcgaactcctgacctcaggtgacccgcccacctcggcctccccaagtgctgggattacaggcgtgagccactgagcctggcatttgcccctcttgaaaatgcctttttaattttttttgagatggattctcactatgttgcccaggttggagtgcagtggctattcatgggtgtgatcatgcacactctagcttttgggctgaagtgatcctcctgcctcagcctcctgagtagctgggactgtcagcatatgccaccttgtgctggcaaaatgccttttgattgaagggaaaaaaaaggaagctatttacatttcttgagagctatttacatttcttattggttatttacatttccatgcatggttttctggcttatgatgtgaaattttgtactttggatagttacaaaggatgcaataaaccaacaaccagtctctttagtttttcattatggaatacatacttttttttttaaaggaaaagatatcacatgttatctgtaattgaaatcagatagatggctaccagacacagtaatatggagagtatatttttgtttttttggctaaaacaaacaaaaaacccaggtaattaagcttagaagtctagttttttattctgtatctatgacaagtggtactcagttatttgaactaaaggagataaaagcagagtaattacttaatgtttaatttaggaaacccagacaaggcttatgtaataataaactgaggatttttagcaccttcatttaggaagggataaaatcccttctctttttcacttatattcaaattgtgtttggtgttctatccggttctagtttcttcaggctaggccatttcttttctgtataatttagatggattggactgaattaaactaccacatgtcatttggtgtttctttactttttcttttctgagatcatctgtggctgatacatctctgaaaaatgaattattgaagtatggcggttaggcccagctggtgatggtgtatcaagaagtatatttgcaaatatttttttaaaatgggtatgtgatcctcccaagataagaaattgttcttatcaatggtagatcataggtgatgctgtcacagtgtcttggatttttttatgctttccagtaatgtctggaacatatgactcgtctctctaagctcccattttcctccttcctcagtttgaagtacctagccatcagagtggaaagaaggttggctgttaacctgagctaaaagaagaatactcttcagcttggcttcagtttattatagggttgggatatttgtcattacccactaagtgacgctggtggggaccctctaagtctctttttttctctgatcttgcaagatggcacagctgtgattcccttgaagcaagcagaagcccctcaggttagctggctctagagggagttctcgagttctctgtcctaaaacttatcccttagtctttttttgtttatttattcaactttttgatagtaagagacctggttttagacagccacttaaagctgtgcagccactttgttgtctgtaaaatgagttttactcatcttgcctatcttggatgtggttgttgtgtgcagtcagaaatgagagctaaatgagataatgcatatgaaagtgctttgtaaagtataaataaccaagaagattaagattatgattattttcttccttgcctttgggtggggggggtagttttctttccttatgtaagatatctggctgatagataaatgataatttgatcttcttgtcatttattccttcaacaaatacatactgagcacctgttacatacaagacagtatgctaagtactaatgatctaagttaaataaatctctttctctgtttgctgtttgcaacctggccctgacaatgaaaggatccagacctattttctaaaagcagaggcccacataggttggtcatggtgtcagggtttatgttaaaatctaaagtttaatcacctcagtcatcaattactttttaaatccttgtttggaattagtagctaagaatatcattttaggtttgctggcctaaattgactatattcttgacctccaagtggtttagccagagtatcacttatttgctcctagaacagattgttctctcttcggagtcaccctggttcctaagatgtaagttatttcttagcagaggtgatatttgttgatggccacttttctcctgtggcagtgtagattactgtctaaagatctgtcttagaattaatggatgaaaatccccgtttcctgaggatacttagaccctcctttatcaactctagtctcctccaaaaaattctggaaagggcaagagtgccacctactgttacttttattagcttccacaggccagtaaaattgtcatgttgagtgtaagtgaaaactgatgagtaagtaaactgaggagtgtgagtaaaaagagaaccacactagagtcagtagtagtggaggtacccctgagtaactgtatactctgattgtaccagggaagaatttatctttgtaaactgttgccccttatattcactaatttagaaaaatgatggtggaaataacctacactctttaaaaaatgatcgtatcttaacattaaagagcttagagaaggagtacaagaaacctactagataccacacttgttcttctaccacttttaggccatgagtatacatatattcatgctttttgcatattttaccaccactgcttcttccttaatattctatcttgactattgttaggaaaaaagagaaaatccttttcacatgtcagttgtcaagatagtagttaaatgattcctttgcgctgagatacaaaataaccttttttccacaagtaaagttatacagaagctgggtattcagaacaaaacactaataaaaaacaaaataaattttgtttcaacaggtatataatctgtctcagaatattcaagaagatgatcttcaacatttgcaagtacgtatttctttttttaatttttattttttgagatggagtttcgctcttgttccccagactagagtacggtggcacaatcttggttcactgcaacctccccctcccaagttcaagggattctcctgcctcagcctcccaagtagctggcattacaggcatgtgccaccatgcctggctaattttgtatttttagtggagatgaagtttcaccatgttggtcaggctggtcttgaacttctaaccttgggtgatccgcccgcctcggcctcccaaagtgctgggattacccggcgtgagccgctgcgcccgtctgcgagcacatatttcttaaagaaaatgtgccaactattgaaatttaattctcactttattatgaatttacacttggaagcctataatactggtaacacgattgaatgttatatgggtttaaactggtgtatgacttcttaactggaagaaattttgtacatacctagtgtgttagaaaattaaatgtttggctttgaaatgattttaaaggttctggtacctggagctttggtgtggaacaggtttacacatgtcttctttcaatctctttagaggcattattttaactaactctatttaatagttatttacagagtatggaagacttgcgatggaagaaatctaccagaaaccatttcaggtaaaaaagttattctaacattttaaagattagcctatgagaagttgtgaagccacctcagtttgtaattttggagacaccaggatattacaatagactcattgctagcaacagattcagtgcaatcgaaactaacctttggtagtatcatcagcatacttatcagtaggcgaacaggataaatagaataaatgaatctaggctaattcttaatgctttcacttagattaaggggagtaatgtttctcttaacagatgttattctaaacttaagacaataggaaatatatgacagtcatgccattttttttttatacgtggtaactacagaatgttacaggtttcttttttgtggtttactacaagttgaaattagttctgttactctttattttggtttcatatagaaaagttccagatagtttattttttgaagcaagtgtaatttgtaagttgccattaatactgtttggtgagctgcagttacagtaggagagcatgactctaccatgtttgctcctaagtgtgtgaagcctttccggtatgacagcattgctactgattgttaatcttaatgggtttacattgattctgcctcactcttgtctggctagtatggtcacttttattaagtagttgagcagatgatgccttcgtttttggatatataggtgaaatataccctatttggcctatatcagttttttctgaactgggatcattttgccacccaaggggacatttgctaatgtctggagacatttttggttgtcacagttttgtgggagagcttagtgcctcttggtatctagcatatagaggccagaaatatggttcaacgttctacaatacacaggacagccacacacaactaagaattaactgacccaaaatgtcagcagtgctgacccaaaatgtcagcatttgagaaatctaaccctatatgagtaaaaacatcctctgtgagtgaaaatgtccttattgaccccagatctataatcagtctagatagccatctagaattagttggtcttgtagttacacaaccatgatttaaaattatgatccgtgtgtcctgatacacccatttttcatttttaaagtcctgtattactgcttgtggtgactctttctttatatttagtgaagttcttcagtggcagcgattgcttggtatagggcctgagaatgttgtttaagtgggtccttgatataaccatgaccagtactgaccatttagttactataacttttgataaggattgtttaggagagtaagagaggcttcaattgttaagagttgtgattttttcgtaaattttctttattgtaaaataaacaatttttattttttctgtgtatagacattaatgtttttgattcgagattggagctatccttatgaacattcatatggtttggaaggtggaaagcaatttcttgaaaagagattacaggtaagaccctaatgcttaaagaggagaacataagcaccaagctaggcaaacgggtgggctgtccggactgctggtcacattaccagtatttacgtgtcgttggaataaagtattccaggttagcccaagtgactctgtttgtaattgatgaaaagtaaagtggttgcattcctaccaaagaagacagtgtccttgaatcaaaattaaggatcatgatcctttattcctaaaggtagccccccatggaagtacttgtgtattagtctgttctcacacagcataaagaactacttgagactgggtaatttatgaagaaaagaggtttaattgactcacagttccacaggcttaacaggaagcatgactgggaggcctcaggaaacttacaatcatggcggatggtgaagggaaaagcaagcaccttctttttttttttttttttttaagacagtctcacactattgcctgggctggagtgcaatggcacgatcttggctcactgcaacctccgcttcccgggttcaagcgattctcctgcctcagcctcccgtagctgggattacaggcgcccgccaccacgcctggcatattttttgtattttttagcagagacggggtttcaccatgttggccaggctggtcttgaactcctgaccttgtgatcggcctacctcggcctcccaaagtgctgggattacaggcgtgagccaccgcacccagccagcaagcaccttcttcacaagatggcaggagagagagagtgaagggggaagtgccacatactttttaacaaccagatctcgtgataactcactcactgttaaaagaacagcaagggggatttctgctcccatgaatcacctccaaccaggcccctcccccgacacatgggcattacaatttgagatgagatttgggtggggacatagagccaaaccatatcaatttgggaaacctgcaggtcagatacttacaggctacccatctactcacacacacaaaggatacataaagacccctttattcattaggagggtgctgtctttcattgataagattttatttgtctatgggaatgatgcatttggtttctcaactgcattaaagacttggggtatgatataattttcttttagttttaaaatgagattaaaaccaattcaacattcttagattatttgaaaggcatttccagaccccacttttggaaataatttcagtcatcagcattttctgtttctggtttgttcagaagaaattaacacaaagcacaatagacatactaactaaactcagaattatgtaactcaaagacaagaaagtttttaaactttttattgaaatgttatacatatattcagaaaattgctcaaatcataagtgtgtagcttgatgaatttataaaaaatgaacatagccatttagccagcacctagaagcactcacctccatacagcaaccttcccccaaaaccctctaccagtatcctgacttctcacaggctttgtttttgtactttatgtggatggaatcacatacagaatgtatttgagtctagctttttttacccaatattatgtttctgaggttaatccatgttgcatatagtttaatttatttattctcattgctgtatagtatctattgaatgaatagacaacagtttttccattctgctgttgatgggagatttaggtagtttccaggttttaattataaatagcgcatattttgttaaaattgttttccagaagagtgtttaggagactgtgtgagttatattgggataaatgagtaattatctaaaatgtttctaagtttaagatttttttccccctaatacatggcagtttcccttctcaaaattctggtaactagcataaatcataaataatcatgtagagagggacctgaaattctaacacatttctaaggtctttgtactgcactgtaattttttttatcttagcttttactttgttcaggggctaaactttttatttgtaggcaaatttatacttttttttttgttttgttctgttttgttgctgttgtaagtactttaaaggtaaattcttaatttatttactggtgtataagtcacagccataatttgttatttggttattagatactgtgattaactaccttatttgtagtttttgctgttccaggcagcttacttgggaaaaacatcttttgtggtttaagaaaatgtggggttggctgggtgcggtggctcatgcctgtaatcccagcactttgggaggccgaggcgggtggattacctgaggttggaagttcaagatcagcctgaccaaccctgtctctactaaaaatacaaaattagccgggcatggtggtgcacgcctgtaatcccagctactcgggaggctgaggcaggagaatcacttgaacctgggaggcggaggttgcggtgagccgagattgcaccattgcactccagcctgggcaacaagagcgaaactctgtctttaaaaaaaaaaaaaaaaaaaaaaaagtggggtcttaacaaagtggtcagaaatgggccttcataattttttgtattgtcaaaaaagactccttaggagtaccatctgagttaagtgtgcatagtgtgcatgcgagtctgtgtgcattttctttaaaaaaattttctttcttctgtttacaatttcacctgtctctctccgccctcaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaaggtgggaattcccattcttgctaaaatctgaacttatttattagaggtggaaagttttttaagaaaatacatgacgccttaaatgtcctgtcttatactggagaatgtttggatgcattgttcatgttgtggttgtaatgctctgtgttgtttctctagcattccattgatttgtttgcagctgtctagcatattgattaacctattttataatgtctgttgctcagcagtgatgtcctgaaaattctgaaggctgagagcatttcttttcaattgattgcagtctgctaaaaggctttatcattttattatattgatgaaatcagatataagtgtctgtttcaggagtgatagtacagtttatgtatgttgtaggattattttgagtgtgttggcaaaacatttggggattgacaaaacttttacagtatggctggtaaaacataatctagtagtaaaatttaatacaattttatgaattgtttgcctcttgaaaaggacattttcgttaatactaaatgtgaaatttgtcttggtagtccacaaatttattgatgttttatttgttatttgaactggcagtgttactagggggttggggaaaatgggctagtagagtaagggggattatattttttcctatgagatatggcatgttggatgagcttttttttaaaaaatgaatccacttcagtaatagatactatgtattcttatttcataaaacagaattttatgaaatcgtaccagtggggacctaattttttttggactaatatgttgctcaattttttgttttctagatattgatgaagactttaaacgagagcttcgaaatctggttccattgctgcttgcccctgaaaatttggtagaaaaagagataagtggatctaaagtcacttgtagagatcttgtagaatattttaaggtaggtgagctcttaaacagttttgtctaagatagaaatgtagttgacttaaaactcatctgtatgtataagaaatttcttgtctttattttaaaacaaaaaagagtaagatttgtgatttatctttctgccttgaattagatgtatctgtatttaaggatatttaaaagattatagcagatttctgtctcctagacagtgatttaatttatttacagaattatcttactttttctccatctcagatatggagagaacaagccattcatcatactctaatactactctgtcattagtgaatgataataggaatggaaagcataattttacatcctaagttctcacaaaaacactccctcagagttctgaggacttgataagaacagctgaaagtatttatattggttcaagtaaagtactcttaggttttttttttttccctctgttcttctctagtctttatagcttgcctgccagaacaagaccgctgtggaaggttgtattatttgtagtagttttaactaagagtgtattttgttcacttattggatacttgatagttactctcatattatctttgtttagttatgaatgaattttttaaaatttatttttacttttaatttttaatttttgtgggtacgtagtatatatacttatggggtacatgagatatttttgatacaggcatacaatgtctaataatcatattagagtaaatagggtgtccatcacctcaagcctgtatcccttccttatgttacagacaatccaattatactctttgttattttaaaatgtatagtaagttattattgactgtaactacattgttatgctatcaaatactagatcttattctaactatatttttgtacccattaaccatctctgcctcccctccaccctctgactacctttcctagactctagtaaccatctttctagtactctctatcgcatgagttcagttgtttaaatttttagctcccacaaataagtgagaacatgtgaagtttgttttttctgtgtctggcttatttcacttaacataaagtcctccagttccaccatgttgttggaaatgacaggatctcattcttttatatggatgagtagtacttcatcgtgtatatgtaccacatttctttatccattcgtatattgatagacacaggttgcttccaaattgtagctgtagtgactagtgctgcagtaaacatgaaagtgcagatgtatcttctatatactgatttttttcttttgggtatatacctagcagcagcattgctggatcatatggtcgttttatttttagtcttttgaggaacccccaaactgttctccatagtggttgtactaatttacctttctgccaacagtgtacgaagattcccttttctctacatccttgccaacatttgttattgcctgtcttttggataaaaacaattttaaatggagaaagatgatatctttctgtagttttgatttgcatttctctgatgatcagtgatgttttcatatcctgtatcccatttgtttgtctccttttgagaaatgtctgttcagatcttttgcccgttttttgatcagatcatttgatttttttttcttttccctgtagagttgtttgaactccttatatagtctggttactaatcccttatcagactagtagtttgcaaatgtcttctcccagtctgtgggttgcgtcttcacttttctgatgtgcaaaagctttttaacttgatatgatcccattcgtttatttttgctttggttgcctgtgcttgtagggtattactgaagaaatcttttcccagaccagaccaatttcctggaaggtttccccaatgttttcttctttttttctttttgaaatggagcgttgctctgtcacccaggctggactgcagtggcgtgatctcggcttgctgtaacgtccgcctcccaggttcaagcaattcgcctggcctcagcctgggcgacagagcaaggctccatttcaaaaaaaaaaagaaaagaaaacactggggaaaccctccaggacattgctctgggaaaagatttcttcagtaataccctgcaagcacattatcaagttaaaaggttttgcacatcaaaaaagtagctgggattacaggcagctgccaccatgcctagctgatttttgtatttttagtagagacagggtttcaccatgttggccaggctggtctcgaactcctgatctcaggtgatctgcctgcatctgcctcccaaagtgctgggattacaggtgtgagccatcatacctggccaccaatgtgttcttttagtagtttcatagtttgggtcttaggtttaagtctttaatccattttgatttgatttttgtatatggctagagatggggtctagtttcattcctctgcatatggatattcagttttcccagcaccatttattgaagccactgtcattttctcaaagtttgtactgaagtacaacttccagtactgtgtagaatagcagtggtgaaagtgggtatccttgttttgtttcagatcttaaaggaaaggctttcaattttttcccagttcagtaagatactagctgtgggtctgttgtatacagcttttattatgttgagatctgtttcttctgtaccttttgaggatttttaccatgaagggatgttgaattttatccagtgctttttcagcatcaattgaaatggtcatatggtttttgttcttcattctggtgataacgatgtatcacactcattgactgactgattgattgattgattggtgtatgttgaactgtccttgcatccctgcctgaccctaggtgatgatgaatgatctttttaatgtgttgttgaattcagtttgctagtattttgttgaggatttttgcaacagtgttcatcagggatattggcctgtaattttttgctgagtctttgtctggttttggtatcagggtaatactggccttgtagtattggtttggaaatattccctcctcctctggtttttggaatagttgagtaggattggtattagttctttaaatgtttgataaaattcagcaatgaagccattagctttcgggcttttctttgttgggagactttttattatggctttgatctcgttacttgttattggtctgtacgggttttagatttattcatggatcaatcttggtaggttgtatatgtctaggaattgatacatttcttctaggctttcccatttattggcatatagttgttcatggtagcctctaatgatcctttggatttctgtggtatcagttgcaatgtctcctttttcatctctgattttatttatttgggtcatctctttttttcttagtgtggctaaaggtttgttgactttgtttatctttttaaaaaatcaactttttgcttcattgatcttttgtattgtttttatttcaatttcgctaacttcttctaattttgggtttagtttgctcttccttttctgtttttttaagatgtatggttaggttgtttatttgaagtgtttcctcttttttgatgtaggcacttattaccatatagtttcttagtactgcttaacgctgtatcccatatatttggtatgttgtgtttccgttttcatttgtttcaagaatgtgtttatttctttcttaatttcttcactgatctagtggtcattcaagagcctattgtattaatataatttccatgtgtttgtatagtttccaaaattcctcgttattgattttattccattgtggtcagagaagatacttgatataatttcaatttttttgattttttttttgagaccaagtgtcgctgttttgcccaggctggagtgcagcggagcagtctcggctcactgcaacctctacctcccaggttcaagtgattctcctgcctcagtctcctgagtagctgagactacagtaacgcaccaccatgcccagctaattttttgtatttttagtagagatggggtttcaccatgttggccaggctggtctcaaactcctgacgtcaagtggtccacctgccctcaagtggtccacctgccttggcctcccaaagtgctgggattacaggcatgagccactgcgcccggtcctctttctttagtttctaataatacttgctttatatatctgggtgctccagtgttgggtgcatatatatttacaattgttatatcctcttgctgaattgatccctttatcattatataatgaccttctttggctgatataaatgtagcttcttctgctctttttttttggtttccatttgcatggagtatctttttccatacctttattttcagtctgtgtctttatagatgaagtgtgtatcaccattttttaaaacccattcagccactctgtgccttttaattggagagtttagcccatttacactcaatgttactgataagtaaggagttaacctctgtcattttgttactgttttctggtggttttgtggtcttcctacctgcctgtcttccttttagtgaaggtgattttctctggtggtatgttttaatttctttttattttttgtgtatctgttgtatgtcttttgaggttaccatgaggtttgcaactataatatatttattttaaactgataacactgattgcctaaacaaactaaataacaaggaaagagaaaactaataaaaattctacactttaacttcatccccccactttttaaacttttcgttgtttctattgatagtataccgtctatgtctggaaaagttgtggttgttaattaatattttttataggttcgtcttttagtctttctactcaggatatgagttgtttacacaccacaattattgttaataatattctgtttttctgtgtgtttactattcccagtgagttttggaccttcaaatcatttcttattgctcattaaaatccttttctttcagattgaagaactctctttaacatttattgtaggacaggtctgatgttgataaaattcctcagcttttgtttgaggaagtctttatttctccttcatgtttgaagtattttcactggatatactattctaggaaaaatgttttttttcttcagcactttatgtcatgctactctctcctggcctgtaaggtttccgctgagaagtctactcccagatgtgttggaactcttttgtatgttgtttgtttcttttctgttgatgcatttagaatccattcgtgcttcttgttgttgttgtggtggtggtttaatagaaatggggccttgctgtgtttaacaggctggtctccaactcctggcctcaagtgatcctcccatctcagcctgccaaggtgctgagattacaggtgtgagccaccgtgcctggcctgttgttgtttttaacagagacgtcatttctctacgttgtccaggctggtcttgaactccagggtcaggcagttcccccaccttgacctcccaaagtgctgggattacaggcatgagccaccacgcccagccaggatccattctttaccgttgacctttgggagtttgcttgttacatgtcttgaggtagtcttatttgggtcaagtctgcttggtgttctataatcttttgttcttaaatattggtatctaggtttgggtagttctttgttattgctttgtataaactttctaccgctgtctctttagctactcctctttaaggcaatgaactcttagatttgcccttttggggctattttctagatcttgtaggcatgcttcattctttttcattcttttttcttttgtctcagctgtgtattttcaaatagcctgtctccaagctgactaattcttctgcttgttcaggtcttgtgttaagctctgaggctgggtgaggtggctcatgcctgtaatcctagcactttgggaggctgaggtgggcagatcacttgagaccagtctgggcaacatggtgaaaccttgtctctacaaaaaatacaaaaattagccaggcatgatggcgcacgcgtgtagtcccagctacttgggacactgaggtaggaggatcctttgagcctgggatgcagaggttgcagtgagccaggattgcaccattgcactccagtctgggagacagagcaaaaccctgtctcaaaaaaataaaataaaaaagaggtttggatgcattcttcagtatgtcagttgcatttttcggatccaggatttctgctttattctttataattatttcagtctctttgttcactttatctgaaaggattctgaattccttctctgtgttatcttgaatttctttgagtttcctcaaaactgctattttgaattctctgaaaggtcagttatctctgtctctccaggattggtcactggtgctttatttcagtttgtttagtgaggtcatgttttcttggatggtcttgatgcttgtgaatatttgttggtgtctggacattgaagagttaggtatttgttatagtctttgcagtctgggcttgtttgtacctgtcatccttgggaaggctttctaactatttgaagggacttgggtgttgtgatcttggtcactgcagctgtatctgcattagggacatttcaagcccataatgctgtggctcttgcagatttgtagaggtactgccttggtgctcttcggtaagatccaggagaattccctggattaccaggcagagactcttgttctcttccattacattctcccaaacaaatggagtctctgtctctgtgctgagctgcctggagctgggggagggggtgacacaagcaccattgtggccaccatccctgggacttcactgggtcagacctgaaggcagcacagcaatgggtcttgcccaaggcccattgtgactattgtgtggttattgcctgtggtcagtcaaggcccagaggttctacaatcagcaggtggcaaatctagcaagttccctctggccttgggtgggtccagagatgctctctggtgatccgcctgccttggcctcccaaattgctgggattacaggtgtgagccatcacacctggcctttgtctcctttactcaagcaggagactctcctcatagccacaacatctgggaatgtgctgggtcacacctgaagccagcacatttctgaatctcacccaaggcccatagtgagtactgcctggctaccactactgcttattcagagcccagaggctcttgagtcagcacgtgatgaaccctgccaggacttggtcatacccctcaagacagtgggttcccttccagcccagggtgtgtttagaaatcttgtctgggaactggggactgaaattggggccttagggctctgccttatgccgcattctactttggctgagctggtatccaaattgcaagacaaagtcctctttactctcccctctcctctcctcacgcagaaggaaagactctctctcagagctgtgaactacactgcctgagcttgtgtagggggagtgacactagcagtcccttggctgccccagctggagtcttactatatcatatgcaccccaggtccactggctctgagcccagcccagcaccaggacctgcccaggaattgcagtccttgtggcctagatggcctttcaagtttattcaggacctcagagcactgtagcccatggtggcaggactggctgcctagggctggtctaaattcttcctccatgggtgctggctgagttctttccactgtggcagggcagcgctgagtttcaatgcaaaaattccacagtcactgctttcgacttccctaagcacatagattgtctctccacaccatgtggttgctgctgagaggatgggggaggggtggtgtaggtgattcaagactgtttttcacatcctcttcagtgcctctttcagtgatctgaagttaaaaccaggtactgtgattgctcacctgatttttggttcttatgaaggtggttttttatgtagatagttgtcaatttgatattccttggaggtggtgatcactggaggcttctatttggccatcttgctctgcctccttcccagttatgaatgaatcttgtcagtggaaagttgagatgagccaggcacggtggcttatgcctgtaatcccagcactttgggaggctaaagtgggcgaatcacctgaggtcgggagttcgagaccagcctggccaacgtggtgaaaccccgtctctcctaaaaatacgaaattagctggatgtggtggcgcatgcctgtaatcccagctactcgggaggctgaggcaggacagttgcttgaacccaggaggcggaggttgtggtgagctgaggtcgtgccgttgcactccagcctgggcaataagagcgaaattccttctcaaaaaaaaaaaagaaagttgagatgaaagaccctatatggacttctaacaaactcttatcttttccttcttactcttaaaccacaaattagttttttttttttttttccttcttgagctgaaatacaatttaagctggtcaaagtaaaatactggataaaattgtttcttcagctggatgtggtggcacacaccttgtagtttcagccacttggaaaactgaggcaggaggatcacttgagcccaggaattcgaggttgcagtaagctgtgatcatcccactgcactccagcctcagtgtcagtgtgagaccccatctctaaagaaagagaaaaaaaagttttttaaaaatattaaaacactggcaatagggggtaattgtgaatttcttttcataaagaagatggcattttatatctaactttgagttataacttttatgttatatttgttatagaaatacctaggatattatttagcagcatataatttaataatattgagaatagggttaactttgttggaataaggtgatttttaaagcctagaatttacttttaatggtgttaattatttttatatttaatgacttttctttctttggggatgtggagccaaattgcataatccgtcagtctaacaaatcttctccctttttaggcttacatcaaaatctatcaaggagaagaacttccacatccaaagtccatgcttcaggtagagagagagagagtgatatgtgttgtacatatacttatttatgagggagaataaaaatctttgctttagagagaaatgctgaaaatggggggtgcttttttgcatgcaaacacattttgcttaaggccgtatgtgtcgtgggtcctaaggtttcatacaattttttttttgtaactgcagattgtaggccttccatgtgtccaggccaccagaaataagagtcctcagtaccttctcttcagatgctcaaagtataggaaaatttctatttgataagatggcttgatgtgggcctctctgaactaagctgcttctattctgagtctttgacaatgaatgttgtttggaataagtcttatttttatttggtgttaatgatttagagctacttctagtgaatatagtctcacttctttttctgtctttcaaatggtggtcttttgggacagtgtcattttaccccattcatattttaaaacatttactactttaggctatttttccattttatagtagattaaacagtatttgccgataaaacttcgtgcagtaaggtttgtgggtttgaaaatgtcttgtataatactgattatgagagagagaaccatatgggtaattctcgattcctaacacctggagatccacatattttagggttatatctatttatctttatccatttcctgagcatatgtggtgttttctgcagacacactttaacatcaacctaagcaaaacaaaatcaggcaggcagtcctattagaaccacttaccattatatcctttataccaacgttcccttgcataggaaagaaaaactggaagttactttctctggttcattttcagacttgtttattgtacataacttattgtgttaatcagaatttttagagtcatagagtattttttgcataataatggcatattttattttttaggcaacagctgaagctaataatcttgctgcagtagcaggagcaagagatacctattgtaaaagtatggaacaggtttgtacctaaaatttaaatttgatgctggagtgagaagatttttaaattaaaaaaaaaaaaattaaaaaaattttttaaataattgagcgaatttgtgcagcttatggtacattattccctaattcccctttatggtctttgctggaaataaactataagaaaataattcacattatttgagagcagaatttgagttagtaaattattatataaactctactgaaatatcttctgacaaatgtgtgattcagagtgctgttattggtgacttctgatgttggtagcattagtttaaggccagtagcagtttctgtacttgcttgctcaaacattaaaatatctttttggggcattatcatcttttacccgttctcttgccagcaattttgtgtgctattatggtatatgatggtcaagtgaaggcagatacagagcacagtgtaaaatttttttgtcttcagtttccgttagtcatatttggaaaatgattttgcttgagtaggttcaacatataaacaataactagattatgataacctgtgaggtattgtaagtgagtttaaaactgactcaatcatgtaagtggtttgactttctgagactaaaaactatgaacaggaacttctttcaagtgttaattatttctagcatgtaatactgtaattctgtctgtccaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggttggtatctatcttttggttttttagtgactaatcttattttcctgtgactttccatcctttgcagtatttgtactccgactttgccttcatgtgaggaatgtcaaaaggatgtcttctgttttgttcagatgtagaatctttatgaattgaagattttttctttaaagttataattttaatgtactttggttagcctaaatctgtactatcctctggatagattcttagttgtaggcctgattgtatcagacggtgggcagggtcagagtctgtaatgatttttttctttgaggaaagaaaatataaacaatgaatgattttcaaggtaaggaaaagaagtttggaagtggtgctttcggaaagcaaaagaagtttcttcctaatattggcaagcagcaatgcaggagaaatgctggatggtagacaggtcttcattgccttccatgaagatggtagtgatttcctgatgtactatgaggaacaatcccgtagggatttcttaccaaggaaactttgacctttgtgttttggaaatattaattagtaaagcaaagcgccatgaacagagaaccatgctccgtcgtaatcttttacctcgaaccagaattcaaagccccaggctgtgaactcttgcctgcaagtatctgctaaggaaagccattttgtgtatctgcctccggtgtgctggaattacctgtggaccgcttatggatgtcattaagatgatcttcgtgaaatacttgaacatcatgtcaaggaccagaatgaaagctacggttattaatgacgaacgctataataggcatttgagatgccatttttgggctcatgaaatattgagcttattttgaagatctaggatatgcaggtccatgtttgttttggctataaacttgaagaccgaagaagcagaccattttttttgaagaaagttgattggatattgacttttcttgtaatgatgttattttataaagtgacccactatattaatttggattttgtgtttactctttagagaaatgctctattcagatccgattgggaagtttatgtttggatatttattctatttaaatttttatctcaatctcactacttgatgtttctttgatatcttctaatagaagatggatgcaaagctatcgcaacttcacttttaagaaaaaattagctattttaaaattttggatcattttctgcaatataattttcaataattgtacaatatcttcttttgagaaatattcatctcttaaacagcattgattctaggattttggaggtaccattattacaaaacaattaaatggaagaatctaaagtgtataaaatcattttcagtatagtttaggtaaggtaatcagctagtcagagatctgtgctgtgtcaacaaaccttgtctaaatttctttgcatttctcttttcttttgcttcagaggagtcccaggaaggtgagaaacctacagtctcaaattcttgtagtcttaaactctttagcttcgaggcactctgattcattctcctaacaaatcacttcatgttttaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcc

SEQ ID NO: 38183 - DNA, 10408 bp, Homo sapiens
ggcgagaggcgggctgaggcggcccagcggcggcaggtaggcgcggccgcgatgctcgcgcgcgggccggggcccaggagctcccccgtgccgggcaagggggcgacctcggggtccgcgctctcacccccaccccgcccactttgtccatcaggtccgggggcgcccggggcatggactagccttctcgaccccgagcgggccccaccgagggctcccgagagccagccgcgcccctccgcgccctcgcatacctggctgcccagtctcgtctcccccggtccggcccggcgcccacccgtcgggctgccctcaggggctgggctcgggccaggagatggctgcgccggcggccaagcccggtccgggtataaatagctcggtccgcggtggcggggggcgcgggctatatttggtggggctgctgcagccctccctgtatgggtggcctccccgagggagtggggagcacttgcgctcgggccgtggcgctttcccctgttcgcaacaccctgaacactccccgacccacacccgcccttgggcaatgactaacagcccgagaccgtgcagggaagtgggggaccctctccagagccaggctgggctccctgggttcgccctacctccacccctggcccccagctcgtgggaaaaccaggcgcagcctttggtagcctcccacttcctaacccacgcctcagtttccctatacgaaaagtgggttggtcaggagcctccctgggtgttgggccagtcaagagacaggagccgcagagtggaagggaagcccttagctctggccggggcctccaggggtggctggagtcggtgagggacgatggggggagccgaggggcggctgtcctcctctctgtcccagaggcatgggctgaaagggtccctctcctggtgatggccagagtcaggcctgctgggcgggaaatggcagttggcccaccccaaggcccaggggcttgtccatgctgagcacaagggtgggaggtcttgtgtctgttggggccggggagtccaaggtcccagcttcactgcacaggcctggaagtcaggtgggtgctggcctgaccctgctgaaggagggtctattccgccagcgtggtgtggaggcggctgggctcgactccctcatggagggaaggaactgaggaggtgctaggaggccgtgggggggtgtctgcccccagagaggctttgagtgcatgggggctctgccgtggcacgtgcagcgtctgtcccccagggccccatggtgtggacagagtctggggtgggcacctggaggcctggtctcaaggcaggcttggtaacgaccccatgtgaccttgggcagggcccgccatccaggccacccagaaagccatgtggcctgcacgatcaggccagaccccactgactggagcggggcactttactttggaggggcagctaccagagggctctatggatcccagcccagccgtcaggccggacgggtcccccctactggcctgcagtgacccttatgccaggctcggctggctcagcggtgggtcctggggtgacctggccacgtgggacagaagggcctgtgccgctccctccagtgaggtgccaaatgtgggccacactctgggccccagcgggggccttccgggcagtggcgcagagccattggaggtgcccgggccctggggcaggggcggggcgggagcagacagagctcagggcgtcctcctagcgtcacctgcccgagtcaggcccatctgtgaaatgggccacgccgggcagccgcacgcaacggaaccgaaccgccgggctcctgctccgagacccgcagttcacgagtcgacgcccccgagtcccgagccgcgcccactggtcccacctctgcagcaagtggagtcggccccgccctgtggcttcgaggccccgacgcctggcgcggctcccgggctccgctgaccccggtggacccgcgcgccggcaattacggtagcgtccagtagggcgcctactgcgggcaatacgggggctcctcccatggcgcggtcacgtcccccacgtcccgcggctggcggggcggggccgggcggagcatccttccctccccctcccccgggtgggccccgcccagcctcgaccacccgcgccgacccccgcccgcagagccgggaagccggaacccgcaggcgccctccagccgtccctccggcccgggcggggattgcgccgaggaggggcctctcctggcgagggtggagttttgggttccccccttcgccccgcacctcccgccttcctgcctcctcccggtcttcaccttcccccccgggtccccacgacgcccgctgggcggcggtggggtagggggcgcctcctgacccgactccccttccagccttggccttcaggcactggctttagggtggaggggcggccttgcggggtccaggaggcctcggaggtgggggacggcggctctggaccagctccggcccccaccacctcccggccccagggcggtgacagccttgcggagaaggggtcttcaaagctctgagaccccgcagtgccagctcaggattgaagcctgcggcggcacatgcagccttcctttcccaaaggggacttgcgcccagccccacttggggcaccagtgggggctcctggccctggccctgggtgggagtggccaatccgcaaatgaggcctgtgtgtctgccccgccggcccctgccgtcgtgatgtaagcggacacagagcggcagggcacgggctgcgcgaggggtctgcgggggtcagaggtggggcgcagggcccaggcctggggcagccccttgcgcagcgtccaccccctgcaagctcggccccgacacctttgcaggcgcctggggcggggctgccgggagttgctcactgctccttccttgtttgcacaacaggggctgcgggggaagaagggaactgagggaggcccctcccccggtgcagcgccctcccgccctcggcacccctcggcagccaggcgctggccacagaggccgcttccttggtcctcaggcagctcatgggatccaggaaggaaacgaattacccttttcctgccccgcctcctgcctgggccacaaaggcagggccaaagcccatccttcaagggctggagtcagttaggtaacaggccacgggccccgggctcaggccactgcacggacccagggaacgggctgacagtccagcagaggcctcagcgaggcggcggcgctgcgcacaaacctgaggacctaggcgggtgaggggtctgcaggtccagacgcctgaggggaagcatgccagggtgcccagtgccccccaaggtggtgggcgaggtttctggagaggtcccggaggagcgggcttgggcagcaggggtcaggttcaggaccctctgtgcatgagtccaggttgactctgcaggacggcatttcgagccacctggcatggcgttccaggcctgtgacggggcagtgcaggggtccgaactggcaggcacccaggtcctgaggacttcatggtcgaatcctggtctaaagccaggggtccttgcagagccctgcgccctgcaccctcgagggaactgcctgcaggagcccctggcttgggagggcgcatggctgtgggacgcagggtctcctgcaagggactttcccacccacccctgccccaggcctcccgctcagcttccagcagcctggggtcgtagagcctttgggggacctgctctccgggcagcccccacctgggagatcagctttctcatcccagaggccaggttatttctgggtgggttggcatgcttcctggggggcggcggggggggggttggtaaatgtcaggggaaggccagcctgtggcgtgtgcccacggagaggccaatgcttggtggctgtggcgtgtgctccaggcaggacagccccagggttgtccctggaacaccgggcagtctgtaccttggcccatcacggtgccggggttatcctggaagatggggagtgtgggccattattttgtgccccttccccgtactctacctcctgtggaatcccttgccccaagccatgtgggcagacagctggctccaagtcagcccctggacaccaggctggagtgggaactcctggagccatttcagcatggctggcaccacaggctgggtgaggacagacgatggtgccaggttgtggtctgggggcttgtccaaatgcctcatcttgacacagaagatggccctccccacatgagcgtcacgtggaagccacaagcacctcaggtctcagaacatgctgtgctctcctggtcagtgagtcctggcactgccccaaccctctgccagccctccttgacactaattcaggggcgccgcgtctcctgagggtggccactgtcccctgcctccccacacgccctcgtctgtctcctgaggaccctggcgggcttcaaaccctgggtctgcctgcgtctcccacccccgctggtgcagccagggagactcagaggccttggtacctctttgtgttttgcagggggaacctggggtatgcaaaatgtgtctattcctgtttgttgtatacacatttccttccttggccttgcatggcctgtttatttttaaaagtgcaaacttgcaaccccaaacaagctggggccctgaggccgtcaacccctccagtctcccctgtgacccgcagtctgcgtcctgttcccagtttcattcctcaagtgcatatatttttatttttttattttttttttgagacagagtctcgctctgtggcccaggttggagcgcagtcgcgcgatctcggctcactgcaagctctgcctcctgggttcacgccattctcctgcctcagcctcccgagtagctgggactacaggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttagg

SEQ ID NO: 38184 - DNA, 19314 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaagtgagtcctgtagggaagccctattgaggccgggacggaacagatcccccttccccacacccgtgcggtcgggcgcccgccggccaaccctgaccggccccctgcagaacgcggcccgtgcccccggcccttctcgagtatccccacgcgtccggggtgcggccggctcccctggcccctgctctcactcgtcgtgggcagaaggcgtccctgggtagcgcggaaggttacttctctgtgtcccaactcttcctgttttgtttctcccatcaaagtcaaatttctggaagtcatcaagcccttctgtgtcatcctgccggaaattcagaagccagagaggaaggtaagtaccccaaatcgccaacaaagaaggtttcaggaaactgtctggactctggaagtttacagtatgattaaaaatggcttcagcacggcaatggaaactctcccttctcttcccttggagtgtagttgtgctctgttattccggagagctgtcgaaaggtgacctggttgtgtggaaatttccactgaaatcactgtgctttatttggagcatctttggtggatgttgctccgagaacaaagcctccggttgccctgtcccaaaaatggatccgggccatgaatgaataaggcctcagttaggatagcagattgagttaccctccctttttcacctccaacgggagcagatcacgggttggttttttttcccaggagatgccctttgtatccagctgctaaagggaagggctgtcactttagtatttacaaatgattttgtaccttttatgtaggctgtcacaatagggggaataaaggctattcttttgtgaagtctgctgcttttcacagacggtgtattaaaacaaggaaagattaaatttagagctgtgctgaatcagaaattgtgtggagtgagtgttgccagtgtaactacagctgtcaacgaaaaaaagtttcattaggttcctaggttagagagtggggaataaaatgtttgtgtcctcacattatttttcaaactgttgttaaagcattcacatggacacttgggtgcttggaatccactttcatttttttacgtaaaatagtttcatataaatgcccatgtgctgcttttaatggacgaatttgtaaagctttaccccctcaattccagtgtagcgaaggggcatggctctggaggcaggcaagcctaggtcccaccctttacatagcaccttaatagctatgtgaccttggccttgtaactcagtgtggtagacggaacaagggaaatacgtgcaaggtatagcagtggctcaggaagggattaactctgggagacatgatgtcttatggtggttttgaaggagaaatagaagtctccttgaagggacggaaaggaattccaaataaaaggagtatatagtttgcaaaggcattggtgacaagagtgtagcatgtttggatgggaggttattagatgtagttgctattgatagaacataattgtaggtggggaacattaggagatgaataacaagggccagacatgagaatgtcactttggaagaaaaggagaggactagagttggtttagaggcttttcacatcagaggatgaactgtggtactgagcaagaatggatttaggggctactaagaagcagaggagacaggacttggataaagagcttttggggttttgatgttaaatttgattgtaaccaggagagaggacttggtgattagaaagggagttttgaaaaaattgtctgctctttgtttcccatcaagattcatttcagacaggttactctgaaatggcgttgccttctcttggccactttctaatttcttagtgtggtgggatggtaggtgggaagaggaccattctcaagagaagaagagtcctgtgaatgcccccagctttggatggagtatctgaacactgattcacccactgttgtgtggccgtatgactgtgtcctactttgcctgcatgtatagttagaggactgtgactccagttctggccagagggccaggaatgctgactcagtgcctgcctagaagtgtttttaaagaacacagttttgtcacttaatactgtcagtctctcacaaggtatttcaacctcagaatcttccgtctgtacaataattaatgtttgttaagccctctaaagccattaatgtagtgtaggcagcaggtattagtgaagacactcagtttcagaggcagaaaacctggaagagttcccactctactctttagtgacagaggttttgggtgggaggttttctaatgatacttaatacttaatagtcatctttacagtgattcttgtcacctatgcaacctatgtacctgagaagatgtgaaaatccttaaacaaatgttactagtaggttaaacatgcaactctcctgcccttccccaatatggtttattacactgttttacccttaattcatagaaaatacactattgagcaattccaaattacttgactctagaataacaaggttttgtgactgaaactcaaatgaaaagtggttgctcgtgtgttttacaagtcatgttctattgtgacattctttgttcttgagtcttaactgttaatgctaatggttaaaagcacagtttgggactcaaactcactttagcattggggtttggtacaaattatttagctcttctaaggctcagttgtaaaataaaggtaatgctctgtggtgtgaggtgagctggggtgatgcctgtaggtccttgcattgtgctctgtgcagaggaagttacgcagtacatggtacttatgtttggtacatggtttggcttctctgctgaacagagaaaagagtctggttggagtccatttttagagaaaggggtctgattggagtccatttttattaatttgcttttcaaagtaactccctgcttcaattcattctctcctactctagattcagtttaaggagaaagtgctgtggaccgctatcaccctctttatcttcttagtgtgctgccaggtaagctcaggcttgtatttcgtattggggagggggataagagtggctggaaacaggagtgctgactgttttgctctttgcctgttcccagattcccctgtttgggatcatgtcttcagattcagctgaccctttctattggatgagagtgattctagcctctaacagaggtaggactctggctctgtcttttctctgtagagtgtaggcttacctagcttcacttagttaaattaataggctttggctttatatggaacttagagagtgacttggaaaatagagtgaagaatgttaaagtgctgtgttgaatagccttattaaatgctgagttcagcaccaaggcataccatcatatttggaattgtatttgaatgcagtacaaaacctgtaatgagaagataagtctatgctatagagagaataaaaaacatggaaaaactagaatactttttgaatacctgaaatgatgacatttccattgataacattcttcagaatatgtaatttgtttttcagctgtatctttttcatatctataggttacatatagtgtcaaaaaatatgtaacagtgttttatatcctctaaccagttacttatgggactggggaggattctgaatgtgtaggttgatactgcatttgattaactcatttaaaaaatatagttcaattaaattccaaatcagttggaagtgtagctcattttaacataatgggaagtagaggcttattcacaactagatacaattgtacaggctccttttccagactctggaaattatttgaatgttatcctttttttattaactgatgaagagacgaacatttcttatctctaaaaccagaatgaatctgtttatggtgaatttaaatgcagcagtctgtttagacaccatgtgacttcctaaacagaataagctgttgcctggcaggctgaacagaatgaattgaattatatactaatcgttgatattttggggttctaaattaaacacagctaggaaactgaaacacattggttttatataaggggtacccagtcaaattttgcgtattcatttttaaaataacgtactacgtttccaagctgatattgactgttttgcttccccgtttcctcaaggcacattgatggagctagggatctctcctattgtcacgtctggccttataatgcaactcttggctggcgccaagataattgaagttggtgacaccccaaaagaccgagctctcttcaacggagcccaaaagtgtaagaaagattgtgaataatctgatgtctatagttggaaaatttgaatttgctataagattttggtatcagtttttctttttttatttattttttatttttttttttttttttgagatggagtcttactctgttgcccaggctggagtgcagtgacgcagtcttggctcactgcaacctccacctcccaggttcaagcaattctgcctcagcttcccgagtagctgggattacaggcacgtgccaccacacccagctaatttttgtatttttagtggagacgggatttcactacataggccatgctggtcttgaactcctgatcttgtgatccacccgcctcggcctcccaaagtgctgggattataggcgtgagccaccatgcccagcccaaacagtattttcttttgtgctgcaacctccttggcctgccaaccctgcaggagctccatgccctgtgttagcgtgagagagcacttctggtagagcagaggtggtgggtgctggggatgggctgggcaaggcaggggagagtgtctggagtgcccctgaggccatgtaatggaggagaaggatcagagcttggaggtcttagcacccttggccaccatttcattattgcttaaaaggaagtaatggctacttcagagctgtcataaggattaaataatcactgtcacaatgcctggcacatagtagttatttggcaagtgttttataaaagaatttaactgactggggggcggtggctcacgcctgtaacccccagcactttgggaggctgaggcgggcggatcatctgaggtcaggagtttgagaccaacctggccaacatggtgaaaccccatctctactaaaaaaatacaaaaattagccaggcgtggtgacaaggtgccttaatcccagctacttgagaggcagaggcaggagaattgtttgaacccaggaggcagaggttgcagtgagccgagataaagccattgcactcaaacatgggggacagagcaagacttctctcaaaaaaaaaaaagaatttaactgaagaaaaggtgatcctgtcagtccagctgtataatttaccagctctgtgatctggggaaaagttagatgatagctcttatgtttcactttcttcatctgtaaaaatggggataataatggtatttgcctcatatctaataagtgttactagtaacaattactagtcatcaaaattagccatatttagcctctgtttgctgaaaaacattaattaggaaatgatatttacagtctcctatccagtcatcttttcgcctacaccagcatgttttacaggtcttaaattagtatggtggataattgaatgagaaatacgtctatttttttttttttttttttttttttgagacggagtctcactctgtcgcccaggctggagtgcagtggcgtgatcttggttcactgcaagctccgcttcctgggttcaagccattctcctgcctcagcctcccaagtagctgggactacaggtgcccgccaccacgcccagctaattttttgtatttttagtaaagacggggtttcactgtgttagtcaggatggtctcagtctcgatctcctgacttcgtgatccgcccgcctcaggctcccaaagtgctgggattacaggcgtgagccacagcgcccagccaagaaatacatctatttaaacttgtcagttttagataaaaattaggattctaaaatacacacatgtggctgggagcggtggctcatacttgtatcccagcactttgggaggccaaggcaggatgattgcttgaggccaggagttcgtgactagcctgggtaacacagtgagagagaccccatctctacaaaacaacaacaacaaattagccaagtgtggtgatgcacctgtagttctagctactagggaggctgaggtgggaggatcacttaagcccaggagtttgaggctgctagtgcaccactgcactcctgcccgggcaacagagcctgtctcttaaaacaaaacaaaaaacactaagaaaacaaaaaaagtacaagcacaaattggctgttttctctttggtcttcacaatgttttgaatgttttcctgcattaagaactaattgttgtggagcactttttaaaaagtcaaatagggactgtatttgatggccactttggagtaaaattaattttacatgacagattaaataggaaagctgaaactgaaggtcagactgtacttagaggacccatctagtactgtggaacttgtcaaatgtgtccattcccttgtgcctaacagtgaaatagagtgagttgtaagaaatgaagacaccctacaaaaaggaaagcttttgccaggcgtggctcatgtctgtaatccccgcactttgggaggctgaggtgggtggatcacgaggtcaggagttggagaccatcctggctaacacagtgaaaccctgtctacactaaaaatacaaaaaattagctggctgtggtggcacgtgcctgtaatcctagctactccagaggctgaggcaggaaaatcgcttgaacctgggaggtggaggttgcagtgagccaagatcatgccaccgtactccagcctgggcgacagagactccgtctcaaaaaaaaaaaaaaggaaagcttctattagaccaaaatagcttggtacctaagggaatgggaagagcagccaaatcaatggtacgtggggttttccttttaaaagcacattaaataaaaacttgagaagggatcactttaccccagagctaataattctgtcctctggacccagacctggatggtgagcctagagaggtggcccaaatctgtagttcagctcttgagccatcgagaccccaagtgcctgacattgagtttgggtgctgcaggtgtgacatctccagattgtgtctccggatgctgtcaggagtaggttctactccctgattttctttgaatagaacaaattttccaagtttcacttttactcctcccatgactaaaaagcaagtgaatctaggaaaaggtaaaactaaagaagaagtgtgcttttgttaaaaggcttttgattcatcatgtactttgctgatgtgatggtttagcgcgttctcagccgagccccttggaggtagtatcactgctcttcatctttgttctcccccgtgcctggcgttgaattggtgtttcttaattgtttcttttgttctgtgtagtgacccacttggaaaacacttctttctttcaattctagtatttggcatgatcattactatcggccagtctatcgtgtatgtgatgaccgggatgtatggggacccttctgaaatgggtgctggaatttgcctgctaatcaccattcaggtaattattatgctaacatctccctttgagtagcccctcacacttacctacaattctcacataacgaatctcaagcacacctaaaaggaactcctactgaaaggaagcagaagcctaagactctgggttagccctctgaattcagcagagaaaggctttactgaccgctctctggggctgaggatgtgatctcattccgtcttcagcgtttatatcagagaacccaattactgaaggacggaaccatgtccgtggggagcagtaacacatagtcttgtatttttgaatttttacagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggtaagggccctgtgctcccctggtggcgacagctttcagcaaaaacaattgagcaatgcaaagcagaagacaaaaatccccccattccacagaaaaataatgtcagttttaggtttatctcttctggtgtttgggtccatctgcaaagttttaaaaacacaaataggcttgtaattatgatgatacctaacttgcacttttcatataaaaatatctcctggacgtttggcacgtcagaatacacaatcctgcctcacttttcttagcacagtataagcttatattgcaacgataaagcaacgttaagtcatttccaggtttttttatcgttaacattgaaaccatgactgtcctcatatgttcatctttgtatattttggcagctgctctcagtgaataagtttctaaaaatgaaattcctaaaccaaagcacttggtcatgcaaggggcagctttctgaaaaaggcctgaacttggagcttagcacctgcgttcaaatcctggctgttcctgttagtcatacatacgtggctttgggcagattcctgcaccactgaatcttggttaccaggatgcagtgagaagcaacatgaaattacatgatgcctggctcctggtagatgtgtatcaaacattggcatgctgtgctacatccaccaagtgccgtggaaatcttgtaacagcatgtttttaataaaaagttcaaaacatacaagggaagccttagagagtgtgacttattagggaaaggaaataaacattttttggcactaaatatcttcttcactgaggagcattccaggagaaataatcatgcatatttgagagttttcttttaattgaatgttggaaacagagtccttggcctccagagaccatattatctcattaatgagatggaaaactggtccccaaacaagtgaaggctgcatgtgcctaacaggttacaaaggagagtggagcttgagatagggagccatagagaagagtgggcaagatcacatttgatgcttccttgagtactttgtataaatttaggaaatccaaggtaaattgggagaagcaggtccagaaggcaaagtttgacaggatgtgaaaaggcaagagggggatggcattgtaggagttcaggtatttgtcaagaccatcatggtgactggcttttggggagtgcctgagtgggaaggaagtaaagtcagaggggagcccctggtggcttagcagcccagtagtagccgccagaggctcatgttccattctgcagcagggcattgagtaatgggagccagagtttggaagaagtgatttgctctgcactgaaaggcagagagagcagctaggtgcgtgcagcagtaatccagccccaattaagccatcctacaggagagcactgtgtgagggcatttggaggaagcaagttgagagaggggaccagagaggcactttcaaggtgggggaaaactaagaagcaaaggtggatttgtctggccttgaagtcagtgtgtctacatgtcagttgctcgtgtttgggacctggctgacacgagatgcattcaggaagggctgtgccccatggcctgcatgtgggcagtgagtggtgctagagggagagcctagggaggggcagggagagccacacagagggcacagctgggacggcagctttgcagctgtgcctggagatgttgcagcttggcttgggacaggggaggctgttgaatgagattctacaggcagagacagtaatcactgctgcttccctgggcagcaggaacaatgcagaactgggaattagtcccaaatttgaaaccgtggggaaacaggccagccttgtcacacaggaccaaaaggtggaaaggatgggaattgacgaaagaccgccacagggtgagatgaggacatgatggccagttaggatatggtgtctctttcacagaagccacagcagaggaggtcagtggtcatattggttagatggtctgcctgacatgtcatctcggaatggtccaggaagatgtagcaggtggtcctagctatcacgtgttagaaacttgggaacagtgcttttgagttctttagtttcaccttttcctagattcacttgctttttagtcatgggaggagtaaaagtgaaagttggaagatttgttctatgaaaggaaaatcagggagcagaacctactcctgacagcatccagagacacaatctggagatgtcacacctgcagcaccgaaactcaatgtcaggcacttggggtctggatggctcctgagctgaactacagatttgggccacctctctaggctcaccatccagatctgggtccagaggacagaattattacctttgggttaaagtgatcccttctcaagtttttatttaatgtgcttttaaaaggcaaaccccacataccatcagtttggttactcttcccattccctcagctaccaagttattttggttgaatagaagctttcctttttgtagggtgtcttcatttcttacatctcactctatttcactgttaggcacaagggaatggacacatttgacaagttccacagtactagatgggtcctctaagtacagtctgaccttcagtttcagctttcctatttaatctgtcatgtaaaattaattgtactccaaagtggccatcaaatacagtccctatttgactttttgttgttgttgagacggagtcttgctctgtcacccaggctggagtgcattggcgccatctcggctcactgcaacctccgcctcccgggttcaagcagttctctgcctcagcctcctgagtatgggattacaggcgcccgccaccatgttcggctaatttttttgtattattagtagagacagggtttcaccatcttggccaggctggtcttgaactcctgaccttgtgatccgcccgcgtcagtctcccaaagtgctgggattacaggcgtgagccaccacgcccgactcctatttgacttttttaaaagtgctcctcagagtactgataccatgaccccacactgcccacagagaccctgtctctggaagtaatgccagcttcctgccagtagaagcagcgtgagttgccaggcttccattatgggatggttatgctgtcctggaacggcagaggttatcacttgtttctttttttcgctttttagttttttaacgtaagtaaatttcttgctgatgtctaaaacttaggccttaataatgcaccacactccccgccttcctctcacttgttactctgttgtctggttcttagattgggtccctttcctatatccctcagtccctcagtaagctcactccacccctaggcctgcctccctcaggagcatctcctggcagggtgtcatttggatgggaccacatggtggacgcaagcatatcctctgtacttgtatccttggtgtgagaagcagagagctggagcctccccactcaccagccaagggcagcctgcacttcatagctgttgaatgggtacttgtacttctcaagattgtccaggaaagtagatttgccagctctgagccccctcttcagtggatgacccctttcagctagagttcagcagagtctgcttttatttttataaattatcatcgttccacacctctggtggccactgactcatgtgcctaagaaatgagaccaattaattttaaaaagtggaatagtggttgggtgctgtggctcacacctgtaatcccaacactttgggagggtgaggcgggaggattgcttgaggtcaggagttcgagaccagactgggtaacatagtgagacccccaactgtacaaaaataaaaaataaaaaattagccaggcgtggtagcatgcctatagtcccagctattcggaagtctgagataggatcacttgagcccaggaggagaaggttgaggctgcagtgagctgcaaccacaccactgcactctagcctaggcagccgagagagagggaccctgtctaaaaaaaatcaaaaacaaaccagaatagcccgtttctgtagtttgaattctctacagaagagaagggagggatgagaataatacatgctgtatccctgtggctatgggcaccatgagtctaataacttaagtttgttttcctctttttatttgtctgctaagaaggctagaagcaaattgagttgcctgttcgttccttcatatatgtctcctcctctgccaacaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccattaacgaaacaaaattaaggcagttctaacgtaagtgaaatcatgttcttctgggttgggcctatcgacaggtaagatacatttttaagttcttagttcaagagaagcaaaaagtactctagctctgaaacctcattgctctcttatagaaagtttgtatgatatttataggtaacttctgcatctcggaaacggcctatcttcttaagctgtcttacctttaaaagtattccatctcttaaacttgcttctgagtaagagacctgaactgctattgttttcctgtaattggattgatctttgtattttttgatggtccactttgtattttggtgtttatttaaaagaagggacagagatgaaaggcagtttgatgtttgtgaaaggtatttatacgagctacatgcttttcccattccttctgctgagactaagccacattcttgcttaataaaaagctatctctttaggggctttgccagaatttgcagtcagatcattaagaattttttttttttttttttttttgagacggagtcttgctctgttgcccaggctggagtgcagtggcgcgatctcgactcgactcactgcaacctccgcctcccaggttcaagcgattctcctgcctcagcctcccgagtagatgggattacaggtgcctgtcaccacgcccggctaatttttttttatttttagtatagacagggtttcaccgtgttagccaggatggtctcgatctcctgacctcgtgatccgcccgcctccacattacaaagcgctgggattacaggcgtgagccaccgcacccggccttaagtatttaatttttaaatcctctgtattccgagccctgttctaggtactgggagctcataaaaataaaccctttctagtctccaggggtttcagagggagaagttgtattcctagaaaagtttagcttttctgtttatgattaaaaacactgtaaggaactattataaggtgtgaggccactgctgtagtggccctgcctcagagccagtgtaaaagcttaggaaacatcaccagctagagagaagcgcccttgggatttgggtgtgtggcctccaggcttttctccatattccacacagatgtggatgtaatgtgataggctctgtcttttggaaaaaaaaaaagtgggggtggggatcattccaccgtgcttgcttccatgttttgttttgtgtgagacagggtctcgttgtgttgcttaggctggaatgcagtggcatgatctcggctcactgcagcctagacctcccaggctcaagtgattgtcccacctcagcctcctgagtagctgggactacaggcgcgcaccaccacacccggccagttttgtttattttttgtagagacggagtctgactgtgttgcccaggctggtatcgaacttctgggctcaagcaattctcccacctcggcctcccaaagtgctgggattacaggtgtaagtcaccacgcctagccttcagtgtatttttaaaccagcttttctgggccccttctggatgtgccaagtgcaggagtgcagtggtgggtaaggagtgggcacaagctctcggaactgggagccccagaaccagcacacaggatttcctcccttgtggcccactggacagtccccggccgggctgtgtttctgtgcagcaggctgaaatgaggcagtgaaggggatttggttctgtttggcttctcagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggtaagtaggctctttgaagatgagctagcaatgcagctaagttgcagtggtttctatcagtgtcttgctcatgaacagatatttcatccaaagatattttccattgtgccttttacaaattcagcacattaaattatcttttcagtaaaaaaattgtactgtgggcaccgagtaaaattgcattctttcatctgctcagaactatttttgccttgatgctaaagtaaaatgaaggagcactcacatgcgtttggtttcttcttccccaggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgtaagtagaagcaaaactttctggaagggtgatgaaagtgtgactggtataaggggtgtggacttgtcacctcatcataaataatggtctgtgacgtgtgcagatagatcgtcgtcctttagggggcagttcagaagctttaagggctgacagatggagtccagcagtagatcagctgtgggtatgagaatctgaatccacactgtaaagttagactttttcatatgacttccttgcggcagttttaaagttctctgtatgaatattgtcagtgctcgaagaggcgatctgtaactgttcagtaccacttggaatgcctatttccccttcagcctccaattccaacttctcccctgtgggcaccctgcaggttgcaaagcagctgaaggagcagcagatggtgatgagaggccaccgagagacctccatggtccatgaactcaaccggtgagtggtggccccaggtccccaacctcccgtctgtggacatgtgttgtttctttccatgcagggcatcctgataggccctagcacttactgggtcactaaatcttatccttgggttacaggacagaattaaatgttatatatttataaacttgctaagtgctggacactggagacgtaaaaataaacacttacagcccctttcctccagagggagccactgggtaaggagatggaagcatgtggccaggcggataggagacagtgcagtaagggtcctgagagcaacagctgtgactggcagcgggaccctcaccctggctcatgccggtggggtgctgaagagagcgccctggaggagggtcactctgagctcagagcaggcaggtcctggcatctgagcgcattttggggcctgtggtggcattaaggctagagaggctggcagtggctgggcacggaaggggttgatgtgcatctgaagcagggcagaagggatggagcctgcagtctcttaggaaggtcagtgctaatacatgaaaccacgctagagagggagagggggaggccacatacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctaaaggaagcaaccacaggaaaagccagaattgcaaacttcagatcattttctaatccctagcagggatggtaggcaatttagttcattctcttaatattaagctgctggatttacagcactgtgcagtagaagtagaattcaagtcacatgtagtttttaaaatttctagaagtcacattaaaaaagtaaaaagaaacaggtgaaattaaatttaatatatttaacctagtatatccaaagtatcatttcaacattataattaatgttaagaaaaaccatgatgaaatattttacatccttgtcttcaaatctccaaaatcttatgtgacatctcagtttggtctagtcacagtcccctggccacgtgtggccagtgtggccactgcctggacagcagcgccttggcctagagcgctagcatgttagtagatgactttctaggagacagcagaggggcctttgaggcattaggtcccaaagtctcaggtgagcctgttggccgcctggctcacggggagctctgtgggtgtccaggagctgactgtgtcccctcccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggt

SEQ ID NO: 38185 - DNA, 4924 bp, Homo sapiens
cctcccatcttccggtctcctcagaagtcgcttagctcttcggtggttgtcccacgtccggaggcctagccgtcgcttacctaggatgccgcgtggaagccgaagccgcacctcccgcatggcccctccggccaggtgagaccatcgcagggtttgagaccaaagcgcggccgtccggactctactggggcaatgacgcagagggaggccgcgggcgggggtgaactaaggtcggctgcggcgtgggctcgcctctgccaggcgggggtagattgaacgtaaagcctatgttaggggagtgtggggagggaattcacttacggaaaaagcttcctatccaaacaacgggaaaggcataacgttatggccaggtggtaggaaggcataaattttgacctagcttgatttcggggaaaagagcacccaaggaaataatccggaaatggtcagagggagcgtgatacatatgaagatttttaaatacgtgcaggacataattagtcttttgttatttgagaaggggtctcgaaattgttgaaagcatctgaacgttgaacagatgaggaatagttgaagttgcttttggtataatagttcagacgagtcactttggccagtcttgttttgtaatgtgtaaaatgaaggaattggactagattatttccccagttgaccatctttaagtcctaattagaatgtttatttatttatattttgagtcagagtctaactcaggctgtagtgcagtgacgtaattatggctaactgcagccttgacttcctgggctcaagctattctaccacgtcagcctccagagtaactgggactacaggcatgcgccacctgtgcaccacacttggcgactttattctattttatattttagcagagacagggtctcattatgtggccctggctggtctcaaagtcctggcctcaaatgatcctttcgcctccacttccctaatcactgggattacaggcaagagccaccactccgcagcctatgttaattatttgatccgtcaataaaatgtaaactccatgaatgcagagatttttgtctcttgttcacagttacattaccagcgccttgtagttacctaatacttgaatgaatgaatcctgtaagaatctttctaacttttagtagtctgtatttcttatgacatgttggatatgtctttaaagatactgtgggctatccgaatacatggaaattgttgcaaagaagcagaaaaaactagtatgtcctaggctattactattataagaaaagattaaagtggccgggcgtggtggctcatgcctgtaatcccaacactttgggaggtcgaggcgggtggatcacttgaggtcaggagttcgagacgagcctggccaacatggtgaaactccgtctctactagaaatacaaaaattagctaggtgtggtggtgcgcgcctgtaatcccagctacttgggaagcggaggcagaagaatcggttgaacccaggaggcagaggttgcagtgagattggatcgtgacactgcactccagtctgggcatcagagtgaggccctgtctcaaaaaaaaaaaaaaaattaggccgtgcgtggtggttcacacctgtaatcccagcactttgggagtccgaggcgggtggatcacctgaggtcaggagctggagaccagccatggtcaccatagtgaaacctcgtctcaactaaaaatacaaaaaattagccggaggtggtcgcgggtgcctgtaatcccagctactcggaaggctgaggcaagagaatcgcttgagtctgggaggtggaggttgcagtgagctgagattgcaccattgcactccagcctgggcaacaagagcgaagctccatctcaaaaaaaaaaaaattgaagagagaaaatgatgtaaataatttgaaatgaaaatcttgaggtccattttaatatgtaagttattttaagttgacaatttccaaaactggttggaattgggaacttgatgtttttttcttttctttcacagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggtgggaatttaggcagcatttcccttccatgggtggattttatgagaaaagccagacgtttgtaagttccttaagtgtaggaattgtctttgattttagaacccactgtgctgttaatagacaatgggttttaaagccacatttggccgttgagttactgccttaggccagcaccaacaagtactgtacaaattgtgtttcttcccaaggaggagacttacaacagtccacttgactcactgtaaaacaaccacttttccctttgaatatttcatcccagtgacacttcctactaatcttgtcttgatcttagttaacaaatcaaaaatctcgcatagctgtgtgttcttttacgtgatgtttgccattacccatctttctgatgtgtgtgggctttctagtctaatgagcataggtgtgtatactcttgtatttccggtgtgcttgaaactgctccatccagttttctataatagtaccatttttcctccctgaagcttcagtaaaccatttagtcttgataacaagataataattccactttatttgcatctttatttaggaatctttctggttgtaattggaattttgttaaaactgttggctttcagcttttaaatattttcacttttggctgggaacggaggctcatgcctataatcccagcacattgggaggctgaagtgaagggattgcttgaacccagaagtttgagaccaggctgggcaacatagcgcaaccctgtctttactaaaaatatttatttaaattcttcttttttggaggtggagtctcgctctgttatccaggctccaccgcccgggttcaagcgattctcctgcctcagcctcccgagtagctgggattacaggtgcctgctaccacgcctggctaatttttgtatttttagtagggacggggtttcaccatattggccaggctggtctcaaacgcctgacctcaagtgattcacccttctcggcttcccaaagtgttggaattacaggcgtgagccaccatgtttggcctaaaatattttttaagtaaatgaagatttaaatgttttcacttcccatgttaatagttggaaactttaattagcatctggtgctagttccattttccattaacctcaaagaggatggatactcttcattgtctaggcataagtatgattttctttctcagcaatgttgaatgttttgcctttgcaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggtaggtaatttgtccaatttacatctgcttaattcacagtggaattcctggatcctgtagaacttagggtaatctgtgtttaataaattagagaagactttgttgaaatttctctagaattaactcctaacaactgggccggaggtttctagtcatttttatgagtaattttctgaattttcttcctttagaaggtataggccaggcacagtggctcacgcttgtaatcccagcactttgggaggccaagacgggtggatcacctgatgtcaggagtttgaggccagcctggccaacatggcaaaaccccatctgtactaaaaatacaaaaaattagctgggtgtggtggcaggcacctgtaatcccagctactcaggaggctgaggcaggagaattgcttgaacccgggaggcggaggttgcagtgagccaagatcctgccactgcattccagcctgggcaactgggtgtctccagtgggagacactgtctcaaatttaaaagaaaaaaaaaaaaaagaaggtataaatcagtatgccagatcttactgtgattactggatgtaagtgaccttctaaccttaaggctgcgaatataagattagattctgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatcaaaaaaaaacaaaaaacaaaaaacccatagccttggccttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcc

SEQ ID NO: 38186 - DNA, 19378 bp, Homo sapiens; identical to SEQ ID NO: 37367

SEQ ID NO: 38187 - DNA, 19378 bp, Homo sapiens; identical to SEQ ID NO: 37367

SEQ ID NO: 38188 - DNA, 1642 bp, Homo sapiens
ctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 38189 - DNA, 36906 bp, Homo sapiens
agctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacggtgagggatcggatcgcggcgtcgccgctctgctctctctgtccacctgcgtttctgggcggcaaaggcagccctgaggtttgcctgaggacctgggcgactttggctgcctccagggttgaaccggcggcccagccgcgcagtgcgagggggggcggcgggcgggccgtcgggtaaggtaaatatttattgaaaagaacgtctgcctctccctcctttgtttacatttctgttccttggtttcctctctggggactgaggccttcggatggctggggacatccccgaggccaccgtcttgcccccatgccctgggttttgtcattggttgagaacgatcttctttcattactgcaaggagactttgcaaactatacgctgaatagtttgggttaagagttgtaatttgtagctcttcttgtcttttgcttcattggagcttttcttgtcttttgcttcattggaaggagaactaaagatttcttatagtgaggcagcgtggaaataaataaacgtctttggtttaataaaaaggcccaagtttttttttgaagacaggcttgctgtgtcacccaggctggagtgcagtggcacaatcatagctcattgcagcctccaactcctgggctcaagtgatcctccagccttagcctcccgagtagctgggaccacaggtgcacaccactgtgcccagctaattttttaatttttttttttttgcagagatgtggtcttgctgtgtttcccaggctggtctcgaacgcctggcctcaagcgattctcccgcctcggccttccaaaatgctgggattatagatgtgagccaccactctcagcccccaagttttcttgaggcttttgtttactaggagatacggggtagctaagttacttagcatagagtaagagatgcttaaaacattgactctaactaggtgaaagagtccacaattttgatgaaagtgaaatagagtctttagttgctgccaggtgttttagcaatattaaaaattaaattgtgctattaagaatgaatacattggcccagtggggtcacgcctgtaatccagcactttggaaggctgaggtgggcggatcacctgaggtcaggagttcaacaccagcctggtcatcatggtgaaaccccctctctactaaaaatacaaattagctgggcgtggtggcggtcgcctgtaatcccagctactttcgaggctgaggcaggagaatcgcttgcttgaacccaggaggcagaggttgaagtgagccgagatcgcaccactgtactccagcctgggagacagaggaaaaacaacaacaacaacaacaacattgattcaggttttttttttcttttttttttttttatggaatgcttcaggaatttgtgtttcattcttgtgcgggagctgtgctaatctctgtgtcgttccagtttttagtatatgtgctgctgaagtgagcacgattcagggagattttaactatatggtaattccaatagaatgactgcagagaatacactttgatttgaagcatgaaacaaaaaaatgtgttgcaattgatttaaagctacaagttattcctgtaagagaaagcatatgagaaaaaataaaggtgcaaaccgagttgaaatggttttgattgattcaaatggaattaatacatggaaatgttgttgcatttttatccttaatactacctataatttttttttttcttaaagagatggggtcgtccgggaggcagaggttgcagtgagctgagatcgtgccactgcactccagcctgggcaacagagtgagactctgtctcaaaaaaaaaaaaaaaaaaaaaaaagagatggggtctccttttgttgcccagtctggtctcaaactcctgggttcaacggatcctcctgcctcagcttcccaaagtgctaggattgtaggcgtgagccactgtgcccagccaagcctatgatttttgaccagaaagagaaacaaaagcagagtgtggtagtaattccagtaggctattaacagaagaaaattttaaaaaactattttttaatggacaaataactttttccccacatataaggtggtatattatagctcagtaatatagaaagtgttatgtcataggaaaagtccctgctgtaaacatgcaagtgtgtcttttctgtaacattgtgataagggtttctgcaaactaaagataatttttgaagggagtgatcttagataagcttttaaaatttttcttttcctgggttaccgagaatactgttgtgctgacatatggccttttcttccaaagaggcccagaatgtccagacagagtttatatatatatatatatatatattttttttttttttttcccttgagatggagtctccctctgttgcccaggctggagtgcagtcgcgcgatctcggctcactgcaacctccgcccctccaggtttaagcagttctctgcctcagccaccggagtagctgggattacaggcgtctgccaccacacccagctaatttcttgtatttttggtagagacggggtttcaccatcttggccaggctggtcttgaactcctgaccttgtgatacagctgcctcggcctcccaaagtgctgggattataggcgtgagccaccgtacccggccttttttttttttttttttttgagactgagtctcacaccgttgcccgggctggagtgcaatggctggatctcggctcactgcaacctccacctcctgggttcaagcaattctcctgcctcagcctcctgagtagctgggatcacaggtgcacaccaccacgctcacctaatttttgtatttttagtagagacggtgtttcaccgtgttggccaggctggtcctgagctcctgacctcaggtgatctgcttgcctcggcctctctaagtgctggaattacagatgtgagccaccacacccagctagttttttttttttttttttttttttttgagacagagtttcactttgttgcccaggctggagtgcaatggcacgatctcagctcatctcaacctctgcctcctgggtttaagggattctcctgcctcagcctcctgagtggctaggattgattacaggcatgcgccaccacgcctggctaattttgttttttcgtagagacagggtttctccatgttggccaggctggtctcgaactcctgaccttaggtgatctgcctgcctcggcctctcaaagtgctgggattacaggcatgagccactgtgcccagctaggtttttttttttttttttttacctgtttagtcatgtcttaaataaacagtaagtgagaacttaacgaccttcagccttagtgccaactcgtctgtctgcatggtctcatacagtgcaaagaggatggggttcgggagtcagtctgatctgccttgttcactggttcctcagcctctctgagatcagtgttttcatctgtaaaatgaggatgaacacttaccttatattattttttgagcattgaaggagattgtacatgtagataagtagcacacgctcatcgagaaaagtttccatttttcctatctttccctctgtcatctgcccaacttctttttttttttttttttttttgagacggagtttcgctcttgttgccaaggctggaatgcaatggttgatctcggctcaccgcaacttctgcctcccaggttcaagctattttcctgcctcagcctcctgagtagctgggattacaggcgcctgccaccactgcccggctaattttgtatttttagtagagatggtgttgctccatgttggtcaggctggtctcaaactcctgacctcaggtgatccactggcctcagcctcccaaagtgctgggattacaggcatgaacaaccgcgcccggccatcctctgcctaacttctttctttatgcctgggtcttggctgtcttctcaaaggaaggaagccatcctagtcccacttccttgcgtattgatttatttgtactattggacacatcagaaaactgtttctcctctgtctcacggcatctttctgctgatcctccagcttccaggattcagctccaaattcacttccagaaagcctttcttgattaacccaactcagcataactattcttttggtttttatctgcttacatttaaatatttcatgtttcattaattagaatatacggttttgtcattatgagacaggtttaccattaatttaaaaatattttcctttttaatttttagaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagcgtaagtaagaataaatgaatcttgctaaataaagcttgtaaaggctgggctccgtggttcatgcctgtaatcccagcactttgggaggctgaggtgggcggatcacccgaggtccggagatcgagatcggtttggctaacatgacgaaaccccctctttactcaaaatatggaaattagccgggtgttgtggcaggcacctgtaaccccagctactcgggaggctgaggcggagaatcagttgaactggggaggtggaggttgcagtgagccgagatagcgccactgcactccagcctgggtgaaagagtgagactgtctcaaaaataaataaataaagcttgtaaaaatactgtgttgctgttctcacttattcatgggaggtaaaaattaaaacaattgaactaatggagatagagtagaatgatggttcccagaggctgggaggatagtggaggatggttaatgggtacaaaaatatagttagaataaattggatctagtatttgatagcacagcagagtgactacagtcaacaataatttattgtacatttaaaaaataataaaaaagatggccaggtgcagtggctcatgcctgtaatcccagcactttgggaggccaaggtgggtgaatcacttgaggtcaggagtttgagaccagcctgaccaacatggtgaaatcccatctctattaaaaaaaaaatgcaaaactacccaggcgtaatggcacatggctgtaatctcagctacttgggaggctgaggtaggagaattgcttgaacccgggtggcggaggttgcagtgagccgagatcacgccactgcactccagcctgggcaacaagagctaaagtccatctcaaaaaaaaaaaaaaaaagaatgggctgggcgcggtggctcacgcctgtaatcccagcactttgggagactgaggcaggtggatcatgaggtcaagagatcgagaccatcctggctaacatggtgaaaccctgtctctactaaaaatacaaaaattagctgggcatggtggcgggcacctgtaatcccagctgtaatttgggaggctgaggctggaaaatcatttgaacctgggaggcggaggttgcagtgagctgagatcgcgccattgcacaccagcctggcgacagagcaagactcagtctcaacaaaataaaaataacgaaaagaatataattggattgtttgtaacacaaagaagggataaatgctttagatgatggataccccatttatcctgatgtgattattacacatcacatgtctgtatcaaaatatctcatgtacccccataaatatatacatctaccatatactcacaaaaattaaaaatacaaaataaaaatatgttgtttaatgctgtgagtctggaaagcgtctggtatacaaaaattggagtgaaataaatattaatgatttccctacttcaattcagcttacatttttctttgagtaattccttacaaatataactgtggatcccataattgcataaaattgaataaatgaaatatagttcttttgcatctatactatgataatgctcacaatttttttttttctcgagatggagtctcactctgttgcccaggctggagtgcattggcgcgatttccgctcactgcaatctccgccccccgggttcaagtgattctcctgcctcaccctcccgagtagctggggtaggcacgtgccaccatgcccgggtaatttttgtatttttaatagagacggggtttcaccatgttgttcaggctggtctcgaactcctgacctggtgatccacccgcctcggccttcagtgtgctttgatcactcctgtgagtaaccagtgtgctccagtctgggtgacatagtaagactctgcctctagagaaaaaaaaaaaaaagaatagttccagccagagattctgaggttctttttttttttttttttttttttaccaaaacagtctcaaacttatagatacttttatgtggtcttaaaactgaatgcgtttttagttaaagatacattatcattttgataaacttgatgggacatgaaaaatggtacaaatatctgtacattgtacacctactgcttcttgaataaagcaaataatacactctgcattccaagcagtggcatatgtggtgggaggtggggtgaacagaaggaagtgtattccttaggttctgaagcattggtgactgggaattattgtattagtctcatcaaatagagaagcagattagaaaaatacagtaatcttgtacatgattaaagcaatcctgtgaattttactgattttaagataattttgaattccttatatacagcctctttagatgactttttttttttttttttttgataaggagtcttgctctgtcgcccaggctggagtgcggtagtgcgatctcggctcactgcaacctccaccttctgggttcaagcgattctcttgcctcagcctcccaagtagctgggactacaggcacccaccaccacgcccggctgattttttgtatttttagtagagacggagtttcactgtgttagccaggatgatctcgatctcgtgacctcatgatccactggccttggcctcccaaagtgctgggattacaggtgtgagccaccatgcccagtctagatgactgaagtttaaaacaaggttatttaaataaatgtttttgatgtaatcagtgagttgataatctaaatggagagttttctatttcttttttctttttttttagcaacaaatgtggctttcataactgtagagtttttgatgcagaaagaatatccttggtggggcacggtggctcacgcctgtaatcctagcactttgggaggctgaggtgggcgggtcacgaggtcaggtgttcgagaccagcctggccaacatggtgaaaccccatctctactaaaaatacaaaaattagccaggtatgttggcgggtgcctgtaatcccagctacttgggagggtgaggcatgagaatccctagaatccaggaggcggaggttgcagtgatctgagatcgctccactgccctccaatttgggcaacagggtgagactctgtctcaaaaaaaaattagccaggcgtggtggtgtgcacctgtaatcccagctactcaggcgactgaggcaggaaaatcgcatgaaccctggagatggaggttgcagtgagccgagatcgtgccattgcactccagcctgggcgacagagtgagagtctgtctcaaaaaaaaaaaaaaaagaaagaaaaaaaaatgtcctcattggtatctgtatttgttgaatgagtaggagccaaggcacctttgtggaaacttactttttctaaggagcttgatatttggtttacacacgtgtaccatgggctctttgtatgttggttaaaggtatttcgtgacgatgaatggtcacttttgttgtaagttctcatcatatgtttgccctcctgctcttattcttctcttactgcctaacagcaaagggtaatgtgtggaatgtcagaagagtttgtttactcttttttttgtttgccctttttttagaaatggcttagtactttactgactagtcttggtaaacaagtgactgtacagggtaagagaagtaattataggccgggtgcagtggctcatgcctgtaatcccagcacttagggaggccaaggtgggtggatcacgaggtcaggagatcgagaccatcctggctaacacagtgaaaccccttctctactaaatatacaaaaaaattagctgggcctggtggcaggcgcctatagtcgcagctactcaggaggctgaggcaggagaatggcatgaacccgggaggcagagcttgcagtgagccgagatcgcgccagtgcactctagcctgcgtgacagagtgagactccatctcaaaaaaaaaaaaaaaaaagagaagtaattatagttgtgcttttcatgaatgagtgtactagttgttccttctcttttagagaatcattccccaagtttcttcgctttttaaaaaaatttatctaagggctgggcctggtggctcatgcctgtaatcctagcactttgggaggtggagttgggcagatcacttgaggccaggagttcgagaccagcctggccaatgtggcgaaaccccgtctttactaaaaatagaaaaattagctgggcatggtggcacacgcctgtaatcccagctacttgggaggttgaggcagaagaatcacttgaacccgggaggtggaggttacagtgagccaagatagttgtcactgcactctctgtctcaaaaaaaaatttcttttacgttattctagagaacattctccaagtttaacgtgtttataaatatagtatttttcctattgaggtttttgtatatattgctattattacacgttattctctgtgtacactttaaaattgccattttattaaagatgtttctaataatagtttttcatattctttttatagtactttgccagacgtttatcaaaatggggctgctgtcttctttcacttgtagtgacgagtttagctcattgagactacatcacaacagagctattactcacttaatgaggtctgctaaagagagagttcgtcaggtaagccctaaaaaatatactttgggtatgacaaaaatatactttaattttaagataattatattttaaagcactgtgaaattctgattataaaacaagtttttaaaagtataaactctaggccaggcatggtggtgtggctcatgccttaatcccagcactttgggaggctgagatggatcatttgaggccaggagttcaaggctgcagtgagccatggttgtgccactgcactccagcctgagcagcagagtgagaacctgcctgaaaaaaaaaaaaaaaaagagaggagaggcaaaggagaggccacagatggactgggatcttgagacaatttcaatttatttttgttttgttttgtttcgttttgagacagagtctcgcactgtcatctgggctggagtgcagtggcgcaatcttggctcattgcaacctctgcctcccagattcaagggattctcctgccttagcctcccaagtagctgggaccacaggcacctgccaccacacccaactaattttttgtattttcagtagagacagagtttcttcatgttggccaggctggtctcgaactcctgacctcgtgatgtgcctgccttggcctcccaagtgctgggattacaggcgtgagccaccgcgccctacctaatttatggtttttagtaagatgggaggtggtacaggattttgattagaggagtgacacaatctgacttacattttagtggggtcacactggctgctgtgttgcgaatggactgagggggcacgggcagaagcagggtgccaggtgccaccatacacgcgagagaggtgggcaggcaggaggggtggggagctcctgcatggattttgaaggtgacgtcagtcttgtctgcttgctggtctgttctcagctttgaagtattttcagttgtaaactcttaagtaatactgaaaaagccagtggtttttaaaatattgtttatgcatttggggttgttaatgtgatattgaattttgataggttctttattccatgcaagttttcaaaatgctttttaaaaacaattttttaattgtaggatccttgtgaggatatttctcgtatccagaaaatcaggtatgtgtgaaaaactttcttgattatgcagactattgaaaagaaatcaaaattaagaaaatactgatttgaggttaaaacataatattgttagtattatttatgaacattaaaaactttgttctcagcaattaagtactgctctgagacttgctttgcttcttattccctcctctttgatcccctgcctctcgccactgagtgtggattccatggtcacactgttaattcagattcctgatacccaggctctgttagggggaccattgaattctcgctagtttaaatactagtttaaaatctaactggtctgacctaaatattcatcagcccatgaatagataagcatgtggtctatccctgcaataaagtgttattcagctattaaaaggaatgaagtacggattcatgctacaatatggatgaatcttgaaaacatcctaagtaaaaacagccagtcataaaaggccacatattgtgtgatttcatttctatgaaatatccagagtaggtgaatccatagagacgtaaatagtggttttcagggagtggggtaagggaaggatggggagtgaaagctaatggatatagggtttattttgggggtgatgaaaatattctgaaattaggtagcagtgatggttgcacaactttatgtactaaaaaccactgaattgtacatttgagagaggtgaatttgacagtatgtgaattatatcttgataaagcactctacattaaaataaaaatctaattggtctacatcattaagaaatttaagaagctgcttatggtggtgcatacccagtcccagctacttgggaggctgaggcaagacgactgcttgagcccaggagtcctgggctgtagtgcactatgccagtctggtgtccacattaagtctggcatcagtatggtgaccttgatctcccaggagcaagggaccaccaggttgcctaaggaggagtgaactagcccaggttggaaacagagcaggtcagtactctggtgctgctcagtagcaggatcacacctgtgaatagccactgcaatctagcctgggcaacacagcaagaccctgtcttagaagaaaaataaataaaaaagaaatttcagtaatttttttttttttttgagacagagtcttgctctgtcacccaggctggagtgcagtggcataatctcggctcactgcaatctctgcctcctgggttcaagcaattctcctgcatcagcctccggagtagctgggattacaggcacccgccaccacacccggctaatttttgaattattactagagacggggttttaccatgttggccaggctggtcttgaactcctgacctcatgatctgccctcctcggcctcccaaagtgctgggattacaggcgtgagccaccatgcccagctgaaatttcagtaaatttatttctgagcttagctaaccaactgctggctgttagtgattcttaggatttctgctgtacaacatcggtaataatttctacttggaatacccgttactggtaaaacacctgattttgttttcttcatagggatgaaaaatttcattttagcccatcctttccaaatcagcacagcttagtgatacatgaggtttgtgaggttagtaatcctgtgagcatgaggtatcctagaacattttgattctctcatgttttaatattgattgtttgtatttaactttcagatcaagggaagtagccttggaagcacaaacttcacgttacttaaatgaatttgaagaacttgccatcttaggaaaaggtggatacggaagagtatacaaggttgtcttccacgtacttgttttgacctactaccctaaataattgtgttttcagatattgttttcattattcttttatttatttatttttttgagatggagtctcgctctgtcgccaggctggagtgcgcggcgcaatctcagctcactgcaacctctgactccctggttcaagcgattcttctgcctcagcctcccgagtagctgggattacaggcatgtgctactacacccagctaatttttgtatttttaatagagacggggtttcaccgtgttggccaggatggtcttgatctcctgacctcgtgatccacccacctcggccttccaaagtgctggcattacaggcataagccaccgtgctcggcctgttttcattattattatataatgtactcaaaggaaaattccaagaaatcttgtatatttacttttctttaacatttgtcatgtacagggaagtgggcagtttgtaatgtttttctaaccgtgttgattgtttacatggattttggaaactttgaatttttgacctatagttaattttaattaaaaaatgtgttaccaaaaaaagttgtactactgtgttttgagctaacatacaccttttgctaacattcccgttcttcagcctagagcttcttaggagctagacttccaacactatctgaaaagctcttagtccggctgacttccctgaacatagtaaggagacatgtctttagctatattttacctctttggctagtttggattgtctaagctcagattaaaagaacctctttattcagttaaagtttaatgacacaatatactttgtctttttttctacttttcaggtcaggaataaattagatggtcagtattatgcaataaaaaaaatcctgattaagggtgcaactaaaacagtttgcatgaaggtatgatttttaaaaattacttattttgaataattgtgtatttagttctttttgaaagagttatacatgtatatgtgtatatttggcaaaagtaggcggtgtggatttccagtttactaggaatggggttatagtaaagtaccaaaattaaattattattattttttgttttgagatggagtttcactcttttggccaggttggagtaaagtggcgtgatctcggctcactgcagcctccgccccgcagggttcaaggattctccttcctcccaagtagctgggattacaggcatctgccaccatgcctggctaatttatatatatatatatatataatttttaaaatatgttaacttcttaaaataaatgatcgatatataatatagctagttatgaaaaaacaggagcccagttccaggtcagtcttctccctgacatgctgtgtggttctggacgagttgtccagtcctctgagccacttctgtcacctgccctgaaatagtagtgacggtagtgattttacttaccttggaggactggggtaggaatcaaaagagagaatggtgataagtgtgccataaaaagtataaaatgccctataaatatgttatttagttgctataacaattgccatttgtttcttaaaaatatttccattatattggccaggtgcagtggctcacgcctgtaatcccagcactttgggaggcgaaggcaggcagatcacttgaggccaggagtgtgagaccagcctggccaacatagcacaaccctgtctctactaaaaacacaaaaattagctgggtgtggtagtgcatgcttgtaatcccagctgctcgggaggctgaggcacaggaatgacttgaacccagcaaagtgattgcagtgagccaagatggcatcacttcactccagcctgggcaacagagtgagactctgtctcaaaaaaaaaaaaaaaatttctattattttaacatagtgtagatgccttgtacagaggagttttcattacagatggtcctccatcttatgatgggattatgtcctgataaacccatcataaattgaaaatattgtaaattggagatgcattttaatatgcataacctaccgaacattatagcttaccctgcctaccttaaatgtgcttcgaacacttacattactcaatagttggacagaatcatctagcacaaagcatattttataataaaataccatatatctcatgcaccgcatactgcaagctggagaaaagatcaaaattcaaagtatgtcaaaaattgtgatgtcttcataccattgtaagtcaggggccatctgtattttgctctggaacaagaagtattgcataaacatttaacaagttatcagcaaaaggcagatctacttccatttcttttctaggtcctacgggaagtgaaggtgctggcaggtcttcagcaccccaatattgttggctatcacaccgcgtggatagaacatgttcatgtgattcagccacgaggtaagccgtttttgatggtatggtagttgaagcgttggcaaactttagcccgtgcaccaaatctggcctgcctttgtttttgtacataccacaagctgagaatggtttttacatatttttttttgagacggagtctcactctgtcgcccaggctgctccgcctcctgggttcacaccattcttctgcctcagcctcctgagtagctggggctacaggtgcccgccaccacggccagctaacttttttttttggtattttttagtagagacagggtttcaccgtgttagccaggatggtctcgatctcctgacctcgtgattcgcccgcctcggcctcccaaagtgctgagattacaggcatgagccaccgcgcctggttggtttttacatttttaaatagttaaacaaaatcagaagattttgtgaaaattatgtgaaattatttttttcttttcttttttttgagacagagtctcgctctgtcacccaggctggagtgtagtggcgcgatctttgctcactgcaacctctgcctcctgggcttaagtgattcttctgcctcagcctcccgagtagctgggattacaggtgtgtgccgccacgcctggctaatttttgtatttttagtacagacagggtttcaccatgttgcccaagctagtcttgaactcctgacctcaagtgatccacctgcctcggcctcccagagtgctgggactataggcatgagcctctgtgcctggcccaaaatttaaatatcaataaataaaatttattagaacacaggctcttcatttatatattgtctatggctgctttttaaatttaaagttagctgggggcagtgtggctcatggctgtaatcccaacactttgggaggccgaggcaggaggatcacaaggtcaggagttcgagaccagcctggccaatatggtgaaaccccatctctaataaaaatacaaaaatgaggtgggcatggtggtgagcacctgtagtcccggctactcgggaggctgaggcagcagaatcacttgaacccgggaggtggaggttgcagtgagccaagatcgtgccaatgcattccaccctgggcaacagagcgagactgcctcaaaaaaaaaattacattaaattttgttttaaaaatagagatgaggaatctcactatattgtgcatgctgttcttaaacacctgagctcaagtgatcctcgagcctcggcctcccaaagagttgggattacaggcatgagccactgggcctatggctgcttttataccataacagaattgttcagttacagcagagtcccagagggccctaaaacctaaaatatttactgtcaagtcctctgtgctgtttgctgacccctcgtatagttgcatggctttgtttttacggttcctaacacgtgccatttgaataaactttttgtattttgccagaaggtcatgacatttttagacttgtagtctcatttgacactatttgtatattttaactctgtctttgactacaatttgaaaaactgggctgtttgaagatgattgttgtttgttttcattcagcagacagagctgccattgagttgccatctctggaagtgctctccgaccaggaagaggacaggtatgtccttttacatattaggacattacctcttgtcacctgcattgggcttttgttcttttttttggcgacagagtctcgctctgtcacccagactagagtgcagtggcacaatcttggctcactgcaacctccgcctcctgtgttgcagtgattctcctgcctcagcttcccgaatagctgggactataggtgcccgccaccacacccagctagttttttgtatttttagtagagacggggtttcaccgtgttagccagggtggtctcgatctcctggcctcgtgatgtgcccacctcggcctcccaaagtgctgggattacaggcgtgagccactgcacctggcctgcactgggctatctttgtcttttgctacaaggagctcaggaggagtgttttagactttgcttatttccgttacaaaatgttaaattatttcttcctttcagatatttcctgtcggtattttttttttttttttgagatggagtctcgctctgtcgcccaggttggagtgcagtgatgtgatctcagctcactgcaacctctgcctcccaggtttaagcgatcctcctgacttagcctccctagaagctgggattataggcctgcaccaccatgcctggctaatttttgtatttttagcagagacggggttttgccatgttggccaggctggtctcaaactcctgaactcaggtgatctgcctgccttggcctcccaaagtgctgggattacagttgtgagccactgcacctggcctattttttattatttttgttgagacaggatcttgctcttttgtccaggctggagtgcagtggtatgatcacagctcattgcagcctccaactcctggactcaggcaatcctcccaccttagctgcctgagtagctgggactacaagcttgcgccaccatgtctggctaatttttgtattttttgtagagatggggttttgccatgctgttcaggctagtgttgaactcctgggctcaagcaatcctcccgccttggtttaccaaagtgttgggattataggcatgagccattgtgccagacctatacattggcttttttttttttttttagatggagtctcactctgttggccagggtggagtgcagtggcgcaatcttggcttactgtaacctcttcctcccgggttcaagcgattctcctgcctcagcctcctaagtagctgggactataggcgcatgccaccacacccggccaatttttgtattttttagtagagatggcgtttcaccatattggccaggctggtctcgaacttctgaccttgtgatctgtctgccttggcctcccaaaatgctgggattacaggcatgagccactgcacccggccgacttttttttttcttggagacggagtctcactcactttgtcgcccaggctggagtacagtggcatgatctcagctcactataacctccatctcctgggttcgagtcattttcctgcctcatcctccccagtagctgcgattacaggcgtatgccaccatacccgtctaatttttgtgtttttagttgagatggggttttaccatgttgggtaagctggtctccaactcctgaccttaagtgatctgcccgcctcagcctcccaaagtgctgggattacaggcatgagccactgtgctcggcccattgacttttatgtttactatttttttttttttcagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggtagattactttcccagaccctcctaatttggccagtattggtgactgtgcaggtgtgtggccttctctcgccctctctcagctctggcgcttctgccctgcgttcagtctcttgtactggccatgttccccttgccatggggcctttgcgtttggttctcccttcttcacttagttaactcctccacgtccttttctggcctccccgacctggccatttacagcttcagatcatcttgagtgtgtaccctagagttggcggcctcactcacactctgtttgtgttgtatgttagcatcatgctataaagatatatttatgcaaaacgattttgcagcatgactttaggtgagtcccagtaggattagcagctcagtattcgggatattctttttaattttaaaattggttttatgttagttgtagttttcaggaggctcttgttgagggtcatactgatacaaccctccttccatggccacgctgccaccatgctttccccagtattttaagtagtaatattaaaaacatgaacattaggccgggtgtggtggctcacgcctgtaatcccggcagtttgggaggccaaggagggcagatcacctgagatcaggagttcgagaccagcctggccaacatggtgaaagcgcgtctctactaaaaatacaaaaattagccaggcgcgatgctgtgcgcctgtaatcccagctactcaggaggctgaggcaggagaatcgcttgaacccgggaggcaccgtactccagcctgggcaactagaggaagactgtttcaaaaaaaataaaaaaataaaactaaaaacatgaaaattgtcagggtctacacataatctgtcttgttaagattataaaactgtatataccatctacaaagacacagcacagaattaattcttgtcacggaatatgtgtttctgagcctgtgttttttttcttgagacaaagttttgctcttgtcacccaggctggagtacagtggcatgatctcggctcactgaaacctctgcctcctggattcaagcgattctcctgcctcagcctcccgagtagctggaattacaggcgcccaccaccacgcccagctaatttttttgtatttttagtagagacagggcttcaccatgttggccaggctggtatcaaagtcctgacctcaggtgatccacctgcctcggcctcccaaagtgctgggattacaggcatgagccactgcatcctaccaagcctgtgctttttttttttttttttttttggagatggagtcttgctctgtcacccaggctggagtgcaatggtgccatctcagctcactgcaacctccgcctcccaggttcaagcgattctcctgcctcagcctcctgagtagtgggattacaggcacgcgccactacgcctggctgatttttttgtatttttagtagagacgaggtttcatcatgttgttcaggctggtcttgaactcctgacctcgtgatccacctgccttggccttccaagatgctgggattacaggtgtgagccaccacgcctggctaagcctgtgcttttttatgaaacttagaactttgaactctttcgcctgaatctggatgacttgagtttgggggacttttaatcagaatcatttcatttctctgtattttatttggaaaattttcttagatgcctaaatcagatggtatatacagtgggctacagtaagcttagtgtttgcttaactttttattgaataagttattagttatgtacaacgtgaagccagacaaagtatatatactttgtagaaatatatagagtagtagaatatcatacagccattctttgatgctttctcttagctttaaaaactgtttatgtagcgagcagaccagtttcaggaccagtttctccgggtcacagttgagagcttctgccattggacccctgcctgacttcagcctggccccccttctgctggtattacaacacccggttttaattatcagtctccttatctgtcactttcattagactttgggcttcttgggtgggcctgtgtcctgaggacacttctgtcttgcaaagagaagtccacacaggtttaatgacttccctagaggcctactctcttggcccagaataggcagattaatatttgttggctaaatgaataatgcgagtgaatcgtgcaaagatgggagccatcactgtgtcctctcctaggcacagtaccacctgatgctgcacatccagatgcagctgtgtgagctctcgctgtgggattggatagtcgagagaaacaagcggggccgggagtatgtggacgagtctgcctgtgagtaccatctgggtctgccgggccgggaaatagacacagtcacaccttccccatctcatgtaggagttgcctccaggtgctttttttcatttttattttttatttattttatttttttgagacagagctttgctctgtttgttgctcaggcaggagtgcagttgtacacccactgcttactatagccttggcctccctggctcaagcgatcctcccacctcagcctcctgagtagctgggactacaggtgcatgccactatgtctggctgattttgaaaaacaaaattttgtagagacagggtctcattatcctgcccaggctggtctccaactcctgatctcaagcaatcctcctgtcctctcctcccaaagtgctgagattataggcgtgagcgtctgcacctggccagaatgttttctttatcaatttttgtgttagtcctgtaaaacctctccatcctctaaatgtatgtcatcatattaatagatgaattaatttacttacattttttgggccatatgctgtgtcatttttggaaagtgaggcattccagatgattgaatcatattcctggagctaacatattttatcttttttcttattccattatttgtaataatatctttaatccactgtgggctaggataccagatttattagcattaaatcccagaatgtcaagggttcaagggaacttaaactttatcgactctagttgcctgatacccgagaattatttaaaaagtcattaatacaggggagggctgtgattgaagttagaggtactttgtttctggttgacaaagtccatcaactgttgggtgctggtttgtgatggtttctttgccagctgaggaagccttcctgcttatttctaggttttagaccattctgcagcattgactttgttgaaaatctagattgttcttaagtgtcagatgttaatgtatttagaatgacattaatatttagatgcccatgtaatgagtaaaaaaattagagaaataaaactatttttttttacttcaaggtccttatgttatggccaatgttgcaacaaaaatttttcaagaattggtagaaggtgtgttttacatacataacatgggaattgtgcaccgagatctgaaggtaagtgggggcgatgaaatcattgaaagcagtgggagctttgtatcagggacgacttgatgttggttgattaaactaaataagattacatgtcctagttcatttgcttaggaggttataattactgtcagataagtcattgttcgatagatccagagtatggaaacattaggtcgaatttttttttttttttgagacagcatttcgctctgtcacccacgttggagcgcagtggcacgattacagctcactgcagcctccaactcccaggctcaagcgatcctcccacctcagcctccctagtagctgagactacaggcatgtgctaccatgcccagctaatttttaaatttttttttgtagagatggagttttactatgttgcccaggttgatcttgaactcctgggctcaagtgatcctcccatcttgacctcccaaagtgctggggttacaggtgtgagccactgcacttggttataagttgaattttaaagtagtaattttggggcatttgaaaatcctctgtggagtataagtactttttttcaggtgctctgagtactgctataatcaggggtgctaaatgtatttagtgctgacagaaatgctcatttattattgcagacttagaggtaaactctatttctataattattcatcttaaagtttaacaaaatcggaagtttttttgctgttttagaaaagtctataatgactatttgatttttatccacaaaaggctatcaagaaagagagaaaatatatttgtgtctttggctgaagagatttaaattaatttgcttacttttcagcccaaagttaaatcatggaaagggcatgaaaaaaaaaaaaacctaggaacaaaaatgttaatagacaaatcactttgtattttggaacatgttcaagaatcagtagtttgtacatttgggatgtcacaggtgataggtgaagcattttctgggacatgtctagccagaaaatgcagtttgagtggctgaaagtccctctgctgtgaaactgggaggtcttatttcaagaggtatatgccaagtcataacagcagtagacagaattccatattgtcactgggaggaattgcttcaagtgctgtttgtatttctcaccataaatattcctgatgtttcttttgcagataccctgtagggataaaggtttttgcgattgctttattagggtgtcccttaagaggcggaattctggtagcatgattcctgcaggtagaattccttggttattggtcattctcagaggataagtgtgataaagtagcctggccagaagtgccgtatctcttacattgcaactgcgctgaaggtacatataaattggagattccccgtttcttgttaaaatgttaacatttgcttcaaattcaagcaggagattgatgattgcctctctgcctccaaagcatgcctcatggatggctgtttggcccttgtagtcctgggcgttgactttggctccgtgagtgagtagcagacggatgcagctgacccccgccccgaggagtcggcctgctttgcttgatgcagtgcacactgcaagcttcaggggcgtgttccccgtggaagagacagcacagttgacgtttgctccataggcaatgagcgtttccatcatctccttattcagcatgtttgcggccatgtgaaggggtgtcatgctggcttcattaatagcattgacatcggcaccattttgggtcaaaatggagagaactggatagcaaccatatgctatggccaggtggagtggtgaacgtttgttgctgatttccccttgagtgttcacttgagctccgtgcgcacacaagatgcggagacatgtgatgctgctattctgaatgtctgtcaggatcctgtgcgttctgttgcctggttttgcccacgtggtggaagtgactggccagtgcagtagcattaagttgagtgtggtgaggcctgtcgtgtccctagaatgggtattgattacacgttacactgaattcacagtgggaacggctctacgtggacagttaatgcttaagaagccagtatttatttaaagtaagacccttcaattaccttaaggacgtgtttcaaaatctgtatcgctgggtagtttctcaggctatcccagggtttttcgtgggatgtggtgggatgcatcactacgtgatggggcctagcttcattttatgtatatataatttttttttttgaaaaattattttcacttttatacaatgttgtgaagaaggcccagcttcttggagcagcctgttttacctgtgccgtccccgctagggctgtgtcccttcaaggctgtatcttagtgatttctgcagtctggcacctcacacagtgctgggctgggttactggctttctgtgaaattgtgtggacttgagtgtgatctgttattgccacagaagtgagccgtgaaggcccgaactcccgttgactcctttcttagaggctctgtctctgctctcctacccgacatttttctgcgtgagtgtgtagggagcagaagtgacaggggttgaatctgaagacctgtggtcattccgaagttcattccctgctccaggccaggtggaatgggcattttacaacttggccctcatctcagaagcgctttcaaaaattcctttgttttggcagagcaaaaggaaggtttattatgtaaatctaactgctctgctgaaattagaaaatgattttagttcacatagatttgtttagcgtgaggccctaggctatggatatggtgaaacagcaggtggcccctacctttgtagggcttatagtctagcagggaagatagacgtgaaacagtgaaacagctcagtaaatagtggaagccggcagagttctagagaggtgcagaagcctcacatagtgcatgcagtatgcagggtaggaaagggtcccctaaggagaatggggcgagtctgtgatggttgagatgtggaagggacttccagaggacttgcagagctggggtggggtgctcagggagaggctgggagcaagacaggtcaggtgggttcttctggagcatggtaaggatttggggcaagaagttctattattattattattttgagatggagtcttgctctgtcgcccaggctggagtgtggtggcgtgattttggctcactgcaactgctgcctcacgggttcaagcgattctcctgcctcagcctcccgagtagctgggactacaggcgcccgccaccacgcctggctagtttttgtatttttagtagagatgaggtttcaccaggctggtctcgaactcctgacctcatgatccacccacctcagcctcccatggtgctgggattacaggcgtgagccaccgcgcccggcctatactacttaattctttcattcactcggatagtattactgagcacgtgctaagtgtcaggcattgatttggttgaggtgctggagatacagtggtgcacaaggtcaacttctctttcatgcggcttaccttctagtggagagtaataaacaagaaaatccattgtcggccaggcacggcggctcacgcctgtaatcccagcactttgggaggctgaggtggacggatcacgaggtcaggagattgagactatcctggctaacatggtgaaaccccatctctactaaaaatacaaaaaattagccaggcgtggtggcaggcgcctgtagtcccagctacttgggaggctgaggcaggagaatggcgtgaacccaggagaatggtgccactgcactccagcctgggcgacagagcgagactctgtctcaaaaaacaaaaaccaaaaataaagaaaatccattgtctacctatattttatttttcacacctaactttggtggttaaacttattgaaggccatggcaaggactttactgcattcctcacaacaccaccattgagctcttaatcctcagaatgtgcattaatttggcaaaatatttatgatgttgcatttttctcagtttttcagagtatctcatctactcagtaaagacattggttcattcataagaacgaacaagtccaaacataagtggaaaaaatgtatgaactgaaaaaaaaatctatatcaggtatatcctcacttagaaatgattgtcagtgaagctgggtgctgtggctgagggctgttaatcccagcactttgggaggccgaggcaggtggatcacttgaggccaggagttcaagaccagcctggccaacatggtgaaaccctgtctctactaaaaatacaaatgttagctgggcatggtgacgcacacctgtaatcccagctactcgggaggctgaggtgggagaagctcttgaacccaggaagtagaggttgcagtgaggcgagattgtgccattgcactccagcctgggcaacagagcgagacccctgcctcaaaacaaaaaagaaaaaaaaagaaatgattttcggtggagttaacttacctgacttctgggtcagcaccgtgccgtaacaggcagagcagactctgggccttgtggtacttggcagccagatggatggggatgatagactctgtcggctttggagggaaaacaaaacacattacaagtggccctgtgtagttaaaaatactgtttgtgttagcttgccgtttcaaaggcaatacatttatttagtgtctcattggctcactctttttctggtatgtgcattgaaagtttcctttctactacctgttttaaatgatcaaaattcagtgaattccatcctataaaatctgtgtttcacagaaatgcacatttactgaggcaacagaaataacactcaaaagctttggaaatttttgaaagttgattcttcagaagagcctgtggtgtgatattaagggtacttgctatgaagtcacttattccttaaattaacccacagggtgatggacaagtaggtgctgtgtcgttgccaaagtcgtattatcagcagtaaaacctgaatcttcagggttttcaaatataacgcagcatatgttctgtctatgattagcagagctgtttgtgccagctcttaaaatacacacgtgtaagtagtggtttcacaccgtggctgcaagataagacagtagggtacaagggagggtgacttcctttttgaatttaattgtaaaagtaataatcattgtataaaaatttagaaaatgaaaatgtatatattaaaaagggaaaaactattttttgtttgtttgtttgagatggagtcttgctctgtcatccaggctagagagtgcagtggtacgatcttggctcactgcaacctctgcctcctgggttcaagcaattctcctgcctcagccgtccgagtagctgagattacaggctcctgccaccaagcccggctaatttttgtatttttagtagagacggggttttgccctgctggccaggctggtctcgaactcctgacctcaggtgatccacccacctcagccttccaaagtgctgggattacaggcatgagctactgcgtctggccaaaaaagggaaaaactaatttgaccacatggagatcatcactgtgggtatgtttgagagatgacatgaatggtcttccagtcacacagggtctggtgttttctcatgttggtttgtgtgtgacatgtgtaggggaggctttgcaggctttggggagcactgcagtgtgtgtggagtgagctggagtcgtgtctcattctcataagggccgtgagcttagtgggttcaccagctttagatcatgcttctttctaagcagcctgacttttttccagaagtgactgagcagaaaagagggtacctgggtcagaagtaatctgttgctggcggagttgggcagaatggtgatgggctggttgacagggtgatttctcaggagtacctcgatcgtagtgcagtcttctctcatgatggcttcatagagtttcgagtgaagtgctgcagatgggccatcttccagggacttggcactgtcaaccaccaggtctctgcttcctttcctggttatattccccatgagaaaaacttaagacttcaggggaaaatgttgttatggaattggtcagtttcagtctctttgtgatgattctttcagttcagttctagaactgttctagaatttgtcgagaattggatctgtgaaggcaatccatcagtttggaaccaagcgtccagactttgttccttgatcatagaatgtcaaatgtcagcagtttttagggttttctactctatcataaaaacatattcaagctatcatcttacacctttatttctgatttctctccagttcaagtgtagctgaaacaatgatcaaagctaaaacagaggaatttatacattaaaatacaaagttaaaattattacttttaaagtaagaaaacttttaaccttaagttattttttagtttttattataatagaatcttccctctccccattatgggttcagtttttctccggcataggaatagtttgggagatgttttgggtctgtactctttgcttaaataaagccatttagtgtgatctattagttcccaaccctggctaatacatatgagttatctgggagcttttaaaaaatatcaaagttggctgggtgcggtcgctcatgcctgtaatcccagcactttgagaggccagggcgggcagaacatgaggtcaagagatcaagaccatactggccaacatggtgaaaccctgtcgctactaaaaatacaaaaagtagctggctgtggtggcgtgcgcctgtagtcccagctactcaggaggttgaggcaggagaattgtttgaacctgagaggtggaggttacagtgagccgagatggcaccactgcactccagcctggcgacacagcaagactctgtcttaaagaaaaaaatcagttttttcgtagtgcgagaaacatgctcacccgtccaaacccaaagagtgaacttagaggcacaaagaacagtgaaagtgagacttttaatagccctcttgcaaggtcacgtgtctggtaggcaggtacacccagggcagttacaacaggtgatttatctcctagcatgcaagaccctacctcagttcctcactggtcaaggactacagggttacgatcttcccggacgtcgcctaagttgcattatccccttagaaggttataccctggtccctttcccgcttaagtttggatttcccagtaatgaaactttcttcccttttatgggctgactcctctacatcctgttcacttattgtgatcttccaggtggatgagccatgtggtttgttacatttgcaggctggctgccggtgcttagatttatcatgccttgaaaaagccatttaaaatgttttctcacacatagaaaatcacgtctctggactcgacaggacagtcgtttcttttcttttcttttttttgagacagagtctcactctgtttcccaggctggagtgcagtgatgcgatctcgtctcactgcaacctctgcctcccaggttcaagcaattctgcctcagcctcccgagtagctgggattacaggcatgcaccaccacacctggctaatttttgtatttttagtagagatggggtttcaccatgttggccagcctggtcttgaactcctgacctcaggcgatttgcccgcctcagcctcctaaagtgctgagattacaggtgtgagccaccgtgcccggccgaggacagtcatttctaagagcttcttgggtaatgatgtgcagtaagggttgggaagcacttgtgtacaaagcatgctctacattaatattctccaaatttagaatagccttgggacttttaataatactgatgcttgcgttcacccgcaggagttctgatgcagctggcctggggaatggttgaatgttgaggtttttttttttttgagacagggttttgctcttgttgcccaggctggagtgcaatgccacaatcttggttcactgcagcctctgactcctgggttcaagccattcttctgcctcagtctccctagtagcagggattacaggcacgtgccaccacacctaattttgtattttttagagacggtttttcaccatgttggccatgcttgtcttgaactcctgacctcaggtgatccgcctgcctcagtctcccaaagtgctgggattacaggcatgagccactgcacccggccagatgttgagatttttaaaactcctggatgattctgatgtgtaggcaaatttgggaactattcctcaaatatttaacttttgaggggctgcttgctcctgagttccaaacacttaaaaacatttacaagatattactatttgttttaagaaagccaaggagttgacttgttttgtttgttgatagccaagaaatatttttcttcatggccctgatcagcaagtaaaaataggagactttggtctggcctgcacagacatcctacagaagaacacagactggaccaacagaaacgggaagagtaagtttttggttttgttttgttttctttgcataagcaaaagacatggttgcacatgttagtatttaaagagaatcataaagatttaatagcaaaggtaagataaagatacaaagcaactgttgttctcttaggagctacactgcttcctcatagtaaatgttctttaatgttgacagcgctaactgcaatgtttaatatgtggcttttgaaatgataggaacaccaacacatacgtccagagtgggtacttgtctgtacgcttcacccgaacagttggaaggatctgagtatgatgccaaggtagtatttgttgctttctgccctttcattcaacttattctgcagtcttaaataacaatacagggttgggtgcagtggctcacgcctgtaatcccagcactttgggaggccgaggtgggtggatcaccggaggtcaggagttcaagaccagcctggtcaacatggtgaaacctggtctctactaaaaatacaaaaattatctgggtgcgatggcacatgcctgtagtcccagctactctggaggctgaggcatgagaatcatttgaatctgggaggcagaggttgcagtgagccgaggttgcaccattgcactccatcctggatgacaagagcaaaactccatctcaaaaaaaaaaaaaacaaacagtacaatgaaatgcagaagctctgtcatagagatgtttttggagataactgagtactgtagataattaactggatcaaactgtcctaagaagaaacctcacttttcagtagactctgtgttgcctactttaccatttcaaaatccacagatgtcacaatttttttgtttgttcatttgttgtttttgagacagggtcttgctctgttgcccaggttggattgcagtggtgtcatcatagctcatggcagcctccaactcctgggctcaagtgatcctcccacctcagcctcccatgtaactgtgacttcaagagttgtgctaccacacccagctaataaaaaaaattatttgtagagatgggtcttgctttgtccaggttggtctcaaactcctggcctcaaatgattctcctcccttggcctcccaaagtgctgggattaaggcatgaacctctgcgcctggcctaaatcgattttgaaatgagctttccctttaaaacatcactgttcacctcaggaagctagaattcatggaagcctgttttcagcctttcttctcattggtttttttcaagctttggtaaataaacaccaaggggaagcctgccccttgactccccttgaaatagaacgaacatgctgtaaagtttgaatctcccttgttcctggaagaaatgctaaaatccatttttcaaaacaacaggctagtaaaattttcttccttttgatggcgcattgagctttttagtgattaggaaagagctgtcagaaaaaatgatggctgcccctaaaatcttgtttagtgaagaccttcctaaaaaatctgtttttaggagtagtatcacagattttatgcagtttgttaaatgtcaccaaggacacttggtaagaatgagtggaggcagaggtgagaccggaggagaacccgcgaccttctgtggctcccccgcagctgacactagcaggcgtgagctcacatcattgcctgggtcaggcctggattgttaaggggtgctgaagacagttgtatggtcgtgactgctgtgggtggggattatccctgccctccacctgaccatccattctgcgtgcccacggatgcccctttttgaggttgtgaaagtccctgtcactgatgagctatcctgctctgttcccttccttgtgggtgaccgtatatcctcattcttagaaaccctctcctgtttggagggtggaacacggaaatggaaacgttcttctaactttgtatttcactactgagttcccctttttttctttttccagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgtatgtgcttttctttctcttggtcctggagtgaaggtggtttttattgcctctcttggggaaggaagcggttgggtggtgcccccggaggctggggctggaagagccagatgatggttctggaggcggggcctgtttgttctcgtccacttcctggcactcagctgcagggtgtgctggcaggactcactccccttggggtagcagctgtggcctcagcaggcacaggaggtatctgctggtgttcacaaagaggagcggagggctgggggccaaccccacagcgaaggccggtaggaaacttcctggggcctggtgggtgagactccttcccggaaaggccggaggggcccgcagggtttgcaccttctcatggctaggcctttagatgtccaggtcaaactctgacccttcaccacctgcctgctgttctgggctgtctgtatgtctgccgggggctcatcactggcagggctggtgaccccggaagtggtgggcgggtccctcgagggtgttttggtcactggtgagttcagcactctattgggaatttccagttgtacatgatcctggtacctccccgggtagtgctgaagagtgtgcccgatggggttgctgcattccctgcgcagtacacagtcattggaccaccggggagaggcaggggtggcctggcgtgggggtccggctgcagctgctgccctggacatggtctctgtacatgttttttttttaaatgctgaggaaaatatgaagcttaaaatagaatttgttcaaattgtgaatcctggccaggcggggtggctcatgcctgtaatcccaggcatgggattttgggaggcagaggtgggaggattgcctgatgttaggagttcaagaccagcccggccaacatggtgaaaccccatctactaaaagtacaaaaattagccgggcgtggtggtgcacacctgtaatcccacctccttgggaggctgaggcaggacagtcacttgaactgggaggcggaggttgcagtgagctgagatcacaccactgtactccagcctcggcgaaagagcgagactccgtctcaatataaatagtgaaccctgtttcagtgaatagtcgagcttagactcatatttgtgcaaacaaaatatttaaacccattctcagagttccctgactgtatcaagcactaggttgaataccagtagcatgcttatattcattgtccacgtaagcaggttgactccccaccgcctgtctactctaagagttacaagcattgggcgtggtggctcacgcctgtaatcccagcactttgggaggctgaggcaggcggatcatgaggtcaggagttcaagaccagcctgaccaacatggtaaaaccccatctctactaaaaatacaaaaattagccggtgtgagctaccatgcccagccacagatgtggttcttgaaaccaagtataaacatttatcttcatatatgaaggggattttctgatgctcagttaagatagctattagagaccatagttatttagtatttatggtaaggatttctactatcttgcaaaagttttttgtataaaatgaaaccttggctgggtgtggtggctcacacctgtaattccagcactttgggaggtcgaggcgggtgggtcacttgaggtaaggagtttgagaccggcctggccaacatggcgaaacctcatctctactaaaaatacagaaactagctgggcttgtatgagagcgcctgtaatcccagctacttgggtggctgaggcacgagaatagcttgaactggggaggcacaggttgcagtgagccaagatcatgccactgtactccagcctgggcgacagagcgagactctgtctcaaaaaaaaaaaaaaaaagttattttaatggagtttaaaatattttctccttacaggttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggtaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttatctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatattcttacaataaacttgagaaaatgttaagaaaat

SEQ ID NO: 38190 - DNA, 16761 bp, Homo sapiens
ccaggaagatgccgaaagaggatcaggatcgggggccagagacactgatcctagagctcagaaccacaaccttgacccagtagttctgcttgtgagaattcatcaggcacaaagatgaggcttcaaggacgttcatcaccattatttgagtgaaacattagaaaaacctgaatatccacctccactaacaatttctggccctgctttacaataagctaccatgctgccatcaaacacaatggcaagggctttcattttagctgctgggggttatgtttacattttttcttttttgagatggagtctcaatctgttccccaagctgaagtgcagtggcgcaatctctgctcactgcaaactccacttctcgagttcaagcgattctcttgcctcagcctccggagtagctgggactacaggcgcccaccactgtgcccggctaatttttgtatttttggtagagacggggtttcaccatgttgtccaggatggtcttgatcttttgatcttgtgatccgccctcctcagcctcccaaaattctgggattacaggcatgaggccgcacggccggacaatgtttacattttaaatgggagaaatcagtctaagtaaagtaggagctgaatcgttttaatgaaaaaaaaaaaaaaatttcaaaaaggatgagaaagacagacggaagacatactaggtaatgagaaaattcacttaagattttggatttgctataaccaatatatcgtccttgaataaaaaggaaaccccgttttacctctggtggttccagagaccctgctgctctcctctcctcctgggcccagacagcactgacacgtccccgctgtcggcttccccacccgattatctacttcccttgtgcagcgtggtcaccaggccatgagaaccctaagcgcaggagccctctgccatcctcctcctccccacaccgcaccatgcccgtagtgaagggactgaaagggtcttttcccactgactgaccattactcctgtctctactaaaaatgcaaaaaaaaaaaaaaaaattagctgggcgtggtggcgggcgcctgtagtgccggctactcgggaggctgaggcaggagaatggcgtgaacccgggagacggagcttgcagtgagccgagatcgcgtcgctgcacgccagcctggacgacagagcgagactccgtctccaaaaacaaaaacaaaaacaaaaaaaacaaataagggaaacggcgataatttcacaagtcacttagattttttttctagtactttacagactcgtctacaccggctccggccgcgtcccccgtttcgcaggccccttagtcccggcccggccctgtgcgttaccccgcgtgcgcgcctgctgttccggggccgaatgggagcagatcttcttggccaggctctgcaggtaggcgtccttggcgagtagagaggccatggcggagacccgggccgttcacgactcacaccttccccgctgcgcgtgcgactctcaccacctccgccggaaaccaccacacgggcaggcgcggccaaacgaacgccgagccgccagcccgcgcgctcgattagccaagcctgactccgccggaagcggcgcgcggggcggggcgcacagcattgcgggccgaggacagccaatctccgcccggagtcggtgcagcagggcacccccggggcctggcctcagtgcctcaatcaccccggtcccgcacgtgttcctgtgctcccctcacccccaaccccgacacagcaggcgctcatgagtaggggcgaaatgaatgaatgaccagcagtacattcattccgtcctttggagtggggggcctcaggtctcaggcggacacagactgagcgcctggcacgtggcaggccctaggttcagtcctaggggacacaagcagtgtgtcacacacacagatgtgttctcggcgagtgtctgccgtagaggtgactgataaacctggcaagcgtgtgactgtcaggtgaggggagcgccaaagaaagcccaggggaaaagggagaagtgttgggcgggagggagcctgcatgttcaaggaagaccccctgggcagtggcttttgctctgaaaaatagaattacacactacgattccctcccccaccccggtgacggagtctccctctgtcgcccaggctggagtgcagtggcaagatctcggctcactgcaacctccacttcccgggttcaagcaattctcctgcctcagcctcccgagtagctgggattacagacgtgtaccaccacgcccagctaatttttgtatttttagtagagacggggtttcaccatgttggccaggctggtctcgaactcctgacctcaggtgatccgcccacctccgcctcccatagtgctgggattgcaggcatgagccaccgtgcccagcccacactgcgatttttaacacaagatgtggtctttataataactcactaggggcaggagaaaagagaggtcatggcctgaggcttgggaccaccacaccccagttcctgcactggaaaattacaggctcattaaggacccagagccccttccagggccaccccgttggtagagaagggagaacttaagagtcttaaattacaatttgaaaaggtggctgctgatatatatattagaaacagaactgttgtatttgaaacagaactaaactttcttcccctaacttctgccatgaggtgatttaaaaaaatttttttggccaggcgcagtggttcacgcctgtaatcccagcactttgggaggccaaggcaggaggatcacttgagccctagagttggagaccagcctgggcaacatagtgaaaccctgtctccacacacaaaaaaatttaaaattagccaagcgtggtggccggcccctgtagtcccaactactcaggaggctgagaagagacgattgcttgaaccggggaggcagaggttacagtgagccaagatcacgccactgcattctagcctggagtgccaggctgtctcaagatatatgtatttttttcacttttaaaaaaggcagtcaaatttagcagtgtgggggtcgaatgccaactatagtgacactaaggttaattagttctgacatcccactgccattcagaccagcctagaggtgatgtttcatggaggataggcgtgacgctgctgctgactcccctgaactgctgggtatcttaacaccatcacctactgagttcagaatgggcatctgaccccccaagccccatctcttcctctcactgtcaacccttttttcagttaaagcggctccatccttccaggtgcttgggccagaccttgaaaccactgactcctttcttattccccacatccaatgcttcagcaaatcctgtcagctgtgccttcagagcacctccagaatctcagtggacccactcccatctcatcaccactttggtcctgttttatttattttttgaaatggagagtctcactcttcctcccaggctggagtgcagtggtgtcatcttggctgactgcagtctccacctcctgggttctgcctcagtctcctgagtagatgggactataggcgtgtgccaccatgcctggctaatttctttttcttttttctttttttttttgaggtggagtttcgctcttgttgcccaagctggagtgcagtggcccgatctcggctcactgcaacctctgcctcccgggttcaagcgattctcctgcctccgcctaccaagtagctgggattataggcatggaccagcacgcccggctaatttttgtatttttagtagagacagggtttctccatgttggtcaggctggtctggaactcccgacctcaggtgatctgcccgcctcggcctcccaaagtgctgggattacaggcgtgagccaccgcgcccggccaatttctatactttttagtagagacagggtttctccatgttggtcaggctggtctggaaatcccgacctcaggtgatccgcccgccttggcctcccaaagtgctggggttgcaggcgtaagccaccgcgcccggccgatttctatactttttagtagagacggggtttctccatgttgcccaggctggtctcaaaacttctgaccacaagtgatccacccgctttggcttctcaaagtgctgggattacagcaggagccactgggcctgacctggtcctgttttagattttaagattccaaaataacaaccaaatgcaacacacaataaaaataggcataaaagcctttcagctggaaccgccaccttccagtaattcgccaaaatgacgaacacaaagggaaagaggagaggcacccaatatatgttctctaggcctttcagaaaacatgcagttgttcctttggccaagtatatgcaaattgatgagaaaggtgatattgtagatatcaagggaatgggtactgttcaaaaaggaatgccccacaaatgtcaccatggctagactgggagagtctacagtgttccccagcatgctgttggcactgttgtaaacaagtaagggcaagattcttgccaagagaatgaatgtgcatattcagcacactaagcactctaagagccgagagagcttcctgaaacgcgtgaaggaaaatgatcagaaaaagagggaagccaaagagaaaggtacctggattcaactgaagcgccagcctgctccacccagagcagcacactgtgagaaccaatgggaaggagcctgagctgctggaacctcttccctatgaattcatggcatcgtgggtgttaaaaaaataaaagacctctggactagaaagaaaaaaaataggcattaaaaaaactatttggggaacaactgaagaaatctgaatacagctagataccagaggatatgcaatcatcatccattctggttgtggtgatggacgaaggagaatgtgctcagagaggcaaactgacaagtacttccatgagttccactgccctcaaaataaaaagcttgggataaaagagttacatggactgagaatgggccggggcttagcaatgtggaggccactggtgaccttaataggtgtagttttgctagagtcatggagacaaaacctgtctgacgtaggcccaagagagaactgcaaatggttatcagctgcttccccgtggagctctgctgccaaggccatgagctggagaggaaaaaaggtcagcagagcggcttggctttaagaaggagaaataacttgattttcacatgggaatgatggtcctggccaagcagaaaatgaagctgatggcaggtcttatcgctcaggattttaggaacagggtaagtgggatcccaccacaaagtctggccagttccttccgggctctcgcttcatatatgcttccatctggttgtaatctttttcttcctcagtggttaagtacaaggcatttccacagctaaaatagtgcgggaacagatcaccacacgtatcaatggggaaattctccctcagaggggaagcaacttccctaggccaccccagaagccaggtccagagccaggactgggcctcaagctcctgtctgtctggtgccttctgcttggctgtggggttctctggttcaggtggtgatgggtcagctgtgttcttacctgtccccaaggctggatcctgggctgtcacctcattcatacatcgggaaagacgatggcctcccccatgagaagatgaagcacatggatggtgctggaggaactggggtggggtgctcccccacagtgctcccccatacttcctgtggacgaactgtgctccccccacacttcctgcccagtgttgtgacttctgcatttctaaggtgagcctggcaccaaaagacactgggtctagacttccatcaggttcaagttctgattcctgccacttcacttcctagctctgtggccgtggtacacctcaccccttctaagtccacatcctctcctctctaaaataccggcactaggagcaccggctctggtagcagtgaggatgagatgccagcagaggcacaggtgcctggatgtgcaatgatggcagcaggtccattcactgaatactggggacctaccaggtgccaatgaggagagagtgaccttgggccaggctgtccaggcagagctgaggagctgctgctcggacaactgctgggagaccaaggatggtcctggactgacaaggaatgaggaagaaagagcagcaatgcaaaaaagtggcggtgttttaatcaagtctcattacaacggcagaattaggaatgagtcccacctagcttccacatgcgtgggcagcagctgtcacacgggcctgtcgtggcactcagcccatggcacagacatatgtggctcagggcaagaaccagtggatggggctctgcacaggaacgctggcctcgggatgggagacccggcctgcccaacactgctcagagcccctcccaactctgacaacaggctcgggtcaggactccccgaaatcaggcaccctcctgccccactgctgagatccccaacgggccagacctagcttggaaactttcttccacctggctggccaggaaggcagcaaacagagatgatgactcggaatgatgggctattcggaaatggctagggaaacaactgtttccctactgtcctggtgggacccaccctgggctaacgggcttcccaaggaagtcctagtggctctggggtcctgaagtccccaaatgggaacctaggctgagagaagcaaggctgtgagggcatccaaagggctgcctcaggttttgttcctgagaacgaagcgtggccccggaggctcaggcgtgctcagtggggccagggccaccagcatgggagtgggcaggggctgccacctgtagggggccagcactgggctccggggacgccagcagaggggccgagaggccatcagcagagtctgtgtcgaggtccagcctcccgtaagcttcgcacagaggcaggtcattagcttcgcaaaggcttgagcttttccaccaccagaaaccccagggagagacaggagcaggcagagaggaaagccaggggaggggagagcaagacagaagcagagttaagaaaacacgaccacaccccagacctgcctttccctttctccactcctgctccatctgtcccctgagttggcaggcctggcaaggagaggcggccagtggtgagagccaccctagcattctgaaaggaggaagccgccctggcccaaccaccaacagctgtgtgacctcagcaggcccttcctgcccagcctccacgtgggcctgtcctagcctatgcctcccagctggtgctggtccccctcctcttgcaaaaagctgtcagcctggccaccctccctcctccctgactgcagaaaccccagtgtcactacactgcaaagagctctctgagggcagactgtgttctttctgggtctgtccctgcctgagacttagcctgaagggggcgacagttgggaacacaggccctggcacttcccgatagccctacatcagccaggcggcctccagcaggcgtccccacctctaacacggggaatcctcacggcagccaggatgcaggtgaagagctcagctagcccttcccatgcccgcagctgtgacaatccacgctcgcctctttctaacctgcaggcaggggccctggctttcccgcggcctgcctcgcccctggcttcctcccttgctcctgccctcagtgttcagtctcagaaccgtcctgggcacagagtggcatcccgaggaaagcaaaggagaggcagagccagaaagagcaactaacaagcagagagggggcaggcgagcacagaggcgcagctcatgcggaacagggcagggcagggcagggcagggagcggagcgccctttgggggaccagcaagaaggggcagaggaaactcggccaggacctggtcgcttaaaggcaatgtacagaggagggcaactgcttctgccacaggggctgtgtgaggccccccagggggcgctggtgtggacaggaggcctgcgggaggggacacaggctggcctggaagccccgctgggtgaagctgagggactgttgggggagggcatgggaagcctggcacagatgtcctgggtttgcgccctgctctgctgcagggccgtgagcaggttccctctctccctgccccaaggcaaggcaggcaggctgaattacaggcccacagctgctctgtgcaggggccctcagggacggtggctgcctcaaagagaccgacaaactgaacagctgtggaaggagatgcccagaagggtctgaaacaccccaggacccctctcagccaccctagtgtggaggaaatgctgcctcatgtctgctgagttaatgagtactggggaccaaagattccctcagaaccccctggaaaactctaggactgctgcagctcagcagtgccactgagcccagggcagggaaaccaagccccaggtcatgctggctctggatagctgtggctcccagcatggccaatgggcagaaaggagtattttaaatccaccaccaggaaggaaaggtttgtccaggagaaggcacaagatggacatggactctgcatctgctggactgaatcttgattttctaagctaatggggcagagtggaaggcctccctgtctccagcctaagtttccccctaagtaaatgatacgtagactctgatttctcagggcccctccagctcaaacggtcgaaggtttcagcttcttacggagccccacaagggtcaggatgatgggttttgacccttctgcatccctgggacccagcatggggcctggcacgtaggttggctccagctccgtggataaggctgagtgggtcacgaattggagctccaatggctttcaaggccattccctgcctgggcttcatcccccacattcccatgactgtccctgcctccacactggggtttggtgacatccacatggaattgcatccctggtgccctggacataggtgtggacctgactgcccaaaaaaggctggcccagccttggctgaaatctctacatatggattcagaaggtaacaggagcagcacagccccagaacgcactgcccgaggaggaaggctctcggaagagggcctgcgggggatacagccaggcgcctcccttctccagactcggcctatccgactggcgtgagtcctgtggttttcatcacattgcactgtgggaaaggcccagggccctggcatatggatgtgaattgtctgtcggtcaaacgctctggccaggagctctgctctgaaacccaggcatggctccactgctaagaccagcaagaatttgaaaaagcagaaggcagccctgcctgctggccaggcccaggtaggcaggctcccgctctgcatggggagtccagcgctatttatacctggacgagtaatactcctcctccagctcgtagaggtcaatggagatctcgtctcgcagcgtgatgagcttccggtcgcactcctcctgcagtgtgcgcagctgctggttgcgctggtcaatggcctcgttcacggaggggaagtcattgaggatcaggaactgcttgaggtcggacaccagcttcatcagggactcgccggctcggacctgtggccatcagaaccagggcgggcacagggtgaggggggacagcggccttgcctacaagtagctgatgctgggcaagggatggcctctctaggagcctcagcttcctcatctgcaaagtgggactctacccctgacctccacaggttcatgtgtgagaattaagtgagaaaactgggatgtcagttctgcagggcaggccctcccctctcgtcagcctctggcttccactcctgcaggactggcctccagtccaattatgcaggtgtacattctgctcatgaaaaactcaaaccccacagataaaactgcgatcccattttgcctcctgccccggggtaggattaacatggctgccagctgggcagagctcctgtgggacctttttccatgcattttgagccctggacgtgcacctgcggaattatctgcttgctgtgtttctcctgtgatccgaaggaatccaatggcgcctacagttccattcggctgtttgtcttttcactcacaactgaccttaggaactcctgagttagcaggaagggctaccctctttctggccactgcacggctacaggacgggcatgggtggctctctgcccagccctcctccaagtgccccacgtgaggacagtctcctgagaaatgatttgcccccacctcattctttaaagctgccgagtggtgaaaccaaagcatctctacatttgcctccttctgctccttctcgggggaagaagaccagaccagccccagagccccctccactccacccaggaaacctgaggggactgatgctcttggagcccaggccgtgccctccaccctggccactcacgatgttggcggctcgcacatgcatctcgtaattgtcctgttcaccctgagtggcccgtgacacctgcgtctcgtcctcaatctgggggaaaacaagaaaacctagaaatcaacccagccaaggcatccccacccctggcccggcccagcccagcttacggtaactgtcatctacccaggatgtccacactggccacaacctgtctgtggtgccatctacagacctaagcgctgtcagccagacctctgacaaggttcaattccaccctctcttgttctggccatgggagacaacatgcacctttgctcaagacaaatagaggcaacccacgctgcttgctgtgctaggtgcagggatgggggcttatcttggcccggtctttttgggctgtgggagccctgtttggtaggaaccgttgtcacttgcttggcatttggtaaactgttggatgagtgaagggatgatttaagttttttttcgcgaccatttcctgatcacttcccaggtgccaggctgtgtcatgcacttgaccaccattaacccatgccagtttcacagaagcctggcctgccacccctggtgtataggtggccaagcgaggctggatggggcttcccggcaggccttgcaaaggctcagttcggggtgggtgtcaggtaccctcagtggttaagacccagacttcgtgggttcaaatcctggctcagccagttgtgagctgagtgaccttgggcaagtcactaagtctcctgggcctgggtttcctcctgaaatgaagaggacaacagtgcccacctcacagagtcctcatgaagattcagcagaacaggcacagataacctcacaacgtggcttgatacatggcaagcactaagtacatgctagcttccatcctcatcatcatcgcttatggagcctgccaggtctgcagcagccaggagggatccagcccaatctgatgcagctgtagctgcagtggtcagcaggcttgcaggccccagtgctgaccgctccacctgcctggaggccaccccccacttctcccctcagtctgcttttctcctgctcattggctgtgtgccaggccccgaggtaactgttttacacagataaactcaccagtcatcacaaggaccccaccatgcaggagaaactgaggcactaaaaagtgaaatctccatccaaatccatactgttagtaagggctggacgtgccattatttggtttgcttatctactgaccagctccctgtgcactgggtgcttcctgcctagaacactattcactcgcgctgctcagcccctggcctctcctgtctccaccccttctcagactctgctccccttggtgggccaccccacccccaccttggcggtcttgatgatctcggtgaagttgtccatgatggacttaatgtcgtccttcagccgcttgttgtaggactgcagcagcgtctccttgctctggggcagggctctctgctgggccatggctgagcctcaagcagcgcagcggggagacctgggacctagagtgcagcacagacctctgagtgcaggcagagtctaccccagccaccctctatgccccaaccttagcagaacacgcagatttctggggattccctttctgccaaataaagtcaatcactgaaacacagatgaactcattccatcagcagacaccgcagggggtgccaggactggccccgcctttgccagagcaagctcatcctggaactcctggccagccctccaagccctgtccagggctccagtccagacttcacgtccaggcccacagcgtgtcccagggagccctgcaaactcaacaccagctccccgtccccagcccttggcttaacttcttagcccgccgccaccttcgccacgccctcccatccgaagagtccttccaattcgacccctctgcaccgcctacatccacgctttccttccactcccactcaggctgccccgctccagacctcatccctgcactgcgggccccgctccctccagtctctgcgcggcagggaagaggtcctaaaaagtggtcattccaaccgggcgcggtggctcacgcctgtaatcccagcactttgggaggccgaggcagggatcacctgaggtcaggagtttgagactagcctgaccaacatggtgaaaccccaactctactaaaaatacaaaaattagccgggcgtgatggcaggcgcctgtaatcccagctactcgggaggctgaggcaggagaatcgcttgaacccgggaagcacaggtcgcagtgagccgagatcgcgccactgcactccagcctgggcgacagggggagactacgtctccaaaagaaaaaaaaaaggggggtaattccactccctcgcttaacatccctcatggttccccggtgcgccgggacaaggggctcaagttccgcgccgcgcctctcggcctctgccctccagccgcactggacggcctcggcgctggagttgcctggccctggggccgggcctttgcgcgcggtgctcagggagggcccggggccccctaggttcggagtctggcgcacgaccgagcggactcctggacgcactcgcattgtttgtgcccatttttggcggggtgtgggaaataagtcacacgcaggaaaggggatctccgaccccagcgcctacgcacccacccacccccactcccgcccacacacccaccccccctccatccccaccccccaccacaccctcatacccgccccagcgcccgcacaccagacgccgcgtccgccgggtcggcctagggcggggtggtcaagtgcctctgcgacccgcactttcccgcgtctctcccacggcctggccctcccgccgcagtctctcttccccgccgcgccgcggtccgaaaacctagtcagccgccgcagcctctcagccccgcctcgatttttagctttataggaatgctgttgctttaaatccgaaatcccgtgccggtatcaactctcgcgatctccgaggccgcatacatattacccacaattccctttcctttctctctcctcccgccgcccaagatggtgagtgagctgtagttccgtggcactatagccaggttccggctgtatccgctgccatcctcctccaggcgcggcctcggagggcctcctgctcctcctggcgctaggagagccccactcggtgtggcacggagacaccgaggtggattagagccccacttggtgtggcacggagacattgagatggactagagccccgggcggccgagagcggaatgcgttgttcccggtgtcgcagggctgggtgtcgcaggcctggagcaccgcagtgcggggctcggagccctagcgtctctcgggcttgctgggggccgctccagaggccttgtgagcgacgagttctgagcccgcccctgttgcttctagagcctgtggggccgcgactcagaggagtcatgagtccggggtgtctcctgggtgggcgacgcgaagagagcgtggtctcgggcttagccttgctctggccactcggggttcccggggctgcatgcttgtgcggctgaatgtgagatgctcctgtcgaggggtggtgctggggggttgcagaaagctgctcgccagcttagttcaggcaggtgctgtcagcgtcccttgttttggaggagccagcctgagccctacccccgacgaagcgagtggaggcggcggtttaactgacgttttctttctgcccagccgaaaggaaagaaggccaagggaaagaaggtggctccggccccagctgtcgtgaagaagcaggaggctaagaaagtggtgaatcccctgtttgagaaaaggcctaagaattttggcattggtaagtaacaaacggcagaatgaaaacggtctatgtttttctcaagggaaggtggtaattgggttgtgttgtatcttgtaggttttagtgggtgtaaagtggtcgcagtccttaatttgtgtctcttagagacgggggcaatgatacatgcttcttgctttcattgggagttgctgagcgagcattcagctcaatatggtagtggccttgaattcagcttagccatctggaaacaagtacagtagcagtgtcgcagcgaggtactaggactgcaattctgctgtacttcgtggcaccttggcttcttgttagatgaggaaaagcatcgtgctctttgttctcaggtgtttgtgtgcagatgatgtaaaagaatatttgctatctgagagatggtgatgacattttaaaccaccaagatcgctgatgcaccaacacccttcctagtggccccagacatgaacttgacatggaatttgagcctcactcggtgtcaccctttacttctcaggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacaggtgaggttctgtggcgtggaaaggagtttctcaggcaaggattccttatttcatccagaacatgagggggatggtcttaggcttcttgaactgcagttgtcattaaattatagtcatatagcaggaccgcagtccagcatttgttattaagtgttaagtgacaaggattagaaccttgactccaagcctaaactgaagagtgtttttccagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttc

SEQ ID NO: 38191 - DNA, 10519 bp, Homo sapiens
gcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggtcgggaaacaatgcacggcgtgccgcctctgcggggccggcctctaggccgctcgcctccgcggcggcgcccggcgtgggcaccacgacccagagaaacaaagaggccgaggcggcggccgcgccccctgcccgttgcagccccccctagctctcccctaagaggagccgttcggggtcgggggtcgggggtcggggatccgcgtggggcctgcaggcgaagggctggccgggcctgctgagctgctgttctgcatgactcagtggttttcggagagggccctgttgggctttattgagtgaggcctttgcttagagggggatggggtatcagtgggacccgaacttgttccaaaatccattggaacatggggccgggggttctcggcgtcgtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgagtgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccaggtgagtgggaattcatgccatctcatcacatcatgtgcacctgaaagaactgtattccataggtgtaaaagctctttgttcagaattggaattggagaattgttcagttacactcgggtgtttttttaagctgtaagttagaggaagccataaactttataaaatctgcattctagctatacctgatagagctgacacgtgcatgctcaagttgctaattactttaaaggcaataaatagtaatggtatttttttctaaaatacaaggggaatgcaatacctaatgggaacacacatcccccacttcatcccctaaatcctcactaaatgaggattcttttttacactgtctccactgtgcttagttttttatcaacaaccttgaccattttagctttgactatgctttcatcttctagattgagattgttctgtagtttttcctacattaggaaaaaactagcagccctttttttgttttcttatgttagatatatgaacgctgcatccttagttcttggggttgtgtaggagttggcaggctttgagatataaatagaagctgatttcagaggcccctgttgactaggctttatgtgagagcctccatccagctcagcttgtcacattgcagccttgtgacaggctgaagcgccctcccatgtgatctgagcttctgagaaatattaaagcaagctgtgcacatgtgatggcatttaaaagctggctttctaggggaaaaaaatctaaaagatgggaacccatgtagaagactcatgtcctggtacctcttgtgtgtctcgcagttgaaagttatttataatgaaatgaaggtagacatgttctctgaagcaaagttggaatactttgttatctctgagtgtgtgaaatctttagatggagtatcctccattttatctaaaacaaatattttaagaatcagattaactaaaattacttaggtaggttgatcgcttggccttaaactttaaagccaatgtcacatgagactgggcctcagtgtagaaaatgtaagctagcatacttaaactggttttaaggagtgacccaactttcatgcatagggcaaacattcacacatattttgtgcgtggtgggcatgcaaatacatacatatttatcatttgaaagcattttttgctcctattatgctcatttaaaaacccagctgaaagtgtttattaataaacttcctaagtgatgttgaaatgtttacactaccctgctccaaaatgagtcagctaaattccagttaatatttaaagagacagtgtcaactaaattaatactgttgttaaaagtaagttgtggatcttggtcactccacacaagctagattgtcttaatatttgtatggtgcacttttacttacaaaagggaagataaaatgttttggggaataattaccaggggtctggccaggtcaaaattggttagtccccttctcccatcttctaattttggtagttaatacttgttaaaacatcgttttttaataactcactaaaaagtgtattctagtatgtagttggaaaaaatgactgaccacaagttacagcacacgaattttcctttaagcaaatgctctcaaatatgctttttgtacatatgcttatacatgtttaagatgacatgaaaaccctccacaactttattttaaaataatttttctttaatatgtattttctcatccagaggaaaacttattaataatttagcacagcgttttaacaagacttttagaaaagcaaatcttccttggaaacaaatgcttgctatgtaaagctttttctggtaacccagcattgaatattaaccattactaaaggttatgtgtatatattgactttaatacattgaatttgagcttggaacggttttattattttctggtatgaggaagacaagcacttgttaaaattaatagtgcctttggctgagaaatctggttcataatttgtgtattgcaggttcctaggcactggctttgacatactctgaaacttcaaatggagaacgtaaaaggagtttcgtaaaccagctgaccctaaattcttagagatttacttgttggtgccagggtagcaggaagggctaccagttctcttttcagccttatatgaagatgtttcagcattaaaaagtacagatgctctgcctcagcagatttgtcaaattactgatgaagcccagatatgtacaggtgttttaagaaaactttattcatccagtttaaagaactacctataaatatcaagactcagtgataattgtgattagccaattaagtaaaaacatttgaaatggtctgcctgtagtgcagcagagtgaaaagttaaagataccagtttcccaaattgattaaaacataaccctgagagctaacagaccttttcataaattgaaaccaagaatagtgataggtaaaaataccctaataattgataaaatttctttttgggtttttttttggtcctaaaacagtttgcttttataaaggcaacaaaatattgataattatctctgcccaccctttttaatgattaacggaatttgggcttttgttaaaacttgcgtagcaattacaacggtataccgatgattatattagactatattttggtgataacactaatttctgaaatttcgtttcatctatagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagcttttcagttttcttttttggggttattttgtttcacacttgtgttcattggattgactttttaatattttttgtttggatactcaagtataggattacagcacagtgaatgcttatatcactaacctaattaaatgcaagtatttattactacgtcttgatactaagtgagtttttgtagtgttcattggttccttacaaatcctttttttaaataggaacagctagtggttccaacagtcctacctcagattctgcatctgtacagagagcagacactagcttaaacaactgtgaaggtgctgctggcagcacatctgaaaaatcaaggtaagattgaacgtttcagagtttttatgatattacaaagaagaaatcaagatgtctgtactggtccaataataagttaatagatacccttggctttgcaatcgaggatttcagtgtcttttaatacatgactcttaagtcattgagtaaagatgtgtgttacttacacctgactccctaaccccctcaaggatactgtgttggaaatgctgtgcttttttatttctttgtaattgaggtttagggattgtcgagtgagactgtagaatattattgggccagacaaggtgttttggcagagctgcccttttgcccttaaacaagttacaggcacagctaaaaatccctagctggttgtaaaatatggtaacctatacaaaatgcagcctcgagttcatgagccatttatcaaacttttttctcaaccatttgtgctgggcatccaatttttttttaaactttagattatctagctccatttgctcattttggaaatattctataatttaaagttgaactgacaacttattcattgtctcaagaagtacccttaacacctttaaaaattgtttgcttgaactcaaatagaaatgtgcctgtggctgccttgcctgtaactcagcaaatgacagaaatgagcatttcaagagaggacaaaataactaccccgaaaacagaggtgtcagagccaggtatgtttttcatttaatacttgttcagttctgaatttgatagtgcaagaaatggctggtggggggattctttccttcccattgaaggaccaaagaggagggagagccataaaatataggccaagcaaagaactactatctttaaaagtatcttgagtatgagtatcttgaagtgtaaaatagtcatatttattctcagtttcttctctgctcatcccctgcactacccttgtgcataatgggcaaagtctgtaatctggagattggatgtgttaaaaacttgatgaagttaaatttcaagggtataaggaataattttataaccaaaagcagtaactttagttttgatattgtcaatgttgtggaaaacttttaagtagaacaacatatttgaacactagaacttatttgaagtacaatattcctatcatattttgtgggagtttgaaactcagtgtggaaaggcattttggttttcatgagatatggtgactttggaaactttgcttatatagcacaaccagaagtgccctgatggtggaagaagactgacttgaattacctgtactaggccctagaacaaaaagatttctgtgctttatatagtgcacgtagcttattttatcaatttgttcttttttggcagagtgctgattaaatgcaatataaaacttctgttgtgaaaaaatactgtcagtggttatacagtctgctttggaggctggcttttgctaacagcagtcaagtttgtttattgtattaatcttacaaagttaaggccaaattctcaagtttggcaggtgaatctatatttggcattttgaaatgagctccatccttaaactgaccacattagtttgcccgtgatgcctttgtttgggtttttgtttttggttttggtttttaaatacaaaattactctgaccttggaagaatagtcttgggttagagctagtctgcatttattattacttagtaggcattctgtgattcactgctatttgccttttctgtgtcattttcttattcccccttcttcccttgtctcaggagccgtagttcatttttcagatgtggccaaagaaatggctgacaccctccctctaccccatacaactattcccctagattattctttatcctcatgacatcaggataaacattaatgttgtcacagtagcagtaggtagaatattgttcgtttagtctaatattaggctatttctcccagtagattcattgctaatgcaattgaattataaatttgggcagagttttagagaaaattgccattaaatcaatcagcttgttgtaggagcttgtctatatgctaatagcattggtgctggcatatttgggcagtaatttcagcattgcatacataaatttgctattgttacatttggattaatattaaaacctgagtttatagtgtttcaggtgtagttgaattatatgtaagtagatataaattttgttatttttgtgttaaagaactagtggcagtgtgggctttagtacagtaatgtattttttgttcattgtgagaaattttattgatgccatgtgtacactgaaacttaaagcctttttaggtggagaaacggtgggactgtttgtagatgctatctctgtcgatagtggatgcccattttagataagattcttgttctgcctgtggaatccttaatagtttaaaatcaatacttctcgagtagtttctaaagactgtttgccgatctgtttttaaaaccaaggtttaaaaaaatctttcaagtcttcctatgatgtttagtgcacctgtgaaaatggtaaaatgattgttttggaatttttggatctgacgttgatttagggatgaatggtttgagttttatttgtcaaaatttgctgtttttatatctacaggattttttttcctataagcataaaatcaaagttggctactgttatttactgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttgtcactcagcccagtccatcagtttctcagcccagtacttctcagagtgaagaaaaagctcctgaattgcccaaaccaaagaaaaacagatgtttcatgtgcagaaagaaagttggtcttacaggtattacaaaacacaagacaatgtatgttttacttctgcagttaacaaggagcttttggtcactccctaagagactagttggtcttacacataaaaaaaaaaaaaaagcctgactagctgtagtctaggaaaggtggaggaggtggtattggggtggaaagaagttgggttttacttccatttgtctcctaatcatataaaactattaactcaggccctcttattttattagattgataaaaagtttttgtatacctagggaaaatgttactgaactaacagtaagcgccacctactttgagctatgcagggaatgttcttggtgctttttttcttgtctccttcaaatctcagaccttgatggttgttttcacttgaggaagcattacttaagatatggtaggactgtgttttgaatccagcttagcctaactccagagcctgtgtaaattttatcctgcgttgcatctacaggagtcgatagagggagagcatctgggagaaattagctggcagatagcccattttgttttctccacgtggtttggcttaccaaacacttcgctattgcccttgcaaggaaagactgaacatagttatttgaatttctcaccatgtcaaaggaagttaaaagttccttttccaggttaacgtgatagactctgtaagagttgactgtgtcttatcaccaggaagtggaagaaaagagttcactgtcttttatgttacaaagcaatgaaaatctggttccttttctatagtgactaaggcttttttttcttttaattgcctcaagttctcaaatgactctacttcttcgtttgtacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 38192 - DNA, 16669 bp, Homo sapiens
gcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacggtgagtgcccgccgccgccgccgtcgccgcctccaggaagccctcggggccgcggcctgcaaaagccgccgcgcgtgatgggccctcacagggtcgggggagccagtgcttttcagaatgcctgtttaggacgagctcgggctcatgcatccgacctgaaccaaatgcagcagcagtagctttgggtggccaacaccaagctcagaaacagaaaaaaaaaaaaggccgtagttcaaactgtatagtttttttcctgggttttgtcggttacgtacgaaagattatttcaagcattgcaagtttagatgagtaaatataatgaacaaagtttcttggagacctgaaatttcttcccatttctcttccttctcgtttcttcttatgattaaaatataaatattgaaataacgtgccttccctaatatcagtggattcgttcaacttgatatagctgaaaaaactttctcatttaaaaaagccctttcaggcagttttagcagttaacgttttcaatagatatttcagtctactttaccggtcaggctagttcttgttagctcttgttctagggcgtgtcctttggtttaagcatggcattgttgtttagaaaacttaattattttaatccgatttgaaatctaaaaagcaaacacattccctacactcgcgacgtgaagcagagttgacaaatttaatgtacctagcaggtgaagtactgtatgccattttcccagcatggaggaagctccctgcttgccttgctgaaagtcaggactggagcatagttcttgtctgagaaggcattttctttcacagtgggaagccccctctcctttcctgggggtggatgggaatcacagctggggtctactgtgattagcaatgtgtgtgggggtggagatggggtctgtgagagcctaataaaaccttaaagccaaatgggctttacctaccgggtttaatagttttaaacacagacagcaagctaccctgcctgttttcatttcttactattaccattgacttgatttttttctttgaagtggcccagggcttccaacccaatcctgtttatttgtgtttccgggggactatatcagcaacttggtgccctttcttttgtgtaatcctttggacgtcacttccccacaaaaggaagcatggtccccattagccaggtaataaaatgtaaacactgcagaaaattccagctttctttgcagtttgtgtgttttcttctctgaaaacccatacactgtgccagctcaggtttgtatcatctccagtgttttaggtttttaaagcgaattaattgttttttgaaataatgtacctctatcttctagttaaaatgcatctgaactcagtctcttctaggggacctaacagatctgcgtgtgtgtttttaaacatactttgataattataccctactccaaagactaatgcagacccaaagtatatgcagtaatcctccacatataaagtaagactagcgtgcctttgactggtggcggggatattggcagaactatgatcagtgctactgacgggacatgatttgacctgcagggctctggctgtgaccacagccctcttgtgaaacatgcacaatgccatttttatttttcttgacttgcaggatgagctcacctttttagggtgtggtgttccaccttagactgatacagtgctttgtatatggaaggcaataagcaggttttttttcttagtttggttgaatttttaattagaagtctaaatgttaatttttttcattgtaaagaaaacactaaccagtgtatagtttataattcagtttgacatagaaattggtccttggaaaagctcgattttctaagtggatctcgaaaaatctgtttatgatgcagcatgactgattttcgtaaatggtaatagctttaacaactcagtttagttattcctgctacctttgcaaagttaattaagtgccagtaatgcattacacacggctcttgctcaagatctggaatcaaatcatgaatctgggatccgctgtcatgaagtggctgtgggaagaagacagcagatatggagctacctctggccgttgtagccaaagatgagtttaagtgcttattatacgtctgtctcatcgcctgcatgcacattgtctagttttgcctcacaattgtagaagctgtgtataacgacactgtaaggcgattatctaggcatctatgaactctggattttcagatagccttagtaaggccttactgaaaaccatatatttacatgagcttgtactttatctaaaatgaagtaagcagtttacacacactcccacgtatgcacaaacacacagtatcttgtgcaacaaggaataaggttgatggctctgattaaaatgagatctccgtatagagaattgagtgtgtacatccactttgaaaaacttcttgatatgtactaggcaataaatattttgatttaccgttgtaactattaagaaaatcttgttattacaaagtgtttcaacacctctcttattagttgataatcataacaatatgttcattttggtagtaaagacacaggttattcctggcaagtattgacaataatccgaatgaatatggatgtttttataaagataaataattccttagaactatataaaaagcagaatattatatttttcactgttactgacagtttaagaatttcagatgaccaaatcacctcatttttccttgtgaaggagccaaattattcgctgaatattttctttgaccagctaaattaacacccagctaaaaacattcttatttgaattttttaaaaatcatggtttatatttgtcaaaacaggaaaagaaaatctatagattaatgattgaaatcattcaaatttcacctataaataaaatgtgaaatttaaatgcatgttcactcatactagttttgcaccgctggcaccatcttttctagtttttaagaaagaatacatcaggaggatattttcagccgcagctgtgtagatttcaaatcacaggcaagctccagcttgttcaaggggagaataatggtgataagtttgtgcaccagagtgaaacagggagtcagtgaggattgacgagcatttgccttgaatccaaactgggaagtacaaagcctccggttttttgttgttttttaaccaaagacaccctttgcatactgtaaatgcatcaatattttgtttgtttttaacatgaaatcgctgttggccaagtcaaagaatcagtattacatgaaatagttttaggtcagttagccctgtggctctccaatgtacaagaaataagaaaagtaagtacaagttaatagttcacattagtctaaattcctcttaaagcagggatccccaaccctgaggccacagactgttactcccactgattctacattatggtgagttgtgtaattatttcattatatattatacagtgtaataatactagaaataaagtgtgtaataaaggtaatgcacttgaatcatcccaaaaccaaggaaaattttcttccttgaaactggtccctggtgccaaaaatgttggggaccactgattgaaaggacttcattttgagattatgcccttgtggttttttcagtggggagtggggtagggaaaggtattaaactgttcctggccgggtgtggtggctcacgcctataatcctagcacttagggaggccgaggcgggcagatcacttgaggtcaggagtttgaaaccagcctggccaacatggtaaaaccccgtctctactaaaaatacaaaaaaattagcccggcatggtgacaggcacctgtaatctcagctactcaggaggctgaggtaggagaattgcttgaacccgggaggcggaggttgcagtgagccaagattgggccactacactccagcctgggtgacagagcgagactcagtctccaaaaaaatacaaaactgtacctaatttatgaaattaggcattagcagacagattactcttttttttttgagacggagtctcggtctgtcgcgcaggctggagtgcagtggcacaatctctgctcactgcaagctccgcctcccgggttcacaccattctcctgcctgagcctcccgagtagctcggactacaggcgcccgccaccacgcccggctaattttttgtatttttagtagagacggggtttcaccatgttaaccaggatggtctggatctcctgacctcgtgatccgcccacctcggcctcccaaagtgctgagattacaggcgtgagccaccgcgcctggccgcagacagattactctttgcacgagcatgtatgcattcaagttcttacacagcaaaaaataaaaagttggccactctattgatttaataatttttaaaagtacgtatgatttataacatctagaacgtttaagacccagtaatctagtccaggccattcattccacatgtgcctcactcagcagtagccaccccagagagcctcggttcctttctcagtgtcccctaactcgtgtttgtcctgtaaagggacgcagactactgggatgttataattagaagggaattaaagtacaccagattcaagctttcaccaaagcctgcacccatccatagcacccctgactaagcttcgtcccttattcaacaacttagttctgttgcctggatgatagtttgtttccaagtccttctcttaaactgacagagctgtgtaattcctactttccagctttctttcattgacacatgttcaaatatttgagggtagaccccaaattcactgctagttgtctttagattgacttttcctgttttcaccctgtcctgtatagaatggcttctcccctcgttgattagataaatcgtctaaaagaaggttattaagggttaaagtaacagagagcaatggagtagtcagtttcatgagaccatgcagagcatgtaaagaatctcacaccatctgtggaatgctctcccgtgtattctccctgccatctctctgttgagccatttaactgccttcctgaacttctgcagaatggtgtctttttatgtattttttgggggggactgctatgagttgtcctctagatttttgctgctctaagtgtcgcaaaccaggacagcagaattatctgggtggttgttggacgtccagtgtctcatgctggcctaaggatcggaatcggcattttaactacttcccggaggaggtaagcacttttaagtttcagaagcactggccaaatcactgcagattacctcctcattgactatgcaaaactatatttttgaatatatcattctcctatgcttacatttagttgtaggcaggatctttttaattttttgaactgtggttttatccagttttcagttctgcctgtgtttggcttaaagagccttatagaaacaatatgaagaatctgacaaaatcttggatgatacagaatctttggtattattgacagatgaatcctgtattctggaaagggactggactctggttgggtgccacattagtgtcataagggcgtcgtttaaaactaccaaagaatgcagcagattcatgaagaggaggactacctttggggggaaacttagtgatcgtctccaaagtatcaccaacaatttaaaaaatattaatgatgttcttcttgtcttaaaataaaagtttattttattttctcaagcttcagtttatcatttctagcttgacttttttttgagacagagtctccctctgttgctcaggctagagtgcagtggcgcaatcttggctcactgcaacctctgcctcccaggtgcaagcgattctcatgcctcagcctcctgaatagctgggactacaggcgtgtgccaccacacgcagttaatttttgtatttttagtagagatggggatttcaccatgttggccaggctggtctcgaactcccgacctcacgtgacctttctcggcctcctaaagtgctgggcttacaggcttgagccaccgcggctggcctatttctagcttgacatttaaagtatttatttatttttacttttttgctcttattagttgatcttactagccttgtaacattttgcgtttttgtatgtaatttctggaaaaaaatacagcatgctttgtcatacagaaaccttaaaaacacgtcctaggaaaaactcagttttgttggtgatcgttaaatggtttccgtgttcttgatttaatgttgaatctttgcgagggctaggaaactttgagaagctgttgttcatctaatgaatatcacttaaattggatttataatgctgctggtttctttgattacatgagcttttctaaatggtacttagaaaataaagttaggacaccaaattggtcttcccttaagaaaataaaacaaacaaacaaaaactttcctacacagaaacgcagcatctatttacctggagtactgaatgcttttgtggtctcaatccagagaatgagagttgacaataagaatcctttctactctctcccatacacttacacacacacacacacacacacacacacacacaaatctggtatataaaatagtaatgaaagacaaacttgtgttcgtattagataaagatggacagtctgcctttgaaaaactgaggaccatctattgaatcatgaaagatgtagctttaggacaagttctaaaaattgatgttttccagtggggtcgggaaatagggtagaatttagaccatgatataatataaaaatataaacagctcctaaagggtttggtcaatttgtagaaagtaggctcattctaggtaactaagtgagaccacagctacctagggcataaagttattaacttttcaaaatgtaggtcatcgagaatacccatgtcctaagtctctacatctgaaaggctccttctcagacagaacggtgggctgggaggaccctgctcagacctggtatggtctaaatggtcactgacatgagaaggcagattgctttacttgaagacgtctgttattcatcagtcaggatctttagaactgtgccaagttttctgtcttaaatgatagttaagtgattcaatgtgggtgtttctgtgatgcaaggagcaggttttacacgttctatttccaaggcagtctttctcaagacaaaatgtggtttaattttccattttgattttctttagactcagcactttaaataagcaagacatgaactgagtcgtgttaagatagcatgggaaaagttcttaaaatattcctatatttatgttcacgtcttggctttaggttaggtgaattggcttaccatttctttggtttaattccttccaagcacttgaaactaagcataaattatacttcagctataatgttagaggaagtataatagtaataatctttttatgttaattttcctcaaataggtaaaattgttaatattactctttacagaaatatcatacataatttatttggctagatttttcaaacctttatctgtgattgtaaaagtttagttattgaaatagattccttgttaggaggttttgcctgtttttatggaaaactcacattctcctatgcaatgatttttattatgtttgcgttcttttacatgcatatatagatatgtttcctttcattgcagtttcaaacttctgaactcataaaattaaaaaaaagtttttgcttatttgatttaactattggacttaattgaacttaacaattaccagtggccatttaaaaaaaactaaagaaatgagactgtaattgacaatgggtcacatacttaaagttatatgatcctttttggtagtgctgcatctgttttaataaggactttaatcatctaagttgttctcaaactttatggatataagaaacactaataacatgcagattcttgggtgctaccactcaagctctgattccataggtctggagggaggcacaggaatcagtatcattttaaggagcactactgcttattttgcctttgtggtctatgggctgtactttgagaggtctgattaattaatgttctttccaaagcatggtccctcttctcttaaaagttatcttacttgaagaacaaggcaaaagtgagaaaaagagacttactaagttttaacattttggctttattcctttctattttaaaataaaacattcccattttaaccttatctctcaagtctctcagtggtctgacaggaagagctagaagatttggaggaaagtaataaaaattgtccgtataaaactaggccaaatcaggtacagtctcagccccatcctgacctaatttgtgtgaaaacagtgtttctaggacagaaaaatgttttatctccttaataatctattgtgccccagtcactcatgaatctagaggaagacctggaaggtgcatgggagttggagaagggcatgtggagccttagctcaggtttgtctctaacagatgaaaagagaaaaatgcatcagatgattgagaaacaatctttaagggatggtgcagaaccttgcgaatgtagaagaaaataaaaacatgaggtactagagaaaagtcacagggacacaggaggaacattttgagtagtgagggctggggagttagtcactgatactacaggagtgtgcttccatcatcttggaataggtgtttttagccttggctaacagatgcaaagactggagtatggccaacaggggcagaggcagggtccaaacgaggtccagcagctccaacacccttgctctttctgccagccccatctttgtttcaccttgaccagtcaaacaacctagaattaagtgaggacaaatactgtcagctgtgctgcgtcacagagtaagagtaacgccaagatggaggacaggtgactcatgactctccttttcaaatgtagtgaagactaataggttaagtgtgcacgatcttccaagagcaaatgaacggatagactaaagtctatccataccatagaatattaatcagccacaaaaagaatgaagtattgattgatgctataacatgacaaaccgcatcataccatactcagtgaaagaagccagtcacaaaaggccacatagtgtatgatattccatttatatgaaaagtccaaaatcggcaaaggtatagagacagaaagtagatttgtggttgccagaagctggaggaagaggggatggagggtgactgctaatgggcacggggtttctttgcggggcgataaaaatattctggattgttagtggagatggttgtacaacactgtgaatatagtaaaaaccactgaattatacactttaaaagggcgaactttatagtgtgtaaattatatctttaaaaaagtcatgttttggattcaaacaggctgaaatcaaactctgtctaaaccatttaccagctgtgtggctatgggcaggttatttgaactctaagtatatccttcatttctaaaatagaaacaatagcagtgtgtaccttaagaagttattaggagatttacactactcaggtaatgggtgcactaaagtcttcaccatcatacaattcagccatgtaaccaaaaaccacttgtaccccaaaaactactgaaattaaaaaatatatataaaaataaaaaataacctgggaaaaaaaagttgttgtgaggattcagtgagctcatgcatgtcctgaatgttattaggtgttaccactagaggaaaggttgtgtgtgaaggggttttagcaatgagggcaggttgaacaataggtgttgttgactggaatcattcgtgtggatagcatggatctctgtatttcctcagtgtagaatagaatgacccagggctggaggtacccatgtaggtcttcaaacctagaagttgattgccatcaaatcctgattcttttttagggcaaaggtaaataattaaaatctcttgtgcaatacattttgaatacttaagaaattaaaatttaggcagaaatttaggaaagtggtttgctcccaagcttgttataagatcttgttataagctagttataagcttgttataagatcagagctacttctccacacttaaattgttttatttaacacctctgcctagtcataaatatattttttcaatgattatttttgcatagaaccaaacattaatatgaaacaaagatcccttaaaggtatttaaaaacatttcctagagtttataatctggattgctcagtaccaaaaatgttgtttattatgatcacgttgtgtcagaacttgggtgaaccttataaatatacccgttatgtggcaaacttatcacacgagaaacagattaatgaagtttgactttcatttcagagatgtaaacttttgccaaaaactgagggggaaaaggcatttctgagtctcagtatattaatgtcctacatatgaattgcctgttcttcccttaaaatatggagatgctcaagtattgtcaaaagaaaaactgtccctccatccaaatgtaactagtagggaaaaaaagcccaaaaccatgttgatactgtgataagtaatttttaaacttggtatgtctgtcttgttaattgctgtttctttttttcttgcagcgtggggtagagcagcggctgccatgctcttctgtggcttcatcatcctggtgatctgtttcatcctctccttcttcgccctctgtggaccccagatgcttgtcttcctgagagtgattggaggtctccttgccttggctggtaagactgtgtgtcagcaattcttcatttatgccttcagtgggcatcgacttagtaatggtcaattccacaaagaagacccgtgactgttacagtttctaatctgttctcggaaaatgtatcaccagggcagaagtaacagaggagagatgtgttttaagatctggttccctttcctcttgtggctcacgcagtgttctgtagtccccatccgagtgacagggattgtcactctacatgcccctatctctcttagggggccctatccactgactcctctacccgagaaactaggctatgtcagccctggaaaagcagtgctctccgttgtggtccccagccctggcctgctgtgagccccctgctgaggggacctgaatgcccctgaactatttcccttgttgaaagaggcttgtgatcttatgatgtgggtcctgaaatggtgttctgccgtgggatggaagaccctgggaggggccagaactggaatctgcagcatggtgcctgtgtggggggaatagtggtccagacacaggtgatgtgaagaaatttagttattcaggtgtgcagggcccagtgtgaatatttattgatggaatacaagaactaggattttaggagaagaattattggaaattttagtcaggtctgtggcactaaggaaatctgtcaaaggggcaggaccctagccacggagttagattcagaagtaaaactggactttctgagcagggaaaaaagagaaggtgctgacagcggcaaagcgaggcctcaggtcatttcttaccagtttaggcttatgggaccaaagcagaaattcaagctacagacccgaggtacaaatacaaagtgagcagatggtcttggaaacaggtcagaagccttatgactctaaggggtctatatgatcatgcatgagccaggaggaaggccactttgcgccggttccctgagcttagaagagttaagttcgcagagctgtgggcaacacaggcgaggcaggaggagtgcctcaaagaaccagctggtacatgcacagtcctggccttcttcacggcacatttgacagtttctgttgattaaaaataaagtttctgatcctcatattttcaaagtttgctttttgaataatattttaaaatcagaagtgacttggaatcacaaaagatataaagaacctggttgatgcccactttcatttctacttgattatttttgtagttcacatttatgagactctagcaaagaaacacatttgatgtgtcttcctttcatgtgtcgtagaaaactccatagatgccagtttaaatcaccattagaaataacacactaaggccaggtgtggtggctcatgcctataatcctagcactttgggaagctgaggcaggcagatcacttgaggtcaggagttcgagaccagcctggccaacatggtgaaaccccatctctactaaaaatacaaaaattagctgggcttgatggtgcacacctataatcccagctacatgggaggctgaggcaggagaatcacttgaacctgggaggtggaggttgcagtgagccaagatgcattgctgtactccagcctgggtgacagagcaagactccatctcaataaataaataaataataaataacacactgagacattaatgttagttgaaaaatcctagtaaatactatatgacccagcattccactcctaagtgtatatccaaaagaattaaaaacaagaacttgaagatacttgtaacccatgttcatagcaacactattcacaacagccaaaaggtggaaacaaccaaagtgtccatcaacagatgcatggacaaacaaaatgcgtatatacatacagtggaatattattcagccataaaaaggaatgaaattttgatatatgctacaacatgatggaccttgaaaacattatgctaagtgaaataagccaggcacagaaggacaaatatattattccatttacatgagctacctggaataggcaaatttacagagacagggagtagaataaaagttaccaggggctggggggagggaagaatggggagttattttttaagagatactgagtttatgtacagatgaaaaagttttgggtatagatagtggtaatggttatacaacattgtgaattcatttaataccactgaattgtacacttagagtgaacaattgaaagtgaaaatgataaatgttatatatattttaccagaataaaaaatatcctagtaaaactcttttatccattgctttcttgtagcattaaaacaaaaagatctagcaatggccatccacagtgacggggtagcagagttattgttgtaaagaaaattagttcagtgagcttcaacagatttacagcttaacagtcggcttaacctagtgttttcattttgtaatttaatactcatcctttcctttaaagagtatgaaaaatagaacagaaaatgtatttagaagaataaaaagcctagaaatctcaacacacttttagtagtaatgctgaataaggcctatttgacttttaaggtatgtttcatagaaactgttattttaaattttatatatattcttacattaaacatcagaaaaattgaacactgatacaatttaaatttggcagaaattaatccaaactgttataaggacttcatatatgatgagccagaatcgataaatagcaatatttaatatttattactaagaaaattagaagtcaacatagaaaagcattgcttttgtatcttacacagtatgtggtagcaaatgacaaacttaaatagtaagagattgctatttaaagtataccagaagtagataaatgtttaagatttgccctaagattgtcctttgtaaattgcaagagaagaggaatgtttagttaagaattagaagcaacaaatgaagacacagaaacatctatagcctttctagcagtgaaaaaaaaaaatgaagaagaaaaagaaaactacttcaaggtacatctgtggagctgtagacaagaattaagatggtagaaaaaatggtggtgaggactacagattccctgataccttcctggagggcacagctacttggtccctccttgtggagagtagtgtcttatggtgaaagagctaaaatcagaccctttgacatggcaatgtacatataaagttaaaatgatgcagaacacacatgtatatactcattgtagctttataaaatcatgcatgtccattgaaaaagaccacgaaagtagactcaataatgttcattttgtttgaaattgcttaaatactattacaaagattaataattgtaataatgtgactattatgccagagagtttagaaatcttcatgtgtttctttccacatcttaactcacacctccctaagcactgtgatcatttgctgcttttgttttttctgtccccaccacacttccccatgcccttccccctgccctccctccacgtctgtttcctcttcagatttccgcgtcctctgcaggcttctctgcggattctccccttgatcattctcaatattagttcattgtttcatttagtcatttacttattgaatgaatattccagtgatgtgttattgaatatcaatattgagtcatgtgtgcatgcctgtgtgtatatatacatatatatatgtaatttttgctaacactgaacatattgaatatgtgtttggtataggaaacacaaagatgaaaaaaataggttgttctttactgtcctgctttctattgtatgccacagttttgcacttttttgctttagtatatataatgcttatgtaatatagaatggatctccaatgatttttttgtgtgtttttcacatatttggcatatgtgtgtgatgctgctcagtgccaggcatctcttacacacagtagtcaagaatcttttttggcctctgcctaaccagattcctcctgcctccaggtagattttatacttatttcaaggcagaaacttggtggaaggaggtaatctgtcgctaatgtgtatttattccttcatgcatgtatgcattcataccctgggatttttttcttccctttagctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacttg

SEQ ID NO: 38193 - DNA, 71638 bp, Homo sapiens
cctactcggagaaaacctactttatcttatttaaattagggtcctccaagcgatcttaacatctcctaagtcccaagcaccctgtttttttcctgatactttttccgtttaccttaaggtctgtgtcaacctgacagtaagctgcacgatggcaggggtcttgcctactaggttccctgtgcacagcagcccgtcaacagtagttgaataaacatcataggtcacaataaccctgggactgcctcttggggaggtagccgcaaactctcgcaggtggcagtgacaccagtacttctccggggggttgttcgagtggaggaatactcttacgtgaaagtgctcagtacaccactgcggcaggaaggaggaagggaagaattccagatggggagaaagtaatattttgcagcacagtacagggtaaactgggtccaggtgggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggtgggcgcggggctgggagtgggtaggttgtctgccagccgtcgctcgccgctcctcttcccgtctccccccttccttcaatcctgtaacctgggcggagccgccccgtcccggcctgaccaggcgcgtaggtgtggtctgcattctttgctggtgagcaggacccgccctgcaggcccgctgtgactgcccgcttgtcctgcctgcacgtctgctctagcccttggtcggcgagggctccgtggatcagatacctgggagcagcagtctgccctgtactgatctcttttgccacatttacttagaactagtcttcacttttttgggtctctaactgaagcttcccctttcgccccatttttccatcactgtctttcttgggccacattttgatttcataatagtagttgcttgaaggcagtgggggaagtgggggaattgggacactggaccaaatgtctgatcagctcatcacattgtccacatgaaatggaccgtcttcctcagttcaaaataatcaaatgatagatggagaattctgaaagttaggagctacaactatttgaaataaaactctagttacatagttgaaccgttcaaggtaggttgtttaaaagcagtttgttcacaaacagatatatacacagtagagtaaatttgttattttagcaaacgcttatttagctcatgctgatttaatgagggttcctttcatgatacttaatagttataagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgtaatcccagcactttgggaggccgaggcgggcggatcacgaggtcaggagatcgacaccatcctggctagcacggtgaaaccccatctctactaaaaatacaacaaattagccgggcgtggtggcgggtgcctgtagtcccagctactcgggaggctgaggcaggagaatggtgtgaacctgggagacggagcttgcagtgagccgagatcgcgccactgcactccagcctgggcgacagagtgagactccatctcaaaaaaaaaaaaaaaaaaaaaaaaaagtaagacttattctgctaactgaaaagtctagggatattccttccttagctttaggtatcactggagatcgtcttgcctccgtgatgcttccctcgaaagctttgttcatgtattgagagggatggctgtagtgtaataacaatcgtccgcaacactcagtatcttacagaagggagtgcttttctccttagctctggtggaagtccatgggaggctcctgggtttgtttgcacccatttatgatggtgggaaatgggctaagttaattgcccttatctgagtcatccagccggtttaatttctccttaccccatggatcaaagcaagatgagtccggactggggaagggttggttctccgaaggaaggggtactgaatagattgctcagaggaattaagaccccttggtgtcaaattttagagctacaactgttgggctgcaaggatcattagtctaatagcataagcattttttttaaagttaacctagaaatacttagccattctttagaattaacataattaaacaatttcaaggtaatttttatgtaggcatgaatagcattcagtgaggattttccattagtaatattaagaaaacatagttgtggtataatgagccctgtgataaaaatcttgttgaatatatcaaatttggttccagccctcagatttggggtcttcagaagcacttggtgcatgggttttaagctaacagacatgggaggttggtggataatggtttggatacggttctcctgtcaactttaaaacttaattcatttgttccttcctttattctttttaccagacttaaatgtgtgaactgttcctaggtagtggacctgttgtagatatagtctctttgaaactaaccatgtttctttagtcacctctgtataatcccctcctgccacattaattcaacaaatattaagtattttcactttttgggcttctagaggggttagggtaagcttggagatattactaaagtttataatggaggtaggtacaaaagttttgtaggtatatacgctgtaaaattagatgtgaatcagttgtgtgatgttcattcaaatccggcagaatatcttatttttaataattatgtttggataattgtgtaaacttaacattaattttttaacttaatgaactttttaaactaatgaactttgaaaaacagagtttaaactaattcctaaataattgaagccagcttgataagtcctgatatgcagctccatatattgctccagtgatagacttgttttcttattactaacttgtaggtgttctattaaaatttcctaaaatatacatttatgcatattataataatgagaatgagtacttaaaaactcatttgttctgggtgtggtagcatgcactcataattccagctgaggcagaaggatcactagagcccacgagttggagaccagcctgaactacatactgagacgctgtctcaaaacaaaacaaaacaacaacaacaaaaaacccttttatatgatacttcttcctttataaagtggcttttactaaaaattgattagaccttggtaaatggtgacctagggtgatcaaatgggaaccctgctggttttttatttttattttgtattttatttgaagctccagatataccatttaccagcattgtgtaatttcttttgtggtgatcagtttctttagagagaaagcttctagtcttccatgaaaaagtctgcttatcagctttctaaattttatcctggggaatggaggttggggatcttaacaatcatgtatgcagtctatcaggtacatctatttttagtatgacacctgcattagggttaggttcatttctgtgtggtagatcccaaattatctgagttaagattttattttgtaaaaagttggcaggtaggtagttctggtagcccagggctggtgtagtgtttctgtggagttaattggggctcagattcctttcagctttctgctgtttgaaacctagaatattgttctcaggtccaggttgcaatcatatccaagttccaggtagtaggatggagaaaggcacggggctcgccctttagggtgtttcctggcaactgttccacaacaccctgcctatatgttaccggccattttgtgtgtccttctgataggatgctaggaaaaggaattttcattatgagcagctgtatactcagctaaagggacacagttttgttaataaggaataggatagactgataatgatgtagtcaattagcactccctaccccacttagcagtgcttgatctccaccttagttatatttgatatctctgacatttttttcttttttcttttttttttttttgaggtggagttttgctcttgttacccaggctggagtgcagtggcatgatctcggctcaccacaacctccgcctctcgggttcaaacgattctcctgcctcagcctcctgagtagctgggatttacaggcatgaaccactctgcctggctaattttgtatttttggtagagacgggctttctccatgttggtcaggctggtctggaactcctgacctcgggtgatccacccgcctcggcctcccaaagtgctgggattacaggcgtgagccactgtgcccggccaatctctgacgtttttttgagagtgaacctaccttcagagtagaggatctgggagcctgaagttttctttgaaggattttcaaccataccttctcgttccagcctcacattgaactaccttcagaggtacctcatgtttcttaattcagatccttttctggcttctctggcatgatttggcttctgctttggctcccttccctcttagccagttagattttggctttctctttttcattcacttttcaccttttagtaaattttgttgaaacctcttatatcctgtgtgtcatttcccgttctttttgtccatgttcatgtacatcttttacatttttaaattcttgttttagtgggttttggcggggagcaaagaaggatgtttattcagatttatttgtttaactgtaagaggaacttgtttgcattttcagctctccacagtgcttgtaacaatttacattctcatcagcaggtatatgggagtactttattcttccatatccttgctaatacgtactgattaataatttaatttattgctttttgctaaactgatgggtgagagatagtacctttagtttgcattcctcttattttactgaggttgaacagtttttgtttactggccactttgtttctttttctgtgattgcttgttcttttcttttgcccattttctattgagttgttttttccttactaatttgtaggagttgtagcattttctggatatttatacttttttcattaggtatgttgcaaaaatcttccaatctgtttcttgtctctcaactgtgtttattctatcttttgtcacatggaagttctcccaaaagtgttgtcatctcataatctgtagttaacattttttttcttattcctaatgttgtgcatgtgttatgtgtgattttcctccctcagatttgccaaaggtttggagccaccttttctttgtttaaaaccaaggctttttggttggttttctgcccttgtcattcatttttttaaaaaatgttctttgttccttttttctatctttttgtattgattggttagttttccatctttttggtttttctaatatattttaggactgtgtatttttttctcagtctgtattggttgcatcctactgactttttcatttgtaaaatgaagttgatggaatactcttttaatttctgaaatattttctacatggtagtgttttatagatcagtaaagaaaatgttctgttttacttcataactgttgtttggattctcgttgttggtttggtggtgaacatactctttgcagaacttttccttgtcccacggccatgaaaatttaggcttgcaaacggtttgaagggtgagtaaagcagggttttattgggtgaaaaggaagaaaagggggaaacaggaactctcacaaagctagagtcccagttagagcacatcccgcctgcagcttgaatctcaggttccgcacaggaagaggaggggccagtctcctccctatggaatttcccaaggctccaccttagtgaacaggctggttggaatttctccagggaccccctcccacctggctgtctcaatattgagataatattagcacaatgacgttgctacaatttgttaaccaaatactaatggagagtctgtgtgaaccatactgtaggagacaatgtggaggatataaagatatacttggtccctggtctcaaggaatatctgtaattggcagacctttttggctccgtaattttattccacataggtgaataaacatatgggaagatttaaaatctgatttgtttttctgtgttttgacttttctggtgtttagtaaatcttatcaggactatcatcattctgtgtatctgtaagaagaatcttctgaggtgctttacacaggagatttaagcccacaaagctatctttatggcagaactggactaagatcctgacctcttgattccccagctagttactttttgccatactctctgctgcagtagtgcttgattaatgatttttcatgtgttaaattgggtgaagaaagaagtgtgaaaataaagttcacaaagaatctatgaactccagccaatatctctggcccagcttttctgattctcttgtttcatcctctagttggtggtctggagttgcacatccctaaatacagattgcagctgaatagggttgtgtgaattagcattgcagtattattttggccatgtggattggttgttcttgatccccacaccttccccttaaattaaaaaattcttttccggccgggtgtggtggctcatgcctgtaatcccagcactttgggaggctgaggcgggtggatcacgaggtcaggagttcgagattagcctggccaaaatggtgaaacactgtctctactaaaaatacaaaaagttagccggtcatggtggcgggtgcctgtaatcgcagctgctcgggaggctgaggcagagaattgcttgaacccggaaggtggaggttgcagtgagccgagatcacaccactgcactgtagcctgggcgacagagtgagattctgtctcaaaaaaaaaaaaaaaatttttttttcctttttaaaaattaaatatagaatttaatctttatttaaaaattttaacatttttgtttttttaagacagggccttggctcagttgctcagctgcccaggctggagtacagtggcgccacaatagcctactgcagcctcgatctcctgggctcaagcaatcctacttcaacctcccaagtgggtgcatactaccatacctggctaattattaaatttttagtagagaggaggtcttgctgtgttgtccaggctggtcttgaactcctgaactcaagcagtcctcctgtcttggcctcccaagtgctgggattacaggtgtgagccaccatacctggccaatttttttttttttttaaactagaatttctttttttgttttttgagatggagtctcactcggtcgcccaggctagagtgcagtggcgcgatcttggctcactgcaagctccacctcccaggttcacgccattctcctgcctcagcctaccatgtagctgggactacaggcgcccaccactacgcccggctaatttttttgtgtttttagtagagacggggtttcaccgtgttagccaggatggtgtcgatctcctgaccttgtgatccgcctgtctcgacctcccaaagtgctgggattacaggcgtgtgccaccgtgcccagcctaaactagaatttctaatgggaatttgtcctgtacctatttgtggtatttcaaagaaatgtatttatttcctagtttctttttccccatgagatttttaagttgagttattatatatttgtgccaaagtggttgagttttataaaatactggagaacatatataagtacttctccattgttgcaaaacagtaatctgtaactaccatttgtcatacatgtactcctgtgtgtccaggaactattttaagcacttcatatacagtaccatttattcctcacgcttaaaggaggtattattactctttaggaaaggttcagagaaattgaataattttttcatgatcacatagctaagagttgggattcaaactcagggctatctgacttgaaagactgtgacattataccttttaaatatatttgggattttatagttttggttaaaaaaattcgcttatttctaaaatagaatctatgaagacaccaatttttttgcaccattattttccacaatgtgctagtttttgccaactcctggcttagcatactggctttccctgtgcctacttatacaaaacttgcagcctaggtctactttgttagagatacatcctaggctagagtctgctgctatagtaaagtgtacttaaatgttaaagagaagggtgtggtagattctcttgtttctgtggattccctatctagagaactttgatgcttgtgatctgggctgaactatgagggataataccttgtggaattatattgaaggagtagcttatggtagttggatctcctggaacagattttgctcatggtaactgcagttagcaatggctgctttcttttgtaaagcatttgttgatctctctcattttgttggggttttctccatgctgatcagacattgttgatttccagtgattgccctcctgttgtacttttatttcaacttctataatctgtcctaagatagccattttactttgagggtttcatcacatagcttctaatcattcagttacaggatataaatgccctgttccccccatacagctcaggttttgttagttggcctcaaaaactttggggtgaagagaatgggtataaaaattttagtgcattcagtttagccattcttcttttcctcacccatttgcagaggaagtaacctcatttcctactactcccttccttgtttactttatagcaagggtcagcaaaataaggcctgctcagctgcctgtttttgtatggcctgtgagcaccactccagtgggttagcattgtgagtgttggagaactagcttagctgtttgcctctgttccattctcccctttgcttctagctcctgtcaccctggccagtggccatgctttattgctgcccagacttactgtggtgctgcctacaccagagtaaatattctgcttggcgttggcttggcactaaatggtataatctcagtctggaaattggtgactcagcaaattatctcacctacggccccctggggcaggtgcccacagtagactctccctgagaattttgatctcattggggtagagtaaaactgaccatgttggtcactcctcctgtctccctatggctcctttccatcagacaggtactttttctttggagaatgtctccaggatggcacctgggcagccgtgtgccacaattttgggatggcccaacctaggcaaaaaaggtacagggcagggcaggggtttttcctcttgttatataagtagttacatacttattatatgcttgatttagcctttttcccagcagagtctagaatatcactgttcagaaaaagtttgccagtcctggctttatagccatattggcctccttgctgtgccaagcacacctttaggcgttgttgcctcagacctttagcacttgctgttcccttcttatgggcttgttctttgatagctcctgttcattcacaaaccagaattttaggttttatttttcagagatagaagaaaactttgcattttaccgattcatttgcttggggctagcaacaaaacagagagcaaatagatctagtctttgctttcatggaatttagaatcctttgagagaaaagacaataaacataatcccaccaataatatatcacaaattgtgttaaatcctatgaagaaaatgttcagggacctgagagattataaatggaggggcaactaattttaaaaaggggttacattgactgtatttttttgagacaagatttcacgccatggcccatcctggagtacagtggtgggatcacagctcacttcagccttgacctcctgggctcaagtgatcctcccaccttatcccgctgcatagtccctttgggggactgtaggcccaccaccacacctggctgacgtgtgtatgtatgtgtaaagatgaggtctcactatgtgcccagggtggtctcaaacccctaggctcaggtgatcctcctacctcagcctcccaaagtgttgggattacaggcatgagccacagcgcctggcctagattaactttatcacttctgctgccaccgtggactccattgatccgtgctagcatcatctcttgactggattactacggtagcttcctaactgatctctctacttctgctcgtgcacacctgcagtcagttttctacacaacagtcatggtgactgtatgaaaataagtcatattgctgttttgtccaaaccttttgatgattcacactcttacactatatagtaaaactcagaagtcttacagttgcactcaaggcatcattacttctttgacttcatcacttactattttctcccttgctcactctatgatcatattggtctccttgccatgccagatacattcttaagtaccctcttgtcccagggtattggcacttgattttccctagattggaaattctcagatatctgcttggctcacctcatcacctttttcatgccttttatggtcatgctgttttagagttaaaactttttttcatgtagtcaaatgaccatgttatttaaaacgacaaccttcttacctctcctcatatattcactttattcctcttgtctctttattctccatggcacttaccactgtcttctatataatatttttgcttttttgtcttcccctctaaaagcttcacaagagcacagatttttagatgtttactgctaaattcttaatgtcctaaaactggtgcatagtaagctcttagtatatatttgttgaatgaatgaatgaggaaaactttctttgataacaatgtcagcctagacaatagtgagaaatggtggtaaaaagagtgaaggccctgagcaaggagagcctataatttagtgactcgaatgtatagtgaatatcctgagatgaggctggagagttggatgatagccatatcctgtaagaccttcaacatttttggatgtaattttaagtgtaatgggaatccaccaaagggtttcagtacttaatacttcagagtttatttcctgagtacaaagatattctcctgtataaccatagtacaactttcaaagtcaggaagttggcattgattcattattaccatttaatctgtagaattcattcaaatattgctgattttcctaatattatttacaggttcaggatctaatctagaatcatgcagtgcatttaattgttacgtctctttaatctccttcaatctggaccagttcttcagtttttctcgtctttcatgaccttgacatttttgaagagtacaggctaattactttttagaattttcctcaataaaggcttgtctcattttcttgtgatttctgcatttttgcataggagtaccagcgaagtgatgctgtgttctttctagtgcatatcaggaaaaataagatgtggatttgttctgtagtggtaatgtttatttttatcgcttggttaagatggtgtttgccaggtttcttgaccttacagttaataagcttgttgtactaattagtaaatattttgtggggagatactttgggactatgtaatatcctgtttcattacacacttttcattattttatcatttattgatgaatcttaccagaattagatattatactctgaaaggtaccaaatggtaatttttctaatttcatctagactatggtaccgtaggatagagttttccctattcacctgtttatttacctccgaatggtggtcttttcctcaatgggctcttattttttactgttattttatttagattggttcagtgcttagccattgggagccccttaaagctacctcctgtgcccttttgacatgtcctcatcattttttgagtacttccttaactttctggcatagcaagatgttttagacttgaatattgaattttttcagtctcagcccttgagtcagccatttctctaaggagcacttggctcattttaatgcaaaagattatctgggcagtaggtgtgcttattgctactgtgaagtgttactgcttataggccctcttagcatatacatttaggaaatacatagttacacatttatacttgtttttatttctctctgctacctttaaaaaatgagttaaaaactagctgggtgtggtgacatgcacctgtagtcctggcagctcaggggctaaagtgggcagattgcttgagcctgggagttcaaggttaccgtgtactgtgattgtgctactgtactgcagcctgggcaacagaatgataccctgtctgtaaacaaacaaaaaaagttcacattgatatctccagttccagtttaaaactgtggagttattctaaccttctgccttctcatgtttgtggatttttttttttttttttgagacaggttcttgcccaggctggagtacagtggcgctgtcttggcccactgcagccatgacctccagatcaagtgatcctcccacctcagcctcatgagtagctgggaccacaggtgtgcgccaccatgcctggctaatgtttgtatttttagtagagacagggttttgctgtgtttcctaggctggtctcgaactctgggctcaagtgatccacctgcctcagcctcccagagtgctaggattacaggcgtgatctgctgtgcctggccctttcaggtatttgtatctctgaccttgggaaacttggcttccattatcttcaatgtatttacttaattggatagtttttcctgtttataaccaaactcatagccatgccagccaaaagcttggtctcagatatgttgcccactcctgctgaaaatttgcccccagaaataatcattacaaaaatacccctgatgaaggggtgggggaagtataagggaaaaaggaaaggaggaaagattagaggccagttagaaagcttggcctgacccttttctcctcctttccctgccagacttgctgactgacagctcaccctgatggggggaagtctgctttatattttgtgatcattctggctgctatgcagaaaacaggtcggaaagaatgagaaaggagatggagaggttgtctaggaaacttttggatttctagctgaaagacagtggtagctttgatgtgctgtgtggcagtgctggagacagatagagatgggcttacccaaaacatttaaaagtcggtaaacctgtttttaattggcagtttaccagagatactaatttgtctaatggatacaaacttatttattttagtaagaaatagtatttttaagaaatattttggttttcagagcagatgttagtttgcttttagccaataacagttgataaatatttttctgtggtggtgggtatgactttttgttcatagtttttcactgcatatattttttaagcttctggtttacgtattaaaaaactttttttcatataaaatagctgctcaaagtaagcatgaataatttttgtatcattttaaaccagttgtaattacataaatgcatgtaatatttagctctggtaattattaattctgctctattttttagatattatgatcagatttgttctattgaacccaaattcccattttctgaaaatcaggtaagtcattaattctgtcttaaaattatatggtaatagcacccatttccttctgccaatatcttcactgtctttagagttttatgagatagtgttataaaaataggagcttttagatctgtctaatgcgaatatatgtgcttctgaagaaagaatctcctggaattctgttcatgtcattcttcagtcacttctggggctcatgtagagcaatggtttgtttttctttggacttcattttatgtcagtaggatctgttgactgattaatctgctgtgtcctttcctttgactttttcagaattaggaaggaaactgcacaattcaggaattattagtctcagtttatgtgctttaaaaattattcgcacaagttacatttgcatgtaaaagttgcaaatgctgttttgattaaatgttaattacatgaatgtcaactattttctccttaaaggctagatgttgaaaatgctgataatttcttatagttttattttggagattggataaagattttaaaattagtgatacttttaaattttaaaatagttataagaaaagtactttaaacattcttgtactaaagtttttacaggtgaaataattatatgttgagatttcctttaatatattcctggaaaaaaagtgtaggtggctggaggcagggcaaattgggaggtagatgaaccaagaagggcaaaagactaaagctgctgatggatgtactggagttcattctctttattctctttagtttttctgtatgtttgaaaatttccctaatcaagagtttagaaatttttgtattagattgcaataaataatttaaatgaggtttatttctttctaatctttgtatgtgataatacatatttcaggagcagagagagagttttttaataaacatttaattttcatgtagcatatggaaaagtgaacaaatcacgggtatagcttgaatcttacaaagtgaatatgtctgtataaccaccacctagataaataaataaaatattaacctattccccaaaataaccattctcctacttttgtcatcatggaatagtttttaatttcatcttctaggaaacctgtagtacttacttttatttcccttgcttcacttagcttatttgacaaggatctactacttattttgttccgttgaagtcattgtgtgtttataaagatgaataagatagtgtttatgattaccaaggcagaatgaccatttgaaatatcccagtgccagtattttactttttttagatttcaatttaaaaggagaaggaaaggaagttgggtggttataggagataatattttgagcttttgtcctttttttcatggtggatttttcttcaaagaagacttaatatttaatgagattcaggaaggttacctaattttctgttttctttcattctatccagatctgcttgacatttacctggaaggatgctttcgataaaggttcactttttggaggctctgtaaaactgggtatgtaatttttaataaaagtgataggaaaattggtctaactactttgcattgtttttagtttttaaaattgttatcctaatgactctttgtaaatactaaagttttttacatttcattctctttttagcttcaacttttaatgcaattttgaaatatttgtagagagcccatgccttgccaggcactgtcctagttataaaaatgaataaaaccgatgtacttagtttttgggaagatagttgatcatttaaaagtgtaatatgtaatagcctatgaacaaactcatggaagcatatatgaggaagaaagtaattctaccttttgaaagcagacaatgtttgagttaggccttgaaggatggatttgtagaaaataatattacagatacaaaatcataaccataggtcagaagggtgaggacatttgatctaccagctccagcaagataacctctctgtgccttaattttcttatctgtgaaatggagataatactatttctctcattggattctttttttttttttttttgagacagagttttgctcttgttgcccaggatggagtgcagtggcacgatcttggctcactgcaacctctgcctactgggttcaagtgattctcctattcttctacctcagctgggattacaagcacccgccaccacacctgggtaatttttttagtagagacggggtttcaccatgttggccaggctggtctcaaactcccgacctcaggtgatccacccatctcggcctcccaaagtgctgggattacaggtgtgagcccctggcctattccattagattcttatgtggattaaatgagtgaatacatgtaaagtcctaagaacagtgctttattagctgcaatgaataattatattattatataacattgtaatgtatatgtgatatatgtatatttcatgtatatatgtatatttcatgtatattatatgtatatatgtattatatatgcacatataatgtgtattatatgtgcatatataatgtgtattatatatgcatgtatgtatatatgtgtatataatgtgtattatatatatgtatgtatatatgtaagtatataatgtattatatacatatatgtatatatacttacatatacacacatatatagtatatttgtatacatatatacatttatgtgtatgtatagtatatataatatgtatactatatgcatgtattattcatatacatatatgtatatacatatatacatatatattcatgtacacatatacatatatgtatatattatatataagaaatatgtatatatacacatgcattatatataagtatgtataatatgccttatggtatatcctttttatagtatacatatacattaagatatgctataatatatactatataccttctaagatatagatgtataatatgtattatatagtatgtgcataccatatacatacatgtatctatatatcttatataaggtttatacttatatataggtgaggaaatggaaatatatattttatagtagatattatatataatgttaatttaataataattattgttatggcttgtaaccataggttgaattggggattatggagggtgatgatattagaaagcagattgtggagagttgcaaatattatgctcctgactttgtacttttccctcttatataataatagtgcatgtttattgggcatttattttacccaggtactctggaagggacttcataaatagtcttactgaattctccaatagcttaatgaggaaaaggcactattattgccagttgaacaaactggtttagaaagattacgtgattttctgaagtcatatggttaggatttaatgaagctgggatatgaatctagaaggcctaactcccgggactagagagaaacagaccagtgaggagactgatgagagatgatgaggttagacaagctagtgtgtgcaagttacagaagagagggatttcagacttttcagaggtgaagttgactgaatttgctgactaccagtcagaaggaagagtaagagttgaggcttgactctgagatttaataagttggtttgacctgttggatatttattcctctttagtagaaaggttgactctgatttttctgtgttatgtctgggtagacatttctctggcattttgaaataaaggatttaaagctcagaagagaaagatatacattcgggaacaattattaggtgataataaatttattccttctggcagataattgactgagaaaagtatcaaagtcagagctaagtaatataacattcaggggaaatagaggaagaggttctgggaatgaggttgagaaaaagctttcatatcttacaggaaccagggtaaaatagagatgtgaaggaatgccagaagagtttcaaaggtgatgtggtccagtggttcccaaacctggctgcgtattagtattacctgggaaaaatgttaaaggtttatctttaaagatgaagatacagagtgccagatgtgataggagaaagttttggagtagggcactggaattagtatctttggaaatatctccgggtggccgggtgcggtggctcacgcctgtaatcccagcagtttgggaggccgaggtgggtggatcacgaggtcaggagtttgagattatcctgaccaacatggtgaaatcctgtctctactaaaaatacaaaattagccaggtatagtggcgcacgccttgtaatcccagctactcaggaggctgaggcaggagactcacttgaacctgagaggcagaggttgcagtgagctgagattgtgccattgcactccagcctgggtgacagagcaagattctgtctaaaaaaaaaaaaaaaaaaaaaaaaagaaaatatctccaggtgattctgatgatcatcccaggtccaggctggaacatccttgacagagtcattgtggcagaactcaagtcatgtaaggttggagaagtcactggatttagcagagagaagtttctcttggagtatcctgaataagcatcagattgaggggtgaatgggaggtgagggaatggaaacagtaaatgtgggttgctcatttcaggaaatctacagtaaagatttggggacaaagggagcatcattctgagagggagccaaggtgcagaaaaggatttttagtattgttatgacttaagaaatttggtaggctgagaataaggagcagatggcaggagaactaggagacacttgagtgatgaactcaagtatccagaagaactgggaagcaaaaaattagatcataaacaggaggtggttcatcaaggcatttctagtagcaaaaattggtaattaaatgtccttcagtaatgtcttggttaaataaaaggctactcattcatttgaatattgtgtacttttggaatactaagaataaaaatgcatatatgtatttgttgatatgtaaagttatatcaatggaatattgaataaaaggcctgccttagttcagagttgttgcattgtacaactctagggtccccggaattgggctccttgggacactcctcatacagaactcagagtaattcctcctccctcgagttgtgcactccaggcaactcgagtgtggtatagtatccactttgtgaaaagttatgtgtgtgaatgtttatgtagttatttgtgagataccaaaaaataaattctggttaactctggaagatgagatgttgggtgatttttaattatttttttgtagtttagaaaaattgtttgaattttagaaagctgttattttcatgagttattttcgttttgaaaaacttagaggctggaagtggtggctcgtgcctgtaatcccagtacttggggaggccaagacaggtggatcacttgagcccaggagtacaagaccagcttggggaacagacgaaactctgtctctacaaaaaataaaaaaattagccagacatggtggtgtgtgcctgtagtcctagctgtttagggggttgaggtgagaggattgcttgagcctgggaggttgaggctgcaataagccatgatcacgccactgtacttcagcctgggtgacagagtgacaccttgtctcaaaagaaaaaaaaaagataaaagaaaaacttaaaagagagcaagtaagaaacaagaatacagttaaatacttagaaaggcatctttgaaaaaaaggaaaattaaatattgttttgaaaacctggtttaagtttagatggatagaaaaaaataaaggaaaaaaagataaaatagctcttatatgtaaaatctcataaaagctcttatacatgacaaattgtcaaaataaaatgagagactacagtctggtatgataatatttatgggcaacataatagactgagatatgtatccaatatataaacagtttacttttatttcttgtttggaatatatttcattcttgttttttttttttttttttttttttggagaacagtcttgctctgttgcccagggtggatggagggcagtggcatgatctcggcttactgcaacctctgcctctgaggttcaagtgattctcgtgccacagcctcctgagtagctgggattacaagcatgcaccaccacgcctggcgaatttttgtatttttagtagagacggggtttcaccatgttggccaggctggtctcgaactcctgacctcaagagctccgcccaccttgccttcccaaagtgctgggattacaggtgtgagccaccacgcctggctgatatttaattttgttccttgctctctcctgccacactggcctaatgtatatatttattgaattaattaaaattatattcagaacttgaagatattgatcccttgcttttttttttttttttttttttttgatagggagtctcactctgacgctaggctggagtgcagtggcacgatctcggctcactgcaacctccgcctccaaggttcaagcgattatcctgcgtcagctttccgagtagctgggactacaggtgtgcgccaccacgtccagctaatttttgtacttttaatagagacagggtttcaccatgttggccagaatggtcttgttctcttgacctcgtgatctgtccgcctcagcctcccaaagtgctgagattacaggcgtgagccactgcacctggccaatcccttgccttttagtatctagtgttactgatgaaaagtctgatttttgttattttataagtgatctgtttctttgctcttgggaatatttttacagtcttctctttatctttcatgtttagaaatctcaaaagacttaatgggatttcattttattcgtgtgtagggcatttctttttggcccttttagtttgaacacttatatctcccttaagctctgggaagttttcttatatttctttgataattttcttgtctcttttgtctctctttctttggaatactttattagatgttggttgttctgagttgttcactcgtaatttttatattttttcttgactttctgttctttctgagattgcctagatattaattttaaaacttgaaaaaaaattttttttccttcctccgcccttaaaacttttgaaaaaaatttaacaatcaagtttttaatttttaggagctttgtcttattaatttaaaaaatccttttcttttatggatgtactgtctttgaatctctttaaggaatgctaattgtgatatttggaatataatcttttatgactggaattgtctttatttattttgggcttagtttttcagttcgcattgctcttcctttattttgctgcaggcttttttcacaacctggttattttggattttccatatgtttaataaagtaggttagagtagctggtgtttatgtctgctttagtttagaatgaggagactagaactggtttggaagcaagttgaaaactggcctttattacctaggaggccaccaaagtactgtaacaaggagggctttactttatggtacaactctgtggcacaaacatacaaatgtagtgttgttctgattctcctagattggtttgttcagtgttttttgtaaggagccttattttgcctagtggtcaatgccttgcacattatgcaagatcttgaattccaaactgattgaattctgtgagtaatagggagctattgtagattcttttttaaaagttatttttcaattgtgatacaatatacacaatatgccttcttaaccattttaagtgtacacttcagtggtattaagtacatttacattattgtgcaaacatcatctcgagaactctttttcatcttacaaaacaaactctgcccagtaaatgataacttcacagactgggggcggtggcttatgcctgtaatcccagcattttgggaggccgaggtgggaggattgcttgaaccaacgagttcaagaccagcctaggcaacatagtgagtccctgtctctacaaaagatacaaaaattagccgggtatggtggcctgtgcctgtagtcccagctactcaggaggctgaggcaggaggattgattgagtccaagaggtagaggctgcaatgggtgtgattgcactagtgcactccagcctgggtgagagaatgagaccctgtctcaaaagaaaaaaacaattataatgtcccattcttccctcccccctcaacccttggcaactagcattctttcagtctctgaattaaactgtaggtacctcatacaagtagagtcgtagactgcatttaaaaaaaatttcacaacatgaaatttattatcttaatcatttttaagtatacagttcactagtgttgggtgtatttcatattgttgtaaaatacatctccagaactttttcatctagcaaatctgaaatattgtactaattgaacaacaatccccctccccctaccaccatccctgataaccatcattctgatttctgtctctatgaatttgattactctaggtaactcatataagtggaatcatacaatatttgtctttttgtgactgacatttcatttagcttaatgtcctcaagattcatccgtgttatagcatatgatttccttcttgttcaaggctcactaatattccattgtatgtatataccacattttgtttatatattcatcagatcacagacacttgggttgctttcatgtttggctttgtgaataatgctgctatgaacatgggcatacgtatatctctttgagactctgctttcatttttttgggggtgtatactcaaaagtggaattgctggataaaatagcaattctatttttaatattttgaggacctgccatattgttttccacagcagttgtactttttctaatttttattttttattttgagacagggtcttgctctgacgctcagggtgaagtgtagtggcatgatcatagctcactgcagccttgaactcctgggccctagtggtcctcccgcctccgagtagctaggactatagacatgcaccaccatacctggctgtttaaaaacaattttttttttttttgttgagatggggtcttgctgtgttgctcaggctgacctcaaactcttggcttcaagagatcctcctgcctcagcctactaaagtgctgagattacaggagtgagccaccatgcccaaccacgagtttgcgttcctgccaacagtacaggaaagttccagtttgtctatatcttcatcaatgcttattttctgtttgttttttaataggagctatcctaagtggatgtgaggtgtgtagattttttttttttaatcagagttgggttttagcccagctaacctgctagccctttgagaaatgtatttgcatgagggagtaaagcataaggccagctaggaggtaattgcattgacttagatttgtggtaatgaggaattggtttgattgtggtgggacaatgtgattttgagaggtgacagaaaaatggaaataatttattcaaatttaagaaactgagagaaatgacatgaaaatgacttttacatttgaatttgattgtaatagaaatgtggaagtaaagggaaggagagaaagaataacttactgttcttcagcgttttgggtgatgggaatattgttgtggaaataaatgcctgtaagggcagcttgaaatatgggagcatatgacagcaagaaaacaggtctggaaacttgtttttgtgagagtcagcgggatgagagaggtcatagtatttctctttgaaacatttgttttctttagaaaaaataatctgatgaatttttccttctcaattttttacagctcttgcaagcttaggatatgaaaagagctgtgtgttgttcaattgtgcagccttagctagccaaattgcagcagaacagaacctggataatgatgaaggattgaaaatcgctgctaaacattaccaggtatgctgaaaagtagttactacaataatggtcaacactaaattggattaagtggaaaataatttgcatttaggtttatagatacttcttacgcaacagatgttttctaaaacgaatgcacttttaaaatgaatttattcttactgttaaagcccttagataaactgtctatagaccaggtctgttattcctcattgttttataccgagcacctagcacagtgcctggcacataatagaggctcaataattgttggttgaagaaattatgaaatgtctgagatttcatctcaggcatttagggtaaatccattttaaataaattacctaattaaaaaaaatttgtacattattttcatatgttttcttagagtgagacacacttgaaatttcactgttgttacaaaaataaagacaagaaattggcaagaaaataaaattttaactttgagacttgtggagaggtcatatttaaatatggtcagacacataatgttcataagttgcctaatctgttttacgtactgatcatttactaatatggcatgttattttgtggcagtttattttattttatttatttatttattttgagacggagtcttgttctgttgcccaggctggagtgcagtggcacaatctcggctcactgcaagctccgcctcctgggttcacgccattctcctgtctcagcctcctgaatagctaggactataggcatccgccacctcgcctggctaattttttttgtatttttagtagagatggggtttcactgtgttagccaggatggtcttgatctcctgacatcatgatccacccacctcggcctcccaaagtgctgggattacagatgtgagccaccatgcccggccagcagttgtttattatttattcagcttttttttgttttggttaaaagaacagtaaatgattactgttaaataatatatatataatcatgttgtcattttatattactttctaatttacaaagtgttttcatgtacattatttgactctcagataaaccttgtgatgtatgtcatataatgtcattccgattttacatacgaggaggctaaaggtccgaagtcttaataaagcagtctatttgggtttcaatagttctgattccaaatttcatgtaattccaaatgtccttccactgtttcactcccaaacctcccatgaaatttgcttgtctcagaggtagtctgctttttcccgttgtttatgtttagggaagaggtgagtgatgctgttctgagaaagtaaaaggaaaatataccgtaagcaaacaacacgctccaaattgtggcttgccttacagttttgaatgggcatagatgacaaacataatgcatacgctatttctttttgaggctatacatggcaaatattttaaaatgtgaaaacgagctgggcgtggtggctcacgcctgtaatcccagcactgtgggaggctgtggtgtgcggatcacgaggtcaggagttccagaccagcctggccaacatggtgaaaccctgtctgtactaaaaatagaaaaattagctgggtgtgatggtgggcgcctgtagtctgagctactcgggaggctgaggcaggagaatctcttgaaccgaggaggcggaggttgcagagagctgaggttgtgccattgcactctagtctgggcgacaagagcaagactctgtctcaaaataaataaaataaaatacagtagtgaaaacgaagtaaaattttatttagcttttggttaactgtaactcagttagttagtatatgagattttagaaaggtcattctgaattatgaaagaaacattccattctgtgagggttcacagcagggcacctggtatcatggaaagataactggtggtattagacctaggtccttgtctaggctgcttgccacccagaagctttgtgccgttgggcaagttctttaacctctctagtacctccagttccttatctgtaaatgagagactcagacactttgctgttgtagactttgattcactagtttactgaacaagttcagttgttcattcctagcagatactctagtgttataatacttactgactgcagaaacatgctgttcattttaatacatttgactttgagttttctctgtgttgtctatttatctaactcatgacacctttttttttttttcttttttgagatggagtctcgctctgttgcccaggcaggagtacaatggcgtgatcttggctcactgcaacctccgcctcctgggttcaagtgattctcctgcctcagcctcccgagcagctgggattacaagtgtgtgccatcatgcccagctaatttttgtatttttagtagagacggggtttcatcatgttggccaggctggtcttgaactcctgacctcaggtaatctgcccacctcagcctcccaaagtgccgggattaacaggcgtgagccaccgcacccggccaactcatgacaccttttaatcccagactgatttatttctttttcttagtataatttgtttcatgaaagcaaagttattttagtattaacaaaatataattgagatgaaaaatctgatggggaacatttcactagtgagctctgaaggccagacagaaatcactggcaatgggtagtaatgctgttcctcagaggactaggtgtatgtactacctggggtgtcccctaactacggcatgtttaattatttgaaagatgaatttgtttgggaccaaagcaagagcattgcagtactaaaaatattttaatgtttatccccgcctctattctcatgttaattttgaggaagtatatctaaaaatagtttaatcagattgttccattagtttactttgtttttccttgtaatttacttttaatctttgttaaatctcttgttacgctatagagttttagaaagataaccttattgtctgtaggtcagatgttttagattggttttgcataatataaaaatttaaatatattaactgttcactgagttaacatttgaaatgacttttatatgtaacagtaggaaattaagtcttgctgagttcctataaagaaattctttttcccccctttagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagaggtaactccaatttatctttttgttgcatgtgaaaaaaagtgataaggcttttaaattaagaaagtgattagaatataatatgttcaatgtcgagctgtccttcttgaacttgatacatgaattatggaaaattttcagctatccttttctgaatttgtggcacaaatttacatttaagaatgtaggctgtgtttgaagtcatgaaatagatctttagtaattgtctttaaacactccattctggaatagtatttatgtatgtttttaacatgtcagacatttattcgcaaatatttattggatacttactctgtgccagtcactgttctagtttctagataaacggagttagaaaacaacttaggttttggcgacgggagagatgataagcaagaattaagtagacaggataatttcataaataattgctataagatttcagaaataattgctataaaaaataagagaattatatgatagtggctggtggtatggttatgggatagggatataggggaagctgggctaattttagattcattagtcaagaaggctttctttcaggaggtcctctttaaagtagacctaaatgacaagaaggagtcatccaggcacagtccctagccctgggaatgagggaataagaataattcttataaggcatataagttagcatgagagattgaaaatgggctgaatatgtaatatgggctgaaactgaaaataagagataagtcatcatgtggaagaaataggaattggaatacttttttcttttaaaataacagcttatattgagatagaatttatatacactcaagttcaccctttctaagtatacaacataagatttttagtatattcatagagttttgattaccactatcttattttagaacattaccatcatcccagaaagaagccatgtacccattagcagtcactcctcactcccctttcccccactgctggcaaccactaatctattttgtctgttctaaattttgtgcagaaaatgtgatttcatcaagaaagatgttttcagatgcgtgtacaaacttgtgacctcagtgtttatactgagacatgtcagattagctcatatttattttaattataatggtcatattgtattccagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaaatatttagacttttttgtgtataagaagcaagttgaaacttataaagaaatttgaagttttaatagagttatctgaagtatatagtagaaatagtttttttttttttttaatttaagatgcatgaacaattcttttatgtttaggggatgcctttgtctttaccttttactaaacttgtttttccaagctagaactctttctggaaaatgttgaccatctgttttcaatacttttatcaaatcaaggcattgtgtagttctgaatcattggtgatttggtacaagcatgtatacttgagcatgttgatgattcacacttttaattattgtcctgttttcttaaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattgagtgaaatatatgtttcaactacttccttcagaaatgttcaaggaattagtttcatcatatggtatctgttacatgattttttttggtaggggaatttattgatttgtaagtcatattcaggaatctttgtacattaaaaaattgcagacaacttgggggtgaagtaaaaatgcacataagtgcattaacagtacttattactcagaaaatgatcaataaggaattaatgtgacgattcctggggatttaagatacaccaagagcctagtagaaatttgcccaggattcttgggtattaacagccttcctcttaaaaagagacttgggatctcctctcatgtttttttcatctgaaagacctcatgttcagctgcacagtgttccgttacatcctgttgggccattagttcagtcctgtcatggagagaagaaagtcacctacaaagacttggaagctacctctgcagcattcctggtattccttgaaaatctcctgtttcagaaccaagttgctccagccttaccttgagaactggcatgagtgtagtttgaaatttagatgtcttttattttttcctttttactaataaagctcataaggtattttcatattctagttataaaactgaaaagtctgcaagtagtgatccaggaaggtaggaaattattccctgggagacaggaaagcacacaaggtagtaattcagtttttgattctcttacattttttgtttagatagtgattgtctagcctaattccttggatttttttaatatcatatacttcctaaaagcagtgaggttacaggttagattttgacgttttggaagagccaccactagtataattgctttcctgctttatgtctttggatcttttgaaattaattttgactggaattattttcaaaacaaataggcaaaataacactttatcattatcattggtcatatacttagtgcatttgtctatgatatgtttttgagtatatgacactgaaatattagtgtatctatgatactaaatcatttttatatggctaaaatcatcttcagtaagaactctcttaggatatgaatttaagtgaaaatttactgtcttttttttaaaacatgatgaaacagtaatctatagagcaatttcattagtatatgtgagtaatgatggtttagttaactctacaggctgggtaagggctcataagaaagcttctaaagctctgtgctttgtgttcctctgtgaatgtccattctacttctctttctaataatgcatgcttttctttttgtaaacaaaatgttgacttcatggatcaattaaagagaattgtaaaaacctaaattggcttcagttaacagttaaaaaaaaccccttcaattggaagaaaaaaaatttaattcatagatttcaatccacacaaaatcatgtcgtcttctctgtttacacctaatgactaaccttaatctctaaaccattaatggggtgattctaatttctgtcttcttttcctttttcttcctgcatcccatgttgtctgtggtggtttgtgtggttggactctcccctggtcagtatttttatttccaggaggtgttccctgtcttggctgcaaagcactgtatcatgcaggccaatgctgagtaccatcagtctatcctggcaaaacagcagaagaaatttggagaagaaattgcaaggttacaggtgagtctcttggtaataaatatttaagtaactaacttggatctctcttttttttcctagtgagatttccaagtttgcccataaaaacctttcccgttcatcacccctatcagcagggacaagtgattgtttttatctttagactttactgcatgtttttttgaggtctcatattttatctaaaaaatagatgcaaaatttgcattcaattctcttttttatccatgtttattttaatgtaaaaataattctaaattaattgccatctccagattgtttttgtctttagactttactgcatggttttttgaggtctcatattttatctgaaaaattcatgcagaatttgcattcagttctcttttttggtcatgtttattttagtgtaaaaataattctaaattaattgccatgctccaggagtatgtgtagtgtttaacttgtggcctggtctttgtctaaactggggcatatacttccacaacttgaggacgacagtggagagatgtgtgtgcatatatatatatatacacacatatatctcttgtgaacagcagagtaccttctatgcagttgtgttcatactgttggcattggggttgtcagaaacttgctgtgacattatggcacctgaggcaacttgccagcaggagcaagagctgtttgtatgagttgtttgtgttttgagtattggtagacagaggatagaaagatgacttatggcatttgagttagggaagtttaaatatgtactgatttttagaagatactatggatgtcttggttcattttgtgctgttatagcagaataccacagactgggtaattgataaagaacagaaatttgtcacaattctgaaggctgagaagtcgaatatcaaggtgctggcatctggtgagggcctttgtgttgtgttacctgtggtgaaaggtagaaaggcaagagagtgctagtgagtgagagagagcaagagggagccaaactgctcaatgaagcccctctcttggtaactaaccctctcccatgataatgacattaatctattcatgagggcagagccctcttgacctaatcacctcttattatgcccccacgtcccaacactttgggattgggaacacatgaactttgggggacacattcagaccataacaatggaaatgttgtttaggaggttcagattaattaattagccttttcatgggaaaggatctcacagtgaccaaatcagagaaagtctttttaaaaaagtcagacccagatgtgtctggggcttcactttgattacagtaacttagatttatatataaaaatgattctgaacaaggaatttgtgggaaggattctttttttaaggctagcatatttaaattgtaagtttagtttctttattttctggtttctgggactattagatttaagtaagcccatatttagtctctataaatcagtcagagaaagaactccttttgaaatttaatctcatttttaagtacccctgaaaaaggaaactatttcagattcacacaatgggagggaggtaaatacttttcctcagttatagacacatagattttgcagctttagttttacagctttagttataggttaaagttaagacagaagttgggtgtgatggcacctgcctgtagtccagctacttgggaggttgaggtgggaggatcgtttgaagctagtagtttgaggccagcctggacaatatagtgacaccccttctcaaaaaaaagttaacacagaacacactcactgatccatatttcagaggacagttattctttccggtaggcatgaaatattttttaattgatttgcactcccaagaagacaaacagaacagacaagaagttgaccaataaaccatattcgctgtagtttctcacttagtagagaataataccccatgattctgacggagatcttaggaggtcacactattaaaccaactttctagttatggctactagcaaagagaaataacttattggtcctgtgcaaaccagaaatgaaaataaaatcacaatcaggaaaatcaaaacaatagataaaatggcagcaaaggtaaaataactgcttggaatcaatcacttctggggccaagaaaaattgtacctgagcttaatacagctcatgagttgcacttcttgaacagtgcagtttatgtggccccagaagatggatcttcttggtcatcttggtggatcttcaaagatgatgaaatacagttttcaaaaagatacagaaacacacacacacacacacacagatataaaaacatgactcacatagaatgactacatgtcaaagatttatttgactcattaatgagggacctagcaagattgtaaatctgattttgtgcaagtattgttttcttagttatggtactaggttgtaggtattaaggagattgtcattatagaatacttgctgatgtgtttagggatgagggcttataacatctaacttcagtttcatgtagttctgcaataaaagaaaaaatagtacttaattatgtgtttgtatgggaaaggaatagataaagcaaatgtggcaaaatggtaattgttgaacctagctaattattttgtgggcttgaaatttttcaaaattgggaaaataggtatatataaggttatatagttcaattcctgttcctctttttccctctatcctgttccctccatccattattcctactgccccatagttaatttccattaatttcttgttttttttctttctttgaaatagaagcaaatatatacatagacagcacacacacacacacacattgcacattctcacttgtcattcttactgaagtggtagtatgctattaatatatacagtgttgtgtaccttcttttctcatataacaatgtatcctgaagatctcttcatcttaattcagcaacagggagaccatccttagagctgcattgtacttcactgtgtaagccacagtttattgctgtctcctgttgctggatacttgaatgtttccaagatttcactgttataaacaatgctacagtaaaaaatcacgtacacaagttatcttgtacttcagcaggtgtcttagcttaggctgccataagaacaccataaactgggtggtttaaacaacagaaatttattttctgatagttctggagcctggaaatccaaggtcagggtgccagtatggtcatattctggtgagatttacagatggccttctctctgtgtcctcatatggtgaacagcaggaggaagccctctggtgtctcttcttgtacgggaactaatcccctatgaggccccaccttcatgacctcatctaaaccccattattttccaaaggtcccatgttcaaataccatcacattaggagttagggattcaaaatacgaaatttggggagcacagtcccgtacatagcagcaggtatatcttaaataaattaatagaaatgggattgccaatagcaaaatataaatatgtctgtaatttgttacatatttggattgttgatccacttggaatttatcctgatgtgtggtgctagatatggatccagtttttaaagtcttcttccaaatggctagcccattgtccccaaaccatttattttataatagccttgtttacctcactgatctgacattctgactttatcacacattagattcacggtatatattgggatctatttctgcttttattgtttcattgacttgtttatctgttcatactccagttccatatcattttagttatttatacttgagactgttttaatgtctgataggtattatctctcattttttgaatttttctgcctgtccttgcttgtttcctaaattttgtcattttctgggttttcctgactattcttgcatgtgtttcttcatatgaattttcttttgtttaactatgatggaaaacatatataaaagtgtagttgtgtaactatgatggtcaaacatatataaaagtatgaatcattgaacttctgttacccaacttaagtgattatcagtatttcgctattttgtgttttagttatttctcctttcctcatttttttggagtattttacaactatctcacgtatcatttcattcttaagttttttagcctgtgtctctaagagataaagatttaaaaaaattaaaaaacaaaaatttaaaaaattaagaaattttgctagatgggtcattatcccaatctagcaaaattaatattaatattaattagtagttaatagtcataatccagtattatccacatctagtttagttttccctgatttttttctcaggggtcttggtttgttcaaatcaggatccacacaaagtcctcactttgcatttgattgatatgccctctaaatctttaatttgtaacagcctcctccttcccaacttctgtgttgttttcttcactttttcttgttctgtatgttttttactatgatttctgtgatgtctgttttcccttttgctccttgtataaatgtctcagtcttgctttcttaaataaatttgtatttttctttacttttgtgagttctgtcacttcctgtttcatattcttttgctatttggctatcactcactctggtttgggccatccagtcctctgttcttttggtactgtcattgtgttcttaagtgttttagtttagtttagtttttagcatgctgttttcatctgctttgcggcaatatttctttggtgagctttcattatctactggaaagatatactgcttgttttcagttttttccttatggtttttttgtattgagagatgagttgacttttcagttacttaggtttgaatgagattgattttgctgggggttcctgtgcagggaaatgggcaggggttagctttacaagcatcattgtgttaagggctccctcctaaggtccacttctctggctcttaaagcctaccctggattaggaagaatcccactacctctgtacctgtgcttccctgaattcctcacagcctttgcatttcaagttgatgcatctacttttagggtttatattttgctggcattttctgagtgcttatgccctttcttctccctccctacttttctgttctctctttctgctccccctagcaaccctgtctttttagttaatctgtctacttctttttctcaccagctctcttgggatgaggcccctcagcatcacatttttttctgtggtcccctggtggcatgataggggccagttggctttgcctttaccgtcacctggcaaggttttctcatcctgttttgttgttttcagatttgcttaaagtaattttaacttagggtggcacccttagcacttccctttcttccccctctgtgtatagcgtacctacggttctggtactagtgtttgctatttgggggagggttcaaccacatttacaaatcaaatttgatttacaaatttaaaaagtgatttaaatttgtgcaatttcccgtttcctagtttacactgaagggtagcttttgttttgttttggttatctttctctaagcatgataccagctttggaggttaagatttttatcatgttaaggaactataatttctattttacgaagattttaaaaaatcaagaatattgaattttatcaaatactttttcaacatctatggagaaatttgattttttaacttattattttggagaattatataagtagattttctagtattaaaccatttttgtattcttgttattttggtgttttagacttgccttatctcttcatctggtcattttatagatgtagatgctttctatatgcctgagaatataatgtgttctctatttgtggagtctagtgttctctatgtctggtaaaccaaactcgttaattgtgttgctcaaatcttctataatcttacacttttttttaatctggtccagccattgctgagacagatatgttaaaatcttccactttgattatgggtaaatgtgtcaatttctcattataattgtttatatagatactattacatgcaaaatataagaaattttacatctttctggcaaattggcaaatattaaaagattatgtattatatttatccctaataatgctttttattttatatggtgtcactatatctaataccacctaaatttgtatgcggcttatgttcatttttttataaggccaaacttaaaaaaaaattcttattgatgttgacatgttgttcacttcctgtgttgttggataatttttttcagatccaccctttcactgagagttaggccgtttgaggttcctgccttcatgtgaaggagtgaaagaggtgcatctcaattctctgtgttgtgtggtttccagacccttgtttcagttctccatgagggcctttaataagttttaattgctaattctttggatgtagaaataacccaacagccagacagggcacagtggcgcaagcctgtaatcccagcactttgggaagctgagttgggcagatcacttaagatcaggagttggagactggcctggccaatatgatgaaacccgatgtctaccaaaacatacaaaaattagcttggtgtgggggtgcacgcttgtaattccagcttcttggaaggctgaagtgggagaattgcttgaacctgggaggtggaggtcacagtgagccgagatcgcgccactgtgctccagcctgggcgtcacagagtgagactctgtctaaaaaaaaagaaggaaaaaaagaaagaacccaacagccagctttcttcaatgtcagtttatactgatgggctcatggatttcttttattatcttgataatctgcctgtgtgtttatagagatagctgttatgtattatccttcagttttcgggtattttgtgatcggagaatttccaggtaaccctgtcagccacattgctggaaatgcaagtcttcagattaaagattttttttttgaaaccaatgcttaaatacttggtggggaaagagaaataaaatcacctccctcttttttttttttgttgttgacgtttttctttttagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactggtatgtcagttattcagacacactttaatctcatttttctctagtttactctgtttttcctagctaaaaatcacataattgctgttgtatgctttgaatataatttgtattcatgttgtttaaaatgaatatgagaataaatattgtgccagtgcaatgttaagatggaaagtaaacaataataaagcatatgtaaagtatacaatagttagaagacttgaaactgtgtgtttgattaagactgtagcacttgtcattttgttaacttttgttatttaagatgctgccattaaaaataaacaaatatggctggatgtggtggctcacacctgtaatcctagcactttgggaggctgagatgggtagattgcttgagctcaggagttagagaccagcctgagcaactggcaaaaccctgtctctaccaaaaaaaaaaaaaaaaattaactgggcatggtggtgcatgcctgtggctttagctactctggaggctgaggtgggaggctcgcttgagcccaggaggtggaggttgcagtgagctgagaccgtgccaccatactccagcctgggtgacagagagagatcttttctcaaaaataaataaataaataaataaaataaatataaaaataaaccacaaaaatatatatttttttcttttcttttttttttgagacggagtatcgctcttgttgcccaggctggagtgcaatggtgctgtctccctcactgcaacctctgcctcctgggttcaagtgattctcctgcctcagcctcccaagtagctgggactacaggcgcctgccacctcgcccagctagttttgtatttttagtagagacggggtttctccgtgttggtcaggctggcctggaactcccgacttcaggtgatccacctgcctcagcctcccaaagtgcttggattacaggcatgagccaccgtgcccggcctatttctttaaacatgtaaacttctggagtggtatttgtatgagataaatacatgttattatattgtagatgtatacaacagatggtagcctctagctgagattccaaggagaatattctgttactgggaaagggtgattatatgtttatttagcaaacacaaagtgtttaccatgtgccaggcactctttaagcactttacaaatattagctcatttgttttcagaagtgccctgagatgggtactgttattatccctatttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctgttgcccaggctgtggtgcagtggtgcaatctcggctcactgcaacctccgcctcctgggttcagacgattctcctgcctcagcctccccagtagctgggactacaggctcctaccattacactggctaatttttgtatttttagtagagatggggttttgccaagttggccagactggtcttgaactcctgacctcaggtgagccacctgcctcggcctcccaaagtgctgggattacaggccttagccactgctcccggcccctcattcagtttaatcaacagatgaacagtgtcactgaagatccctcaaactcagtgatgaacacatctgaaaaagaaagaaaattaagttcaaagaagaaacttttcattgttgccgttgtccatgaatgtagtgatctaaaaattctctttatcattgtgctttaaatagtgatttagttttgatctttaaatgtcaatagacaataaatatttatagactatgtgaatattggaaagaaaatataaacagtcacttttacagttcgggtttttgtctaaaaattttgttgtaatttctcttcctaattttagatctgtttgagaagatggttcccgtgtcagtacagcagtctttggctgcctataatcagaggaaagccgatttggttaacagatcaattgctcagatgagagaagccaccactttggcaaatgggtaggtagagcttaattttagagcctaaagttttccgtttggttgttctttagtttatgaacattttagtttctgagcttagagctaaatgtcaagagtatataaaatagaaaatgtagacacacacttacaactatttttgttggacactgtatttatgaagctctagcaaatatagttggaagaaattatagaaacaaggtgaggatatgaggactaaaaatttgtattttaagaggtatttatttggaaatgagaagtagaaatgaactcagatacatggtacatttagtgttctgaaccaatttttgtttctgatggactgaatactaagaaaataattcattggtttaaaaaatttttaggtatattttacacacacaaaatacacctattctaagtgcacagttcaattattatatgtatatgtgtgtgtgtgtgtgtatgtgtatatatatatatttatgtatatatatatattttttgttttttgggacagggtcttattgtcaccaggctggagtgcagtggtgtaaacactaaacatggctcactgcagtctcaaccttctgggctcaggtgatcctcctgcctcagcctcctgtgtagctgaggccacaggtgcaagccaccacacctggctaattttttgatatttttatagagacaagatctcactttgttgcccaggctggtcttgaactcctgggctcaagcgatcctcctgccttgacctcccaaagtgctgggattacgggcatgagccaccatgcttggtcatttagttagttttgataaatgtatgtacccatgtaaccggcactatgattaagttagagaacattactgttaccctaaaaaaattctctcatgcccctttcccagtccttcttcttttagcccctggccgctattgatctgctccctgtcttaagtttagttttactttttatacaatttaaaacacgtgtaatcattctagcatatgcatatacagtacttacagtatgtacagtatatacttagaatgtgttttgctttttttcacttagctactgtttttgagattcatctatattatgtgtatcagtttcagtcttttctatggctgagcagtattccattttatggttatagggcagtattccattttatggttatacggcagtattccattttatggttatagagcagtttgttaactctttcacctgttaatgggcatttcagtttctgtgaacattcatgtataaatcttcgtgtggacatattttagttctcttgggtaaatacttaggagacaaattgttaggttgtgtggttagcatatttaattttatacaaaattgccaggttgttttccaaagtggttgttccattttatatcctatctgcactgtttgaaaatacaattgttctgcatcctcaccaatacttggtatgtcagtctttttagttttagctactttagtgtgtgtgtagcagaatctcactgtgatttagtttgcattctcctaattgctaatgatactgagcagcttttcatgtgcttactagccattcatatattttctgtaaagtgtctattgaaatctttttctcagtttttaaaagtgagtttttcttaatagttaaagacttctttacatattttggaggcaagtcctttgtcagatacatataattgagaatataggtgaccctgaacaacatggggttatggatgctgacccccctgcacagtcaaatctgcatataacttctgagtccccaaaacttaactactaatagcctgctgttgaccagaagccttaccgataaacagtcaattaacacatactttgtatatgtattatatagtatattcttataataaataagctagagaaaaaatactattaagaaaatcataaggaagagaaaatatatttactatgattaaatggaaatggatcatcataaaggtcttcatccttgtctatttcaagtttgagtaggctgaggaagaggcggaaggagggttggtcttgctgtcttacaggtggcagaggtgaaagaggtgaaagtccacaggtacacggactcatgtagttcaaatctgtgttgttcaagggccaactgtatttctcttgtagttggcttgccttttcatgtttttagttttgattaatgcatggattttaccatcatttttctctaacaagaaaggaatgtaagtttactctagcatatgataaacaggcagtctgagattttacagagcttattttctgaggagttcattgtattacatcatttcatttgcctttttgtcgttacatagtagatagggatatgtacctcccttcgccatcatgtaactgaaataactgaggaattgttattgtgctacaaaactgagaacagatgaagattctgtaatgaatacttagatcatctattttctgttgacattttgcctagatgatgtgaaattataactattgattctgttgaaagagagcaaaaaagaaaaaaataactattttgtgtattgtttctgacttgttagagatgctgtaacaatcaaaagtataaaagactgcttttttaggatagaatttttgacttttaattacttagactgaaagaagtttgaactgtaagccgacgatacctaatatattttaatgcggtcatagtttttcttattttttgacttttttttttttttcccccgagacggagtctcactctgtcgcccaggctggaatgcagtggtgagatcttggctcactgcaaccttcgcctcccggcttcaggtgattcttgtgcctcagcctcccaagtagctgggattataggtgctcaccactacgcctgactaatttttgtacttttagtagagatggggtttcaccatgttggccaggctggtctcgaattcctgacctcaggtgatccacccgtctgggcctcccaaagtgctgggattacaggtgtgagccactgcaccagcctattttttggcttttaattctgaattgtgggcttcattttttaatgattttggtttaattttatcaatcactgattttttttgtttttctgttaatctttgctttgctttttttttttttttttttttttgagacggagtttcgctgtgttgcccaggctggagtgcggtggcgcgatctcggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcgatctcctgacctcgtgatcctcccgcctcggcctcccaaagtgctgggattacacgcgtgagccaccgcgcccggcctttgctttgcttttaattgatagggcttatccagtttttctgggtgctaactccattgctgttgatttggttatagaatactaaattaaataaagtaagtattgatgaggagttaaattgttttagacttcagtataacatagtatctcattttttcagggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgaggtatgttttataagatttgcttttcaagtataaacactgtgatcccttgatgtccagcagggattgggactggagacttcctcatgctagtacagtgtagttagtattcatcactttggtgaatttactgtggcccagagccttctctttagcataagagaaattctggttgagtgagaatgggtttcattcttatcttaagggtaagtaagtacacactaatgaaactcaaatgaccactgtgtaaaactagtatactgtgagaaatcaactgtcatacaaactgttcagtctttgtaattattgatttattttatgcatagcatgtagcaagatttttctttttaatttaatttgtcttaacctggaaggttaaaccctttaatttatccctaatttcttaaaatatattaaatatatttgttttatattatttatcttataattccaatatctgtagtttttgtgggtttgagtctatgatttgtaatttttgctgattcttgcttatggtggcttgttttctcttgtgttcagtttttttgttactgttttttaaaactttaaaaaatagtttcagatttacagagtctttgcaaatttagtgtagaaagttcctgtatatttttcacctagcttccctgaaagttaaaatcttatgcggtcatggcacatttgttaaaactaggaaattgacattggtacagtattattactcagattttaccagttattccaccagtgttcctcattctgttccaagatccagtacagaatactgaattgcatttagtgttcagtgagttttgattgtgcattcatatttcctgtacttatttgtgggaattcattgagatctgggtttaaggtgaattctagaaagaatttgtgtttgcttctgccataaaaaggcattatatacctggtacctcctcaaacttaagaggttttttcctttcttttataatcttttaattatagtagtaatttatcttaagactttgtgtcacacagatagtgcggtttctagtcccaagttcaggcttttgatcaggaatctcagataatacttcttgttttttcttttttctttagagccaaggtccagacaggcatgttttcttttgtagggcagttttctgttttaaaaattcatccactgagaatcacctgtttggaagtataccagtttgagggtggagagtgcttttgatctgacctctcaccttttattgtccctacctatgtttcttgttgacttttcatgttctaaattcacaatccaagtcaatggtgaactacacagctggtgaactatggatggtgggccagtgctagcttgtggcctactttttttgtatggttcactagttaaggataatttttatcttttttagagcattgtcaaaaaagaagaattctatgtaccgtagactgtggcccacaaaacctaaaatatttactctgtggtgtttgacacaagtttgctattctttgtcctaagctatcagggattgtcatacattgttggtgctagcactgtgtctactggtagattagtatttccttgtgtttctggccccctactatcctgtcatcttatctgtgcattaaaaaggcatttaaaaatatattaaacataattttctgtttgttgtattggaatgaaagtctaaattttatattttttaatgtaattgatcagttttccccttttgtttatggcttctatttatttattttaatcttaaaactttctttaaattgatatatggatgtaaatagtctcttatttattcctccttttttttttttttactgagaaaggtgatagctaattcacccttaaatttataagactttttgttaaatgcattataacttagatgtctgcaagaaaaaagtcgatttatattctaacctagtattcccatctcaccaaattctcacttatattgtgtatgaacatttattaaatgtattaaagtttttataccagaaatgacatttcagggttctttttgcttccttttaaagtcattaaggttgttggatgaagaagaagcaaccgataatgatttaagagcaaaatttaaggaacgttggcaaaggacaccatccaatgaactgtataagcctttaagagcaggtaaaaatgtgtataaatgaccttcatttgaataaattcccaatttcgacccacgtttttgcttgattaaattaggctcagttgtaaattcatttttaccgaaactgtttttcctcagttttagtataaagattaaaaaagttcacaaaagtaatctgccaattgtcagaagtacagatttttaagaaaggtatgaagtgaaaagttaaaatgatcctccaactttcattttctgttccaaactctgtgcatattttattttatttattttttttgagacaaggtctcgctgtgtcactcaggctggagtgcagtggcaggatcacagctcgctgcagccccaacctccagggctcaggcaatccttctacctcaacctcctgagtagctgacactgtagacatgtgctaccatgcccggctgatttttgtattttttgcagagacgaggttttaccatgttgccctggcttgtcttgaactcctgggctcaagtgatccacctgcctccacttcccaaagtgatgagattacaggcttgaaccaccatgcctggcccctgtgcatattttaaaaacataaatgagagcatattacatttatggctttgtaatttttttcatttagtagtgaatcctgggtggtaaaaaaaaaaatgagctttaagttattttgaggccaaatttatgcttcttaagactttgattattaagattttgtgcttgctgagataaatgctatcttcatggtggctggagattagttttatttatctttgtaaaaagttcatatattattgagatttttctaaaaatcttttttttttttaagtcacattgctcttttgacagaggaatacttttaaaataaatggaccagtttttggagagaatgatttcttcttcattcatgagttataggaaaagattaatattaattaacttttatttggcagatagtaaccaccaaatgtattttaaggtatagctatgcttttgattttataagtgattttgtcatctttctaaaaacgagaacgcaaagactgtcaggagctgtttttattatgaagtgaattggggtctatagaaggggaggataagtaaagttggagactagaactcaacatataaccagccgataaacgttgctgttagaatcacttctgtgctctgcaaacttttattttctcccagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggtaagaaggacactttgatgtaggttgtcatctgcttaagaaaaccacattcaagccattttatataatgaactgccaatttcttattgtcaactttaaaaaaatgcagaaataaattggggttgttatatttaaagtagtatatagactgtgtaatagataattatactaatattaactgtcctgtaatagtaacttccatttattgaatgcccttttttgaactaaattttagatacttcataggtcaacagtatttaatttgggttttataaaagagagaagcttggaagtatagaaatttcctgaaatgaaaggactgggtatagccagatacacaaattctttatttcttacattattctatactcctttccaccttgtttcaccggaactacctttgaaaggaagattgacaaggtgtgcatgttaataaatggatagcaccatcatggtatttctactgatgacaggaaagagaaaattgaatagtagggcatctgatttggaaagtcctaaaagaagagaaagtgcaagtataatttaatgacctatcacagggagatagggtaagttagtaggaaaagatagaggtcccaaatctctgcacaggaaaacaagcgaaagggcaagaaatactgctgaaaacttcttgaaaaaagtgaatttcctgggatagtaagttttgaaaagtttgagttttgttccttatttgtctttccatagaagcattttatatatttcatgtatttattccaagacctactggatatctgctctgtgtaaggcactatggtaggtacattggaaaattaacatacaaattacacacaggctttaccctcaatttatgatccattgtggaatattagtcatgtacaaggatgactgtaatatagggaagaagtttaaaaatgtcacagggaaagtataggaagtatgttacgaggatttagatgaagtacttaaatttcagtaattttggagtagttctcttcagaggcttcttaagagattggcacattatgagaacagagtggataggcagaaaaagtaaacgtgtaggatcggagaagggctgagtagtggctgtgtctagagagttatccgaggtacagaggatctgcaaagacagcttttactcctgatttcttgtgacagaaggtttacagacatgttgagaatggctggaatctgtttgtttatttatttattcactaagtgtttgaaggcctactattccagaacagtgctgagcaccttggtccctaacataaagagacaaaaaactgctctgggttacctttagtgtagagtaaatgcacaggtactgggcacctctcaaagggaagagaaggctacatagttgaatgtgcattgaacctggatctaacgggggaacccaatggaacaaggaatgtgagttattgttttgaggacataggggagaaaaggaggtggtcagaagattaacttgtgaagaacaacgaacctgaagaagaaactgcagacccttcgaacagcaataaattttggtaccttttttattttagaaaaagatttctggttagtactttctttgtattctttttggtgtcttgtacatgactcagaattatgtggctttcgtcctttgattcttctgctttcagtagaaaagcaaaaatggtttgtgctaagcaaaatctgcattagtatgcactgatatattgctattttattcagttatatcagttttattaatccttacttgtgttacacaggagaaaggaacttttatagtcaatacgaagtaattttatggaagctagattttcttgacggggtaaccacaaaaatttcagtactctctgtatattcgtttgtcatgtgccttaatcaaataaggcaagcatcaggtttatcaaagctatttcagactggttataatagttgatgacggattttagccagaatttttatgataaaaactcagttttttgattgctgattagagtgatgcaaatgtacatgttttattaaaaagtccaagtttgatggtagggctgttttttcttttattgtgaagaagcctactgtctggttacttattttcagtctctttggacatctggttttagacattgagatactctgacaaattttgcagactagtggtaatttgtatttaaagatttttgtattaaatacctaggatcactgcttgtgattggttgcctatgatgtactgtggcctgaagtccagtctatggttggctggccaagccttggccctaatgtatatggggctgagtctagccagaggaaggaacatgtatttttttgcacaaggttgatgttcagttatactcaaagtgttacatctgctgggagtaatggagggggtacctttaaaaaaaaaaaccctttacctccttacaggtagagcataaagagaattgtttaaaactgtgtgccctcccagaggagtgccttttttggattcacagactagtggaggatctgcaaacacagcttttactcctgatttctcatgacagaaagtttatagacatattgacaatgactggaatctgtttgtttatttatttactcaccaagtgttttttgaaggcctactattccagaactgtgctgagtaccttggtccctaacataaagagacaaaaaactcctctaggttacctttagtgtagggtaaatgtatcaagtttctgcgttcgttgctgtagacatagttgcttatttgccttttctgaaaataaaatgacaaggttataaaagtaaaatagaagattttgttgagggcatttctttctttcttttttttttttgagacggagtcttgctctgtcacccaggctggagagcagtggcgcaatcttggctcactgcaacctctgcctcctgggttcaagcaattctcctgtctcagcctcccgagtagctgggactacaggcatgtgctactgtgcccagctaatttttgtatttttagtagagacggggtttcaccatgttggcctggatggtctcgatcgcttgaccttgtgatccacccaccttggcctcccaaagtgctgggattacaggcgtgagctaccgcgcccggcccattgagggcatttcttgtctcatattgtacttggtgctgttaaatgccacagaggattttaaatctaaaactggggtcaggaagctgtggcttgtgggccaaatccagcctgcctcttctctttgtatgttctgtgagctaagaatgagttttacatttttaaaatgtaaaactctactttctacttcattttttaaatggctgaaaaaaagtcaaaagaatgttttaatatgtgggcattatataaaattgagatttcagtgttaatacatttttgttgaaacatagctgcgctcattcatttacacattgtctttcacactacaaagcagagttaaaagagttgcaacagagactgtggcctactgaggcaaaaatatttcctgtttggtcctttaccaaaaaagtttttaagttcctgatctgaaagacaaagtattgacaacctaggtgatgccattcctgccattctgtttgacctcatctcctgttctgccttttgtttactatgcttcagccagagtggcgtttttttctttcctttgatcctgccaagcttgtgcctgccacaggacttttacatttgcgtttccttctgtgcagggctttcttcccatttccgtggctgttacctctttttcattagtcttagatgtcacctcttctccatctttgtcattgtctacccacattattctatttttgtgtatttgtttaatcctcccctttgcatatttatttaatcctctctggtccccaaatgaaggaaaagactgtttttgttagtagttgtgtccatagcatctagaatggtacccaaaacaaaagtatttgtttgaatgatcatcactggcagcctaacttaataaagggatacatttaattgcagttgaaaggtagctggagttgtgtataagaaataaatatgctaggattctaattatttatatactttgataacatgttaaacctcaaatttgaatttataagaaaatttaggcagtggttttcttattatcttggtcattcatttgtggaagcagtttaattcattttctacttcatttactctgttaaaatgaggccagtgccttataatctgaaatatgttaaactagtgtactgcatatgaatttttttaaaaagatgttcataatataagggatctctatctttgtgtggtagtccacaagttcgttcataaattcgttgtttgaaatggcatttttttttccccagaaagttagaattattgcatttttgaatatcacagaatttgttaactatttgaccctctctgtatcagtctggttggataccatggaagttgtggttagcttttcttcctaatctaagtaatatgattgaatacttaccctttgttagaagttatgttgagcactttatatagattatctcagtctgcacaacagtcctgaaataggtactattatgcccattttgcagttgtgaaaattgaattttcttagtagtaacctgtccttgattgcacagtaactaagtccattatggtctctaagggagtatagtcagagttgaagtgttttttattttctatgtaattacatttttttatgtaattacgtttcactttgttagacccatttgtttccatattcaagttttgaacttaatctcgttttttgagtgtgtaaaaaatgttcatgattcaaaaggtacatacagagaagcctcattccttttccctctacttctttcctgtatacttgctgtaagtaaccatattcgttagtttctggtttgtccttactgattttctttttgcaagaacaacaacaaacaacccccaccccaaattatgcatacatatgtatacatatatacatattatgtatatgtatatttattttctgattttccttctgtcttactcaaattgcagcatactgtatatgcttttgtatcctttttttctcatttaataatatgtcctggaagtcacttggaaggaaacttttattcacatcgtctgatatcaagttctgctaggtctttaaacagactttgtcatatccacccacgtatgattctttctcctcctccttccttttagagtttctgtggtttgatgctttctagactctaggaatcatatttctttctctttccacagccttctcccctgtaccctcttctttccctccctccctttctccttcccttcccccttccttcctctcttccgcccctccctcttctgttcctttcctttccttccattttaaaattaggatgtttaggagatatggatgtaaacaaggccaaaaaggaaattcacctacatttagcagaaacctcgagtctctggtcttcacaaagggatgttactttggacattcctatcaaggagctaactaagactgtggaagaaagagtagaataggaatttttagaaacaggcagttggtaggggaatccatgggaattggaattgctgctggtagtgagaaagacaggggtggagacagggctcgtgatgtcctcttcttcctttgtctttcccccagttttctttctatgagcatcattggggcaagcagaatagagagattgggttgatgttcttggtggtcttagcaaagtatgaagagatgagtgaaaggggcagcttgaaagtgctcattagaaggcacttgaacactatgaatatgaaggggtatttatgaatcaggtgggtataggtcagagagtgtcttgactgaatacaagagataaatctctgttttgtttttgtattttgttttgagacagggtttctctctgtcacccaggctggagtgcagtggcatgatcatggctcactgcagccttgacccactgggctgaagcaattctcctgcctcagcctttggagtagctgtgactgcaggtgcacaccattgcacccaactaatttttttttttcaatgtagaaatggggtctcactttgttgcctaggctgatctcgaactcctaggcttaggtgatcctcctgaagtgctgggattgcaggcatgaacctctacatctggcctaaaactcttaatggtatgaagagaggcacaagaaccctctttccttttcctctcccagtatataaaataaatgtggtatatacacttatatctgtatctttctctatttctttctccatctaccatgcttgcttcatagctgtctctatttctgtcttcacctctgtttctctatatctctctcagtctctctaggcaaaataggatatctacttacctagcaaaatcataccttcccctgcttcacagccatgattgggagggagtagaatgtagagtggctaagagattggttttggaactagtcagacttaggtctcaaatttcacctctgccccttagtagctgtataaccatgtcacttaatttttctgagactcgttatccctatctttggaatagaggtcataaatatatataccccatggggtattgtaaggaatatatgaaattatatttctgaagtgttttagcatggtgcctaacacataagagttcagtaaattgtagatgttggctattgttattaatgctgcttttgttttaatatgagtcaactgaaggtacagtgtctatctatataaacctgacgttcaatttatatttggctctctgagaaatcatctctctctcagcccgaatgaacctttatatattatttccttctcgaaattggctttttttttttttttttttgcagttaaactaaggtgtcttttttgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtgaaatttatatatttaataagatctgtgttttaaaaattacagaaaagatatgtctggactaaacctatattcagttaggaaaatgacattggagaatatctgtagttaagagtagaacttaatacatgtatattttgtaaaattaaacttggcacatcagttttatctatgaaacaaagtcacttcttttttttttttttttgagatggagtctctctctgtcgcccaggctggagtgcagtggcgcgatcttggctcactgcaagctccgcctcccgggttcacgccattctcccgcttcagcctcccgagtagctgggactataggcgcccgccaccacgcctggctaattttttgtatttttagtagagacggggtttcaccatgttagccaggatggtctcgatctcctgacctcgtgatcctcctgccttggcctcccaaagtgctgggattacagacgtgagccaccatgccctgcagaaacaaagtcatttctatggctaaaatgttgcatattacttaggagtgcttgatacttcagatatttttcatggttccaagtttttaatagctttggttttttttccatatgggaggaaaatcgaaattagttggaattactgatacctttaattgtatggctaacatacatacagacttcagtcattttttaaaaaaataatgcaaagtaaatatgttgagaagtttgaagttagttttcgtgtttacagataggtagtttggactaacaaatacttgaaagtttgcccttttaatagttaatatgcaaaattaaacatatatttctactcctaaacattgtatctatatatgatataaaataactccaaaaggtaaaataattttcatgttatattttttacaagtgttatatactaatagaaatctgtgatcattattggttgttttgactcctattggatttttgaaatttttacttaagaaagatttaaagcataatgaggcttcaaaagagtgtactaggtattctagtaattttgcatatgtatttaattacatatgattttcataattggaaaagatcaataaaaatgttatgagctatattaattttataaataaatgtaaatatgtaaatctttcttttaacaaggtctcacatcaggaattttcaaaaatgaaacaatctaataatgaagctaacttaagagaagaagttttgaagaatttagctactgcatatgacaactttgttgaacttgtagctaatttgaaggaaggcacaaaggtatgaagtacatgcaaaaggaaccatagctagcaagtacagatgtgaacgcatagtttggaagttaagtggtatttccagttgaaccaaattgctctttgcctagaattttagctttaatgccattgctgctgcgaagtttgttataggagggagaaagcttaatgaaggtggcaacatttcatgggaactttgaagaatgaattgcatatttcaactggcagaaaaggggtataaatattccaggtagcaggaattagcagagatgtcaatgacacctttttaagggataggaagttgactaatttgatgaattttgaggggcaggagtagtcaaagctgatttgtgatggaaaagcggaggggcatgacttttatgttctctgcggtggtttgctgaggacagacttgtggcctgcccaagtgtcagaaggcttactgaatatgtaagtactttcttgccttgtcctttaaaaagtttagggaattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttattcatctctctgttcatattcatgaacagagaatgaacatgttcatgttcattcacctctctgctcatgttcatgagagaagttattttcttctacctctaacaaagagcaggttagttgtttttagaatatttctactaaacctataaaaagcaaataattagaatgttttaaaaatggttctaaatgtttaaaaaaaggtgatttttttttagatggagttttgctctgtcgcccaggctggagtgcagtggtgcagtcttggctcactgcaacctctgcctcccgggttcaagcagttcttctgcctcagcttcttaagtagctggcattacaggtgtgcaccaccacgcctggctaatttttgtatttttagtagagacagggtttcaccatgttggccaggctggtctcgaactcctgacctcaggtaattggaattataggggtgagccacccccccagcctaaaaaaagatgagtattctccatattagtcttaatgataaaaaaacctaacaaagattaatacaaaacagtctacagaccagtttcagttatgaatatggatgcagaagtcctaaataaagtatttgccagtaatagtcaccaggacgttaaaaaataattattgaccaaggggaggggggcatttattccagtttcagtattcagtattttcacatcaaaggaaagatcacaggtttgtcttaatagatgaggcagaagcatttgagaaaatgagtgttctgatactcagtaaaataagaatagatagaagatagatgcttccgtaacatgaaaatatatatatgtatgtgtgtgtatatatttctgcccaaaactcagtatagtgattaatggagaagcactataaacagttccctctgaagtcaagaacagacaacaaatgtcactgtcagcactatttttaaatactatactgcagtaccagccaagacaatcacatgagagagaaattaaaaaattggaaaggaagaagtaaaactagcactatttacagacattatgattgtacaactacttgaaaacccaagagaaccccaaaactctgcaaataataaaattattattactgaagttgttgatcataaaaataatttgtagaaatcagtggctttcatgtaaataaacctatagaggataagatgaagagacccacttacagtagcaacaaaaaggataaaatataaaatataagtttgtcatatatgagacctatgtgaagaaaacagtatttcaaaaagaaggcttgagcaagttaaaaaacatgttcttggacaggatgactcaacttcataaagatgtcaattctaagttaacttatgcatcaactgggcgtgatggcatgcacttctagtcccagctacttgggagattgaagtgggaggatggtttgagccctagagttctaggttgtagtgcgctatgattgtaccgtaaatagccactgtactccagtctgggcaacagtgagaccctatctctaataacaaacataaataaagaaataaacatatgcggccaggcgcggtggctcacgcctgaaatcccagcactttgggaggctgaggcgggcggatcacgaggtcaggagatcgagaccatcctggctaacacggtgaaaccccgtctctactaaaaatacaaaaaactagctgggcgtggtggcgggcgcctgtaatcccagctactcgagaggctgagacaggagaatggcgtgaacccgggaggcggagcttgcagtgagctgagattgcaccactgtactccagcctgggcaacagagtgagactctgtctcaaaaacaaaaacaaaacaaaacaaaagaaataaacatgcattcatatgcttttgatatgcaaacatgcttttgatatgcaaacatgcttttgattaaaaaaaatcagcagcttttcatttggaattagacaagttgatcctaaagttcaagtagaaaaagaaacaaggtcagccaggaaaacaataaaaagagtagtgaaggaatactagttctaccagatattaaggtatataataccatatttaattaaaacacagtggtactggtacatgattagacaaagacagaatagaaaatagaaatagattcaaatacatacgtgaatttagtgtaaaagatcttcagccaaccagaagaggtggacaactgcccagccatttagaaaataaaagttatctttataccagagtaagttctgagtggaccaaacttgaaatttgtaaatgaaatataaggtgtaaaatagaatggaggagaattccgtaataaagctgggatgagcaggatctaataactcctacttaaaatccagaagccattaaaaaaaaagaaaagaataagtttctcatagaaatatgataaacagagtcaggatatgacaaattgggaatccaatatttgaaacttattcacaggcaaaaggctaatttactttatttagaaaagaactcctagaagtgaacgagaagaaaacccaatagaaaactgaggagaagacgcaaacagaattttgcagacaaggaaatacaaatggctcttaaataaatgaaaaaaaatgaataccctcattcattataaaatacaaattaaaattagtctgaagtaatatttttcagattggcaagaatctgaaagtttgataatatgctttgttgtcacatgttggagaaatagatttcatacattgccgtgagaatacccaatggtgcaatccttgtgttgggcattttagctgtaaagaataataagactgcaaattcaaacatcctttaatccagccattctgtttttgggagtctattctgaggatatattagaatatgctagaaatgacatatttatgagcttattcatttctacattgcaaatagcagtaaaaaagtagaaacaaagtgaccagggctggtgaaataaagctatacttgtatagtgaaatgctgtgcagctattttaaaaatcagggtgttttcaatttactgatatggaaagatctccaagatagttatggtaaaaagacacagaacagtgtgtagagtatgttttgtgtaaaaaggaagaaaataacaaatatagaaattggcttgtttacgcacaaggaagctctggatattctaaggaagaaagattggaatatcgtcatttaaaatattttatatttcatatatctaatttaaaaatcaggtttgttgtaaacaagtatatattttatttacacttgtcaagtattttcagctcagtgattgaaaggtgaatgaaagatggaaaagtaggccatataataatattagcttttgaatatctgagagtttattttgttaaagtcgttgttaatactgaaggccaaaatcctttgaaatcttactggatataatgtataccggaaaagtatacataagtgtgtatcttgttgaatgttcacaaactgcgtacacccaggcaaccagcacttaaatcaatacacagaaaattctcagcaccctaaaagcattgttaatgcatccacccagtcagtcagtctttatctttcttttccagggcaaccgctatcctaacttgtaagaacatagattactttctcctgtttttgcattgtatataaatagaatcacatattatgtactcttccatgactggcttttattctacattatatttgtgagattcatcagtatagttgtgtgtatttgtagatcttttattctcatttctgcatatattttattatgtgaatgtacaagttatttattctactgttgaatattttgagtagttgccagttttgagcttttataaatagtgctggcatgaatgttgtaaatcactgctgtccagtattgctggtagcagtaaaaatatggaaacaagtcaaatgtctggttctggttaattaaataaaactacatctatatggtgaagtactatgcagtgacatatgcaattgaaaatgtaaaatttgtagtagccgtagttaaaaaaaaaaaaacaggtgaaattaatttcaatatttcatttaacccagtatgtccaaagtattattttaacatataatcaatgtaaaattacaaatgagagatattttactttttttcacactaagtcttagaaatctaatctgtatttttttttttttgtgagatggagtcttgctctgtcgctcaggctggagtgcagtggcacgatctcggctcactgcaacctccgcctcctgggttcaagcaattctctgcctcagcctcccgagtagctgggattacaagcgcccaccaccaagcccagctaatttttgtatttttagtagagacgggtttcaccatcttggccagactggtcttgaactcctgacctcctgatccacccgcctcggcctcccaaagtgctgggattacaggcgtgagccaccgagcccggcttaatatgtattttatacttacaacacatctcaattcagagtagccacatttcagatgtttgatagtcatgtgtggctaatggttactgtattagacagtacatgcttttggtgagcatgttatatgcagtgctgttgggtatatatcgaggtcaaaggatatgtgtgtatgctcagttgatattgtcaaatagttttccaacgtgattgtactaatttatattcctcctagcaatatatgagagtcctggttgctccacatttttgcccttagctattctgctgggtttgtagtattatctcattgtatgattttaatttttcattttcctgatgactaatatgtcctttttatatacttattagctggaggctttgctttttaatttctgttttcattgaaatctttcatcagaagtttaaagcgtttaagaagaatgaatattttactctgagctttactttcttttgactaatggtttgaatactactgtcaggttgttgggcatagtactagtggcattttattttatatctttttgctcttttacattattgattttatttaatagcattgatttatatcttttataagtggctaggaaattatcatttgctctataaatgtgttatttactgcaaccatccctagagtttatcaaaggaaaagaaaggtattgtgttaaagctttataatatacgtatatattttagatatttcaaaatctggccttttagaattttgatattgattaaaaacttatttattttataagcagttatttacttaagaagtagttttgttttttttttttgatgaatgtatactagttttctttatgtctggagtgactggggcccttcttgagagggaaggttggatgcggacagtgtggggctttgctgttaattgttaaatcagggcaaaaggtactgtctcagatgttttgggacatgtcatatttacttctttgtgtacgttaatcagtgcagtgaaaagatgattgacatcatgtattacatggagtgcattttaccttaggtattgtttagtgtgattttgggataaatttcaatttactgttagaggagacagaattttctaatatttaatactaaattgtaatagtattttcagcaatatatctttcatgagtttatcttagtgacaggtgatgtgttatcttttaatataaaatatttcaacgccacatttctttgaatatcttcaggaagtttttatctagaaatttgcataatggtttgcataaaaggttagccttttcacctgttttattttgtataaacactgatatagtgattaaaacattagctacataactatgagtcactgtagttttctgataacttttagatagatgatgttaggagttttttaaatccagggactaccttttattagagggtgggcagtcttttaggattacttgcccagtttgacacgtttcttactctagctgtaactgtgatctctgaaaatgtttactttttcccccagtcttcagaaatataaaaaagatacaacttcattttattaaacaataggaagaaagaggatttagattctagtcaagaataaaaatgtagtatattttgtttttttcagtttttgttatattgataaataattatacatattatggggtacatgtgatactttgatcatgaatacaatgtgtaataatcaaatcagggtaattaggatattcatcacatatttgtggggcacatgtgatattttgatacatgaatacaatgcataataatcaaatcaaggcaattaggatattcatctcaaacgtttatcatttctttgtgttgggaacattccaaatcttctagctattttgaaatatacaataaattatcattaactatcatcaccctatgctgctattaaacactagaacttatttattctctctgactgtatttttgtacctattatccaccctctcttcatccccaccccctactctttcttgactctagtaaccatcattctactctgtctccttgtttttagctcacacatatggaggagaacatgcaatatttgtctttctgtgcctggcttatttcacttatcatgatggcctccagttccatccatgttgctgcaaatgacagaatttcattatattttttatggctgaataatattccatggtgtatatatactacactatatccatttatctgctgatggacacttaggttgcattcatattttggctgttggaagtgctgcaataaacatgggaatacagatatctcttcagtatatggatatcctttctttaggatatatacccagcagtgggattgttggatcatattgtagatctagttttagttttttgagggacctccatactgttttccatagtcactgtactaatttgaaatgtagtatattttaaaataccatcattgtttggaatccattttctatgtttcatgtatgaagaaaagaaaagctgatattttatgtgtgttaatttttttctatcatgttaatttttaacactctgtctttgataagggacttgcaacaaagcattgccagagaacctagtgctccttcaattcctacacctgcgtatcagtcctcaccagcaggaggacatgcaccaactcctccaactccagcgccaagaaccatgccggttagtaggcaaataaatattttaaacagaggttttacattaacgatgattacttgttctaacggataaaacatgatttacataggaaggatctagtggttaccacctgcatcaggtaaccaaccttctgatattttgcaatatgtagaacacagcatcattcaagaattcttgacaaaaaaatgcttaacctgaatgtaatcaagcccttaaactttctgtttatagcaaataaaacaaatgataaaataagaagttaaattatgctattaggaaacaattggacaaatctttcacatgggacatttatatgaaataactgagttgatcatttctaaaagtgaatgtcatagattttttaaaaaagaggcatattctagatgaaaagagatgaaagtttccttataatcaaatgcagtatatgaactttatttgcttttggtttataaaaatagctatatgagcttttttgtgttaattaggggaaaattgaatttggagtggatatttgatgacattggggaatagcattagttttttaaggatgaaaatggtattgtgattatgtaggagaatatccttatgagaacttgagtgctgaagtctttagggctagtgtcatgaaatttgcaacttactttcaaatgattctgcaaatatatatggatgtagttatagataaagcagaaatgacaaatgttaatagttgttgaatttcattggtagatgtgtgattattttatatactattttttacaaattttctggtgtgtgacatttttcatgtaaagtttggggactaggaggagatgatggtagtaaacagtacctgtgctgcttccttccacctcaaatgtccaaccactggaggaagcagtaaatgattaaatatgaggcaccaggaaaagagcagtggctatggagtttccacaggttggaaaattattcaactatgatatatttctatagtaataagccggtatttaagaatgggaattaaaaatatatttggttggattctagagtttctcatatgtccttattaattttaattaatagcaatttgagagaaatatgaaacattttatagtcaatgctgactttttcttatagcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtaaggctgcaacattgtgtatcccaagttggctaatgttgtttctaggctctggctaacctgttaaaaacagggtcatcccttctccaaatggaggtgtcatgaatgaataagctacactgtcagcttatccagaaatgaaaataatgttatggtcacttacatgaataggatagctatttcctaggcttttaaaatttatgtttttatattttacatattgggtttatattaaataatcttttctgtattatagagtttagtaggtgtttccttggactttaggtgataaacaggtaccttttctgagcgtagcatagcaaaactgataaggccttgtttacgtccctatacttagaatacttggcatttaataaacagttgaatagaaatttatctaattatgggttgcactttcttaaaggttaatctctgtggtaatttcttaattttaaaaatccaaacatttgactaccttttaagatgtgctctaaattttacttagtaagtacatgttgtctgccaaatattagaactttataagttgtaaatttatgtatatcacagtgaatattgaatattgtggaagaggaatgtatttagatgactagttttgccacgttaaaatgaagggtctccattttttttctttctttaatactcgaatatttaatcttattttcttcagtatttatttttggatagtattaaacacttggtactcttttgttttaattaataacaggataggaatgcttttctctgacaagtgccttgaaacagtttttttcactccactgttctttaatagactaaaaaatagaaatgactttcatgaaaaacgtagttctagaatgattattgttttattttttagtatttgatttaccaatcaagatttttctgttttcttctatcaggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 38194 - DNA, 17458 bp, Homo sapiens
ggcgctgaagatcggggccgctcggccgcaggccgcctccagcgccgcgggatgtagcgcgggggaccgcggcccccagcagagcccgcctgcccggctgtaagtctcccaggggctgcgcggtgggcagggactcggcgggagcgcggggaccccgggggccccgacccaggcctgcggaggagacagctgttgggggaacccgctccgacttgccagggggctcgggccccagccaaggagccgcctggcctccaggcatccagccggtcaggttgtaaacatttccggcccctcccactgcgcgccgcctccgaggcggcctaggtgcggtgggcgctcgtccccggctgtcccccgactcccggcagtcctgtgagtgctgcgcctttagccccacggggtggagatgcatgggttccccagatcgggaccagagagccagagttaagcctggccccgaggccgccgcgcgtggggagggagggctgcgggcctaggtcgcgaaccgcctctcagcggggaacagccgcattgggttgccaggaagccctaaggttcctccaccaacaatctttggcaggtcaagtcctgacagtgccctcactttgatggggtgggaagggaggttggtgatcgctctgcagggttaaggtaatcctgaaggctgaaatgcggggcagaatcgaaggtactttgggggaaaatgaaatttcattaccttaggtatctaggattgatgtattctatcttctgtttgagaattttggtcttcaagccttcgatttttaagaaaatagataagtgttttttttccctcagtttctggtgctctttgggagaatgggaaactgacaaggccaatttcagtttacaccgtttcagatgtcaaaggagcgctaggaggccatggtactttactagattaaccatagtacttccctcaagtgattcagaagacgggctagaaaatacagcggagaatacataggctgccatctacaaaacaaatgattgtaatggctggttcttttctgaaatgaagtaatagtggggtcggttcactgcttttctcttttcctagtagttgggtaggctacgatggtgcaacttcggttcctgaggttgtatactatctgtatactgccaggaatttagggtggtgctaaacagattgcaatgtcagggtaccggcttgcagctactaaatgtatttactccaggaataacttttatgtacccatattgtgatttgcacttgggaaatcagtcataaaaactgatgttacctgtgaaggcccatgttatggtagacctccgcaaaactatacctaattgtagagtagaaactgaaagctttctattctcaatggtcaagactttgcctgcaggtaggagagaatctcagaaaaataacagggagcaacattaatccactgatccccattgctgatttataaagtacaccaccttaagtaggcttttaggctattttcagttttttaagtctggcctcattttacctttccaggactctatggaaaaatgaattgtttactgccctggggactgtgttctttcatggcatgttcacaccatataccctcctggaatgccctgtttccatctctatctatcaatctcctgtcataaaatcttccacaaaactttttctgatcacttcaactaaagttgcacttttcttttgaattcctcctgcacataatggcactaagccttgtagtgatattaggaaagttatttcccccatttagaggccaacaaccatttcaaccctctgactcctctttgccttgtctctgtggccacaacaccatgcgtattgtaagtaatcaatcggtattctcagattaatgaaggttagaaattgcccttctttctaggccagtgtatttgttctctattcccataggaaatttcctttgacttctaatacaaagccaaactgaaaccctttaacactcctgctacattatcctgtcccatctacttattatcacacaggtaagataagcagtcgtctttatatctagacgctttgtgaattatggtgagttttttttcttggaccagtactcatcaacgttgttatgtccatttgtccctaatgtcacctcctggattttgttcctctcaccatgctaaaagttgattcccattttcctgctcagaaatgttgggggcataggccgggcacagtggctcatgcctctaatcccaacactttgggaggctgaggcgagtggatcacctgaggtcaggagttcgagaccaacctggtcaacatggcaaaaccctgtctctactaaaaatacaaaaattatccggatgtggtggcaggtgcctgtaatcccagctacttgggaggctgaggcaagagaattgcttgaacctggaaggcggaggttgcagtgagcagatcatgccactgcactccaccctgggggatagagcaaggcccttgtctccaaaaataaaagtgggggctggcattggctgggcacggtggctcacacctgtaatcccagcactttgggaggctgatgcaggagaattgcttgagtccaggagtataggctgcagtaagctatgatcgtgccacacactctagcctgggcctggaactggctgaacttgggagcaagaccctgactccaaaaagaaaaaatgggctggcattaaaatccttcatatgcctgtatactgttcacttttttttttgtcatgacattagcaaagtttgcctgtctgtcagggctcaaaaacacctcttcagccaggcacagtggctcatacctgtaatcccagcactttgggatgccaaggctgggcaacatagtgagaccttgtctctacaaaaaaataaaattagctgggcatggtggcacatgcctgtagtcccggttactaagacttgggaagctaaggtgggaggatcgcttgagtctggcacattgaggctacagtgagctgagatcacaccactgcactccagcctgaatgacagagcaagacccttttaaaaaaaaaaaaagacttctgttggggaagagctacaaaggaagtcagactgtttttccacttcagagtctgggacgcttggcatcgagtaggagagctgaggccctatatactgtagttcggtgatttcaaacatgtgcctttgctttgattcatatttctccaacaaagctgtgaaattatcctgcctaagagacagtagataggggaaaaatggctgtattctttatctatactgctagactggtcttgctttaggacaagaatcaagctaggtatggatagaggctacccatagactctctaaaggcccaggaactaaactcttagaaactttgtgtctttgcctccaggaaaggtgtgccgtagcctggaaaacttgggaattggttcacaatataaatgtctccaaaaactataagtgaaataactctccagctaactggctggtgattaaaaatcaatcttttccccatgtttggcacaggattatcttatttataggagtacaaacaacctccctgctccacagctttactctctaatatcctaggtttacccagttggaaagcttagtggtaaaggtttattagcttgagttgaagaaatctcatcaaaaatgcactcagtcgagtttggctcaaatataatttgcagtattgggtgtggcaagcttgaggggaaaggcatttcctctaaaatacgtaaggacatagaaagctggcagaaggttggctcacctaggatcgttctaacaccttaggggtttgttctgattttacaccatagactaaaacacacttgtaattctccattgtttgtgagtgatccaccccatagaagtggtattttcagatcctagtattatttgctcttctttcttgccagacgtccgatccctatctctccctttcctgtctctgtgttactacagtttagaagaccaaactggacaatggactttgctcactatgatgacatgatctccattgacctccattgtatgtactttaatgcatgatgatatattttgtatgatgagttgtagctgatggctggtttgtgagttaactggggtctcaggttttggtgactctgggtctagaagatgtagagaggtggtataggagctagtgatagaggagctagagggaatcggaagaactaatagtaaatgatttggactgaaaaaggaaaagactttgatgatagccagaagacttgagggcataaaaacttttcagatcaaatgatgaaattagtaagaatgccaatctggattctgcacatgatctttggaccctaattgcccaacttaaattttctctatattattctcattgcctctagtaaaatagttacatagcactcaaagttactaaatttagtgtgtgaccattctagttgaggggttctctccctccactgccctcctggagcaatcaaattgtatcacttatttttgtgcatatcacaaactacctatgttatctggctctttgaaaacaatactataacttgttcaacttgtattttgcacagtgtcttgtattttgcacagtgtcttagaatgccttagggtgctagtcctaaatacacttgctaaatattcaatgaatgtgttgacttactctggggaaagggataagagaagccaccacaagcacaagaaaatgcacataagcccttatctaagtggctagaagctaagtcatatgctggcaagctggaatctgccccattcattcattcattttgaaatgggttctaactaaaataaagtatatttattattttatgatccatgtattgcatctcagaaccagaattttgttttgttttgttttgtttctgccctggtagcctgatctaagttacttccaacagtaacttagtaagtaacaagctaagtgtgcccctcttttcagatttatctaagatgcccaaaaatatttatgttttttgcttgtgatataaagttgttttttggtttttttttttttgcttgcgatataaagtattttttagtaaagctgctgattcagtagtacttcactttgaggaaatatgttttgaggtcagcctattgagaaagatttccttgtgtccctctcacacgggttgcccatcctcgaggttttcataggcttccagcttcctgttctccttagctcaattgttcactatgactgtgtgctggcatctcgtcagagtcttgcacatttaaaggaagaggaactgtctatgtgttgacaccatataaaggtctgctgtatagcaagttattgtttttgtctctcttggactagattgccggttgctttcaactgtgcttgtgggttgagcatagcatgactcatgactgtttagaagcttgaggattgcccttacctgatgtgttagtaagtgttctccagaaagcaccaataggatacatacatatggatagagatgggatttattcggggaattggctcatgagattatggaggctaagtcccacactatgccatctcaagctagacaatgaggaaagtccataactggttcagtttaaggctgaaggcctgagaacccaaggggctattggtgcacgtcccggaatcccaaggcaggagaacctggagtttctgatgtccaagggcaggaaaagaagggtgtcccagctccaggagggaaggagggggagagacagagagagttagggagtcagagaaagagatttataatccctgagaaggaattgtgattactcttagataaaaaagaactgacacaagatatcaaagatatttgtatatagtgaatagccatggatgatatagtgtctccctcaggagcaaagttatgtttactgcccaatataaaagattggggctccctaagcttaagtttcctctcccggaatgcaacccactccatgtgcagttgttacctggccctccctgcattgcaatgtggttatttgggtttgggtggggcttgggtaaccaatgcaagaaaatgctaatattctggctactgctattgctataactaataaagtcctttgtatgggggtagaggtggggagagaactaataatttacagcatagtggaaatctttggaaactttctccctctttccctctttttttatttgcatttccctgaggcctgtttaaagactactgtgaaaatccaacccaggaaaacctaaagtgtctgagatttttcctagaaaatggaattctgggtttttctgattttgtgtgtgcctgtctctagtttctgaaatactcatttgagtagggcttagattatgggttgtggtggttgaaacaagttattgtggagctggttattaggtatgtgtgtggcaaagggtaaattggggctgcctccttgtcttcaccttcctgcttccaggtaagttcttgcttgcttgcaggacagattgtgatgaaagcttgttatcccagggttgaactcaggctataatcctgtaatagaattagtagacttcgcagagaaattaaccactaggcatctgtcccacaaccaagttccttttgtatgtatgacacatttatcagagcatttgtagataaggtctaactgagttcagttggcatttaattcatttctaagcctggatgatcttgtagtaattgcagccagatgttggctttatatttttattcctcggtctcagagctaggcctttcttgggcagagtgagctttgggagtgatagatgagattcttctcactaaatggttccatacctgtgggagggagttgagggtgggtagctgtttttctatggtgacagtttggtgcagtaaccatagatcatatgaaagcaagcaactaggtgttacattttcagccttacctataagattagtgaggttctgggtaaaggttgacattaaagagggaggacaggaatagatttcatttaagcaattaactggcctttagaattggggacaggatatgagttgattagcttcttattcagtattagagtatagaaatgaaactgtaagaggaataaattgtcaatccttcatgtttgtattttcttttagtgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagtaagtcatcttcccaggagtcatccccttgttcagtttctctccttagaactctgtcattttctcttttttaagagctcaccgtccaaaaggaggaacattgcatcctggaaatgtctctatccaagtccctatgatactgttataaacatcttgttgtctgctttccccattgtaagcttttgggaatgcactcatctttgtaacaccagtgcttagcacaaggcctgcagtccaataaataatcagtaaatatctgaatgaatgaaggaagcagtcaattaggattaggtttgacttcatataacacacaaaaatccttacagttttgacaggacagaagtctctcaagcaaaagaatttcagaagtaaccaatccagggctgatatggaggatccaccactgtcaggcacctgtgttgctctcccatcactcttaatatgtgcccatcatacccacattctaccccccatgaaagggaaacgagaagaaaggccctctctttcccttttatttttattgagataagatctcgccatgttgcctaggctgatcttaaactcctaggctcaagtgatcctcctgcctcagcctcccaaagtgttggaattacaggtatgagccactgtgcccggccaactctttgccttttaaagggactatcagggccgggcacggtggctcacacctgtaatcccaacactttgagaggccgaggcaggtggatcacctgagatcaggagttcgagaccagcctggccaacatagtgaagccccctctctactaaaaacacaaaaattagctgggtgtggtggcagtcgcctgtaatcccagctactcgggaggctgaggcaggagaatcgcttgaatctgggaggcagaggttgcagtgagccgagatcgtgccattgcactccagcctgggcaacgagtgaaaccccctctcagaaaaaacaaaaataaataaagggactatcaggaagtacctcataagacttcggccagaacttacttacataactatattcagctgcagtggaggttagaaagtgcagcctgagtaaaattgcagtaacattgccaccctgaacaaaaccgtgggctttgttacttaggaagagagagaatggatgttagggtagactggctggaagctgtagcacaaaatctaagatggaccatgtgtttactagtgaccatcagcaacaggagagaaatagcccagaaaaggagttgaactgccaggctttctatagccatgattcggagccttgggatagagagagagaaagttctctccctttcacaggcaagtgctctcctgggtgtgttttttttttttttttttggagacagagtctcgctgtcgccctggctggagtgcagtggcacgttctcggctcactgcaggctccgccctccagggttcatgccattctcctgcctcagcctcccgagtagctgggactacaggtgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccctctgggtgcgcttttttaggccctggagtcagtaccgctgttttccatggaaccagttctgaggccctggtactcctgggagctgctgtagatacaaagtttcaatcatgacagcatccctagagtcagtgaacagggaactctgaacagaattattgttatggaactctctgagactctgtgtctttttcgttgttttgaaaacgtaggctgggcatggtggctcagcctgtaatcccagcactttgggaggccgaggcaggaggatcacgtgaggtcaggagattgagaacagcctggccaacatggtgaaaccccatctctactaaaaatacaaaaattagtcaggcatggtggtgggcgcctgtaatcccagctacttggaggccgaggcatgagaattgcttgaacccgggaggcggaggttgcagtgaacagagatcgcaccactgtactccagcctgggtgacagagggatattccatttcaaaaaaaaaaaaagaaagaaagaaaatgtaatggcttagaaaagagaactctttgggaaactgaggaaagttaagaaccactatcctaaagaaaaggatgtcattcagtacctagagctggtgtattcccccaatgctagtctctgtgacagtccttcttttacgcactgcatagaatgttcactccagcatttacgaagtattaataaatttctaactagtgttgtaaactcagtgtgtatgcttttggagaagagaccacaagaccctctgtaggaaagaggctgggcagaaggcattaggtttgggtttttctgggtctctctgctctggaatagtacaatttatgagatgactccctggattgttgtgggttttttcccccataggctgaagaagagcaaacatgcccagtgccccaggaagaagaggaggaggtgcgggtactgacacttcccctgcaagcccaccacgccatggagaagatggaagagtttgtgtacaaggtatggcctatgagcttctgtcctggaaggggaagggcagcaggcctgtctgggatgtccccagccagcaagcttgcactgggtcgaagagcttttattcctgggaaggagtggatttgttttttggttaagatgaggtaaatcaatgtgaagactggctaaatttttactgcctactctgtgaggcattgttcaaaatatattcttaaaacggattcttttctatgcaaggggcgcctttggaagtcatcaaaatatttcaatatgacagtaatatgaatgcctttgttaacacattaaatatacatgaatgatgagcactaatgtattttattaaaatttgtaatttctaagtaatgatgaatagaaacagtattttgagatacctgcagaactaatgtgtgagagtatctgatttctattggtgacaaagccacaagttctactaatactgtggtttgttgcttatgcttataattgaggaaaatgctcaatttacttagaggtaaatggaaatacaattttttccatctattccctggatcctgtccatagtgcatggatcctagattaagaacccctactctaaaaagatgtggtaagaacttagaatctaattgggggagggatgagacatgagatagaatctcctggagaggggcaaaggagggatctgtacgttttttaaaacaacgtttataatttttttgtttttattcagtatatcaattttgaaatttcaagtagcctaaaggaggttgtaccatatatatatatatatttttttgagacagagttttgctcttgtctcccagctgcagtggcacgatctcagctcactgcaacctctgcctgccaggttcaagcacttctcctgcctcagcctcccgagtagctgggattacaggcatgtgccaccacgcctggcttatttttgtatttttagtagagacggggtttctccatgttggtcaggctagtctcgaactcccaacctcaggtgatccgcccgcctcagcctcccaaagtgctgggattacaggcgtgaaccactgcgcccagcctggttggaccatattttcttaaaaggttgagaaacacttacctaaaacttctccagataaactaacatgaaacaaagacaaagagattttttgtttgtttgtttttgtttttttgttttttttgaatacagagtcttgctcggtcgcccaggctggagtgcagtggtgcaatctcggctcactgcaacccccgcccgccaggttcaaaccattctcctgcctcagcctcctgagtagctgggattacaggtgcccgccaccatgcccggccaattttttgtgtttttagtagagacagggtttcaccatgttagtcaggcaggtcttgaactcctgacctcaggtgatccacctgcctcagcctcccaaagtgctaagattacaggcatgagccgctacactcagccaggattttttttttttttttaatggtcaaaatatgagtcaggactctgctagccccattcatgctatgtcttggatatcccccagtccaggctggttctccactattacctaggaccattcagagcctgactgacatcttcttagactagttctccatcactgcttgtccttggggaaggtactatctagtgccctacccagagaaagtgtatatgttctaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtgagtgatttggatggggaaaggtggaatttgttgtctccctaactgcgaagggattatagagcccaacaaagttgttcagatcgattggcagctgggattctacctttaaactactaatgactttaagctaataaccttggttgacccttgatcactgatctttaagactgagagtaaaaggcctagaaaccaaagaaattgggactagatatttttttgtgatccctggcagaactgttctaggtggagacaattccttgtacttcgtaatttccaactgtaaaagtaaaatgccaacatttcaaaaaatggtcttttttgtctgggtttctgtgaccagtgccactttctttgaaacattggactgcaattacacagctaaacctcatagctttctgattttttttttatttcaatagctcttgggttacaaaggggtgggggggggtttggttacatggatgaattatatactggtgaattctgagattttaatgcacccatcaccttagtagtgtacattgtactcaatatgtagtttttctgtctcacacccctatctccccctcccgcttctaagtctccatagtccattatatcattctatatgcctttgcgtactcatagcttagctcccacttataagtgagaacatatacagtatttgatttttcattcctaagttacttcacttagaatagtggccttcagcttcatccaggttgctgcaaaagacattattgcattcctttttatggctgagtagtattccatggtgtacatacaccacatttcctttattcactcattggtcaatggacacttaggttggttccatatctttagagttgtgaattgtgctacaataaacatacatgtgcatgtgtctttttcatatgactgcttttcctttgggtagacacctggtagtgggattggtggatcaaatagtagctctacttttagttctttaaggaatctctatacccttttccatagaggttatactagtttataatttacattcccacaaggagtgtataagcattccccttttaccatatccatgccaacatctgttgttttttgactttttaataatggcctttcttgcagaagtaaggtggtatttcattgtgcttttaatttgtatttccctgatgattagtgatgttgcctgtagctctctgattcaaaaacatcaaccatcaaagtgtacacattcccttttttcttacaggttttttttattttaccctcctgcaggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaagtgagttaaaagaacaccataggaaaatactgtgcactgttgtcacatcttgagatcccagtgcttactgggtgataggagctcatatcactcctaaaggtttcttgatatgccagaggaaaggctctctgttctgtggcgatagtggggtgatgaagcttttctcttaaacacttcatgaacagacttactgcatcctcttcaacagatggagagaccaattgtggaatatattttctacctgaaaagcactatcttttgtgaggcttagagtgccagtgcactggctgctttccaagaccttgtacaagcgtaacttactattagcccaagccaaagtagggtgtggtaaatagtctatgcttcattctgctggtgctcctacccagcagtcaagtaaagcttatctttgctgcccatgcattgctggaagctccagatgtccatcatcgtgtgctttctctcttgcccagccgtgagcctgaggttctatttgtttgcttgtttttgttgttattgttggttttggtggcgacagtggtgtattattttgttttttctaacaacaccagtaagaaggtacattttcctcatttaaaaagtcaactaagatagaaaaagctagagtatcccttaatactactcccaatttaagaattttgtttttagaactcattctatcagaataggagaattttcaaagcctttcctgagtgtgatgctgggaaccagctggattgtgatggaatttctaaattcaagtgtctactatgggagatacggctgttcactagtaagggaaagggatagagttctttgaatggggattcttagagatttttccatcgtaaaatagaagtgaccttgtggaattttaatccagaatacaggatagattgtatgggagtctacaatacaggatagattgagggaatggttaaatctgggagcaggtggagaacagaaagagctagttaaatgagccatacaaattcatttcccccactgatttgtttcatttttgtggttctttttagactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggtaggtcggaagatgtacgtacacctcagaggtatttagaccttaggcctgataggctcaaacctatttgagccttaaggtttgcagcttgagaaccccacccaaaccctgatttgtgtttcagaactttcaaaacagcatcaatttcaaagctcagttctcaacccccagtgtcatactatttcagtagaatgccaataggacagatcattacccagctggtcaattaactgcaagcacagatgtagctactcttatacttggtttgtgacagtttaaaaatgtagcaagcacagtaattttagtgacccgagtcccaagctcagaccaagggattaaaattaaaacactcagaggcattttactaagggaatggaatacctggtttggtgaatgaaaataccttgagcataaacaggtaacaaagtaatagctacaagcataaacatctttgtgttgtctcatctcatctggactcttattttaagcttttattacttgcagcaacaccaccaattaccactagtctttagtccctttacaattaatatctgctatgttttaaccttcagttaaaataattaaatattgtccgggagcagtggctcacgcctgtaatcccagcactttggggggccgaggcaggcggatcacttgaagtcaggagtttgagaccagcctggccgacatggtaaaaccctgtttttatttaaaatataaaaattagtcggcgttgtggcaggtgcctgtaattccagctacttgagaggctgaggcgggagaatcacttgaacctggtcgggggcagaggttgtagtgagccaagatcacgccactgcactccagcctgggcaacaaagcaagactctatctcaaaaaaaaaaaagaaagaaagaaagaaaagaaaaaaataataataattaaatatttatcaagcaccagccacgtgccatgcactgtgcttaaacaaaggtatttacaaagatggagaggtggtccctgcccttcagttatgtgtagtgtaatgatgagacacatacccattcttcccttgctcttgccttacttgtgtgtcccagcagctacaggataactgctaatctgggtatatctgtctactcaggaggtcagagttctggttatgtaagacttttatgatcttaacaggaagcctatcctatgcttctctgacttgggaggcaactgaagccttgacatctaagttctgtacccaagttagccatcagagagtcttgacataccatttttacctaaattccttaacagataatgaagaatatgagatctttgttcttggtgcttaaaaggtagtaagcacttacacagcttcttcccattcaggacatagaagaaatatctgttgagtgttatccatcttgtagctaagtttcctaaacatgtactattcatccaaaaatagctaattatcataaacattgaaattccagagtaagacagcagtgccttccatgcggtggctgtttccttgtttgacagtcttatgtctgttctgttcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatgggtaagaaatgaatcttccagcaggtcctgtgatggtgagtgaacagcccaaagttaaagggctgaggaaaaggtggtatgagactgggatcatatagtgtttggaggtacatatatgtgcattgaaggtaaatcatcaatattaacattttggtgtatctctgacaaggactgtgtttttaaaactttctaaatataccactttaatgttattaacaaatttgtttaattaaggataaactagaagaagcaaatgctttctcctacttgtttcttattcctccttgcattatcctaaaggctcttttctttttattcctacagttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagacacttggcattcaaagatttc

SEQ ID NO: 38195 - DNA, 24760 bp, Homo sapiens
acgtggtacggaaccggcgccgcgcttgctgctggtaacagggccttgcctagtgggccttccttcccaggtgggtcttcctgatggaccttccttcccgggtgggcgccctgagctgggaacgggctgggcggggaggacccgggtcagcggcgagagtcacgcctcattcgtgggggagcgtggggcgcccggccgcagccaggcgggaacaatggtgtccgggctgttcccgagcgcgcggtcgggggcggaggcccgtgacggccatggccccggggcctctcgcacctccgggccactcgtgtcccagcagcgccgagcgcgtccccggtacgcagggacaagctgggcggcgcacttggcctgagcctgcgtggccctccctggtggagtcgagtggaacgacccgggttggagatggggttgcggggagccgagcgctggtcaggccacacccctccccaggggcctgctgagaactccagcctttctccaacggatccctttcccggagacctggggtggggagtgtggcgggacagaagcctcccaggttcaaagggccctggacagcgtccctagctcccgccagcatttgaggcagcgtttaaggctataggaggaagcgtctgaggggagacaaaattcccatgccagcttgatggtctggggcaggtgtcttattcaattggcttcagtttcctcatctgtgaaatagagacaatatttggtcctcacagacagggccaccaaaccaaactccccaccgcctgccaaggtcagattccgtagatcatccaagcatagactgcaggaagaggcggagaacccggggcctgctaccaataccttccttgtccctaatgtttgcaggcaggagtggaggaagagaagtccacattatgcttagggatcaagttctagcttgggcagattggagattcttttattggttcttaatcagacatgaaggtgtgattcagttatttgtgttatatatgccttcaattatcaagggacagggactgagattctcagaactagaagactcatttgtgtgtactactgacggttccaggtgccacagcaatttctcctgccctccactagtctcaacatttaaatcatgttactcccttgccaggcatggtggctcatgtgtgtaacctcggcactttgggagaccaaggcggacagatcgcttgagtccaggagttcgagaccagcctgagtaacacgagcaaaccccgtctctacaaaaaatacaaaaattagctgggtgtggtggtgcgcacctgcagtcccagctacttgggaagctgaggcaggaggatcatttgagcctgggagacagaggttgcagtgagccaaaatcacagcaatgcactcctgcctgggtgacagaatgacaacctgtctctaaataaataaataaagttactccgtatgaactttagatttttagaggggagtgaggtgtcatttaaaaggataatgcttttgcttaaatcagcatactgcttttaccttaattagtggtgttctccagagcatataaaaatggttccatttaatggctttgtaacgggggaggtggggggaagtgaaacaggagtaacccagaagtgtgaatgggaggagaaactggaacctggcctagcctggtttgactggatgagtgattaacaggagttgctttttagcccatctctgatggtggaacaatctgatccctgtttcctctcttttagtgaaagtcgtaacttagataattacagtcatatgttgcttaaggatggggatacattccaagaaaatgcattgttaggcgattcgttgttgtgtgcacatcctgagctgcgctcacacaaacctggatggtacagcctcctacatacctaggctatatggtgtagcctattgctcctaggctacaaacccgtacatgtacctttactggatgctgtaggcagttgtaacacagtggtaggtatttgtgtatctaaacatatctagacagaaaatgaattttttagctccattataatcttttgggaccaccgctgttgttgatggaaatgttatgtggcacgtgactatatttttgagtgactttagctacaatgccactggttaatttgactacaagagaataatattaatgagaatgtaccacagtgagcttgggatttgtggcatttaataaccaggaacccagatgaaaatcaccacatgtagcatattgtcctgctaaataggatttcctttaatgtgaacaggtagcttccctgcgtacatttttggcaacaggtggatgacagtgttatttattaacactgataaacgcctctccagcgtgctcatgggctccatcttacttgaggctcctccaaatgagtgcctcagcagaaagatccgagctggctgggaggtatataaccattccatgctctgtggctagtgtttgaagaggaggaagagggcacttgagaaggcagtggttggatgtcccacccacatagaaatcacatttgcaacttgcagtgccctgcgatttcatcaccctgcacagcaacagccacttttgaacagttgccacgcttggtgtcgtggtggataaagtcacctctctgttgagaaatcactttgaaagcctataccaaggaaacaatgctctttacctgcagcatgtcaatgcacaggcgtttgtctggcatgtagacacgaggctgtagtagggtcctgtcactccacagctgtgactctgaggcacttcatgtccccgcagttttgaatttgctccgtacagctgtgtgctttctgctgcggaaagccaattataaaagtcccaataccagaatcaattttccattgtattcattgtgactaacaaaaagagtctgaggatgtgttttcacctctatctgtgagtggggcggaagttgctgggtgtcacacatggaagtggggtgagagcatgcgcgctggagcctgtgtggcctcttggtcaggtgcttgtggaggtttagctgatgccctttggctgtttctggactaagatcatcaactttcttaaactgaatctggttttccttgggctctgtcgtctgtgttgtgggtttgtggtggtggacacaggatgtgacattcttgctgggatccctgaagtgactatatcctctgcaataacagaaagtgaaacttatctttgtgctttaagagtgtaaaaatttttattaaagtaccagtaaaactaaaagtgcctacttttagttttcactgtattttcttcaactcaggccctccctctgttgttacctgccatctgacacggaattttgtgtaattttccttccaagtaaagaagggaagtttagccccagcctctaactggttcccaaagtttttgtctctgaagccgcagtcacttcctggagcgtctctggctgggtgttgcagtgctggctgggagggtggggcaacaatttacaattctgaacacgtgctttctgggcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaaggtaagggaatattcattttaggaaacagtaaaatctgatttaatcccatggggcccagagaagttgtcaagagctaatatgaattatgccatttaaatccagggttagaagatctgcctagagatctgttcattagcttcttattatggcataggttacacttttggtttttgacaaagtgttaatgtatgtttctaagaatagcaaatctaattgaaatttttgtttcatctccatcaacaatttcttgtgatagttacagattaaatagtttgcattaagtatgttctaagtaattcaatagttatatattaatctgtttcttgatgttaacttagagcattatgttttaaagttattcttcgtacatacattacagatgaaatctttagaattctcatgctaaaattatactttagaaaatttggccattgtcgggatgataaataagctaatttggactgtggcaacattgggtattttctgtatctttcagttgtaatttagtcacattcagataaaaacttatttacggaacctggtacattttacatttacttcctccttaattgttaaaaataaaccatgtgacatttttcttttgtactctagttcttggtacagggttagtactgtagcaggacaagccacagacaaaacctctcagacaccgagttgtagaaggaagggctttattcagctgggagcatcggcaagctactgccttaaaatccgagctccctgagtgcacaatttctgtcccttttaagggctcacagcactaaagatttcacatgaaagggtcgtgattgatttgagcaagcaggcagtacgtgacaggggctgtatgcaccggtggtcagagagaaacagaacagggcagggaatttcacagtgttcttttatacaatgtctggaatctatgaataacatcggtttttaagtcatgagttgatttttaactactaggtttaggccaggcaggcccgggtccggttttgggcctggcgccgggctgcctgtctttgatttcacttccttgttttttttttgtttgtttttaaacaggtactgagtgtaaaacaatatgagagggtctctctcttccctcagtacaaacagtttttaaaatctttaacccaaagcacacgtgatgggtctgtcctatttccaatcagcctgttcaactgcagcagccacagagggtgagcctggaatgtggcaacgttacgggagcctcttctccctcaaggacaccttttcagaatccctcgttgcttcttgtccacaaacagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggtaggaggcaacattctttgcattgcaggaccgtagacagattctgcctgaggggttgacaagacgccacaagttcttaaaagatcttttgcttcacataccccactcacctttaaaacaaaaaaggaagggcctgatttggatggtaagttctgtacgtgactgcttcagttggattggggcaaaggttttgtggcactcagcatttttctccaggaaggagaactgctgacagttactcaggactaagttaatgtaacagtcattctgagagaatggctgagattcccctcccagcaatccataagctttcaaactaggaagttacactttattcaagtccatttaaaaattataaagactccccccaacccccggctccccctcacacacagtgctgcgtccttgagccttatttttttattttttttatttttttgagacagagtctccctctgtcgcccaggctggagtgcagtggcgtgatctcggcccactgcaacctccgcctcccgggttcaagcgattctcctgcttcagcctcctgagtagctgggcgagcgccactacacccagctaatttttatattttttgtagagacggggttttgccatgttggccaggctggtctcgaactcctgacctcaggtgatccgcctgcctcagcctcccaaaatgctaggattacaggtgtgagccactttttcataagagatattttgtgtgggggtctgttgtttttcagtgcaggattctgacaggtgagaatggtttgttttcttgctaaatgaacagtctcactttgtggtacagtaagtactcacgtcatccataggttcttagaaactgcaactttaagcaagacaacatacaacaacaggtccttgaataaggtagttttgttcacttaaagtcacagtttctaaaagcctatccatgaagttgagtgaggacttactgtgtgtgtgtatatatatgtgtgttttttttgtctttttggtttttttttttgtcgggatggggtttcaccatgtttccaggctggtctcaaacttctagtctcaagcgatttacctgccttggcatcccaaattgtcacgccaccatacccggcctcttactgtatgttatttcactagtttatttcaaatgatttcagccttatgttaattgcatgtttcatgccatatattttcaaagtttgtaatattcttttatattctttgatctaatgataagctatggcttatctcggttctttggcctgatgatttgggtgtcaatctgaaatcacagcactagaagcttgagtgtggccattcagttcagcgcattcgtttcatcagagggagagagtggaggccaggcagctctgtccactgggagcccacaggaggctcatgcagagcaggttcatgcccaggcctcctgattccccaggcagtgctattcatttgaggttttcttctgaaaacaaatttaataattgacttagggtatattatagcttcccaccaattttccccccatctttgggagactaaaccaagtttcttcatgttgtttctttttagggtcagactcaccttgctccctttcgtttttttttttttcctaatatattgaaaaatctaggtgaggtaaatcatttttaggagttgtttcattacaatagttatatttacttcgttgatcactgacattgctgtgcaattcttaagaaagggcctttcataaaaaactaaattactgttatactattttgaattacataacactgatttttatcaaggaattgaaatatttcatcactggtggaatcttctgcagagatgcttgcggtgtggggtgaccacacatcttctgttctcttcccgcatgtccatgtggcagtggtgttctgtttttcagagtgatgatgacttgatgcaggggtgaaggtggaagtgggtgttttcctgtgtcagtgcagaagtcagagtattttcagctgatgaaggaaaggtgatgttgggcgtttcagaacaattttacctgtgggccaaagcagtttctcagaaaatgcctaagtatttcagaggagccctattgaacaggaatttatgtagagaaaatctgtggtcatttgaaaatcatttttctgctcaggcaagctgagggccagctgggactgccaaagccatgggttccctgggaccagagcagagagatttcagccacaattctttgtccctggtgggtacaggctgtcctggtgagaactgaggcacagatacagccacagtgacgctgggacaaatgaggggcgtcaggccatacactgcacacgcagccacagtgccgctgggacaaatgaggggcgtcaggccacacgccacacacgcagccacactgccgctgggacaaatgaggggcgtcaggccacacgccacacacgcagccacactgccgctgggacaaatgaggggcgtcaggccatacactgcacacgcagccacactgccgctgggacaaatgaggggcgtcaggccatacactgcacacgcagccacactgctgctgggacaaatgatgggcgtcaggccatacactgcacacgcagccacagtgccgctgggacaaatgaggggcgtcaggccacacgccacacacgcagccacactgccgctgggacaaatgaggggcgtcaggccatacactgcacacgcagccacactgccactgggacaaatgaggggcgtcaggccacacgccacacacgcagccacagtgccgctgggacaaatgatgggcgtcaggccatacactgcacacgcagccacactgccactgggacaaatgaggggcgtcaggccatacactgcacacgcagccacactgccgctgggacaaatgaggggcgtcaggccacacgcagcacactagcagccttcaggttgcaggggttacttaaattactgggaacacaaatcctggatcccataagaatcccagccacctgcccagtttcgtaaagtgcttgtacacttagagctggaggccctgcagtttggaagggacacttttctcagcctatcaccagcactgtcctgatccagttgtcatttcagtgactgctcattttacctcttaattgcaaactgttaatttaacttcattatcaatttagtttttgcgttgtgtctgttaatacctattttcatgaacagtattttctagcaactagactaatatatatgtatgtcatgttttagtatgaacagtctcttcctcctacagctaaaagcatctcctgccacttgcttgtgacactttgtgatgatcatggggtattttcctattggaatataggcactggtagaggagctacatggccacaggagttttgcacagcctgagtaggccatagtctaaagtaaaaggtggagaccactgacctgatgtgaaaactggaaaagacctaagattgatttgcctccatttagatgcaggggtgggctgggatgcctgtcccattctccattcctatgggattgtggaatattggtagtgcttctgggacaaagctcagaaggcgtacctgctatcactaactttttagaatggctaaatgtgaatttaggtataaagatttttttatatatatcttggtttatggcattttccatgcataattgtaatcaatgtacagaatttcaaaaatacctcttctgatttaagattatagtttattttaaccatcatttcagaaaataataaactaagttgcatcccgaactcagcctgcgtgttttgttatataaaagtcaaagaaaaaccagcctttaagaatttaccaaatccagccaggtgcagtggctcatgcttgtaattctagcactttggaaagccgaggtgggtggtttgcctgaactcaggaattcgagaccaccgtgcgggcaacagtgaaaccctgtctctactaaaatacaaaaaattaaccaggcatggtggccggcacctgtaatcccagctacttgggcggttgagacctaagaatcgcttgagcctgggaggcagaggttgcaatgagctgggatcacgccactgcgctccagcctgggtgacagagcaagattctgtctcaaaaaaaaaaaaaaaaaatttaccaaactgcctgcaattggcaaacatgtacatgtgctctggagtacaagaaagtaagaaagtaaatcttaattagtgactccattgaacagtgtgctcttaaactctacaatagaggttgattgataaggacagataaggaagctcaaggtcttttaataatctccaccttaagcactgaatttcttaaacaaaggctgtccttggttcctttcctctccatgctcagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggtgagcgccgcgcgcctatgcgtgcccagaggaaaggcactgacttttggaaagtcattgctagtccgtttttctgtttccagtacagactgtttttattttattttatttattttattactttttaaaaatctttttttgagacagagtctcactctgtagctcaggctggagggcaatggcaagatctcaattcactgcaacctccgcctcccggggttcaagcgattctcctgcctcagcctccccagtagctgggattacgggcgcccatcaccacgcctggctagtttttttatttttagtagagacggggtttcaccatgctggccaggctggtcttgatctcctgacctcaagtgatcccccccacctcagcctcccaaagtgctgggattacaggcttgagccaccacgccgggcacagactgtttttaacgtaagctagaaatggaggtttcttacaggtgcctctgttgctgaacttccagaaagcctgccttttcctgtgcaaatgagccccccgtggctggcgtctgccaggcttcctctactgctgatgctttttctcagaatgcacatttggaatccaggcagggccttcctgaaaagcctgtccccttgtccccctccccggcccttaccaacagctgcttctgcggtatatgttagtggcctccttcaccctggctgccccagtgggggtggcgatgtccctgttattcaccaagtgcttccgtgggcctggcacctgcaggccttttgaggcccgtgctatgagggaccccgcaggccagcctcttttcttcctgttccttctggtgtaaaggccttctgctttcatttctgaatttccacatgtgcctgcacgggaggctttgaccagatgaggaatcctcccaccctcatgctgggcccctctgggctaagttccaggctcttctcatcgaagcccttccaactggatcattgcatctgtgttcaaacctttcctggcccagtgtcagttgtgttcattactgtgcaaaactgaaactgactttacttaaagcaacattttttatgagatgtaattccatgtcattgtccttgtcacggtggaattactaacttgcggtggattgtaggattaaccctctctgtgcacttgggcgcccctccagcgtcagacccacctgtctgcttggccgtgccctcactcctggaactcgctctctctggacagaagtctttgtctttgctccttgtccgctgtcttacagtctccgcggatggcaccatctctctgccacctgcactgggaactgggtccccatccctgccaggctctcctctgggaccactgcccttcccacgttgaaagctccctgtccccctcacccactccgtggctgggtcctgctctccacttctgggccttcacggtgccactccttttctgggctgctcccagagtgacctcaacatgccacttctcttcttgactcctcttgggggactcaggatggcacagagggtccctcccctcacctgccttctgcctgccccttctcccacctgtacccagccacacgggaccacgtgcagcccccaggagcctgtgctgctcaaaactgcacctgggcacctgcgcgggcgtcagccccatcaccgctgcctcgtcctctgtgaggcctgcctccagccatcctcttagccctccctgtcccagtctcagtaggctcctgactgtcaaggaacctagaagagcacctgtactgtgggaaaacttcactcactgccagccgcccggcctccctctccttgtcagggagccctggagggtgggggcaggtcacatttgtcggcagctctgagccagcaccgtgccagccgctgtagttgttcagtgtttgttgtagggataaggattgttgttttagaaaagcttatatttgatcttcagtttttgtgaaaagttgggtttcattcgtcaaaggaaattccccaggtggtgatgactttcagcctcatactaccttgggctggggcctgctgaggctgcgggacctgggaagcaggctgagccccgggaggtcaggagactggccacgcagacccaggcccacgagaaggccacgccttgaggacggctccctcctctggttccatgaggccgggactgcgtggcagaggatggaggaggcgtggggccttgtcttcaagttgtcgcttgtgttgtcagcttccccagaagcaattgtggtgaggggccgctgtgactgatgacgctgattagaagcagcgtcttgtctgtagttttcagagtgataactacagaaagaaagaagcagaggttaaatgataaacatgttctttgtttttttatcaaattaggtgtcacaattgggtgggggtgagattatggttcttttttgacaacggtgccttgaggttcctaagtgactgggcttcctgtccccattgctccccgctgcttctggtaaatgggttttaatgaactaagcagctggctgcgactccctggagttagactggaggtctccaccctgacccagcaggaagccatgcccccacctgaccaccgtgaccacggtgggagaaggaaggggttcttgggagcatccacgtggcttatctctttgatgatgccaaattctctgacaaatttaacgatagtgttgggtggaaattgggggctcctgatcggaaggggaagcctctctcgtgtttgcttggctaaggggttatcagatgtgcacctgagacacgctgcttctgggttccttgtaatcatcactttatgaatttgtggattgctgttctaggcaagctgtatgggagaggttcgactgatgataagggcccggtggccggctggataaacgccctggaagcgtatcagaaaacaggccaggtatgccccccacgctgacttctgcctgagtcctgggttccatctgagccatacaaagacaggctctctgttcacacaacagcttataaagctcacaggaaaagataagacaagcgtcccccagcccttatcagcacagatgactcggatgtaagagtataggtttgttttccagctttaggaaacattcaaagtgtaattgttttacagctgcttaaaggtcacaatattggcgactcagcgtgatttttgccaccgcatgaaatgtgacttttcagtccctgcctgtctctgtgagtgtggtcccttgccagaacatagtgcaggctctgtcacatcacacaggcccctcactgtctctgtgtggtttacgtcctcctaaaaataaattctgatttttaaaatgtattctctggctgggtgcagtggctcacacctgtaattcctttgggaggaattactttgggaggctgaggtgggtggatcacttggggtcaggagttcaagaccagcctggccaacatggtgaaaccccgtctctactcaaactacaaaattaaccgggcatggtggtgggcacctgtaatcccagctcctgggaggctgaggcaagaaaatcgcctgaaccagggaggcagaggttgcagtgagccgagatcatgccactgcactccagcctgggtgacagggcgagactctgtctcaaaaaaaaaaaaaaagcattctcctacctgtgaaatatctgttcgttgttcaaagtttgctaaaaaacggacaagtagagagaaaaatacttgcctagaatccaaagacagttagtattttgaaatctaccaagattttctgttgcttttttcctagttgtgatcatgctgtatagacatctttgcatcttgcttttatcttgtatcatggtgacataagaataagataagcatttttgtcaaagcatggaatgttaggtctgaaaagggtcttagccctgctggtccgggggattactttacatggtggggaggtgacacccagaaccacctggcctggtgcggccgagcctgcatgctgggcgggaactaggaagcctccccaacctctggccccgtggagccctcagcctcagctgcagtggaggcacctcgggctctggggcaaccaagtgtgacaggtggctgtgcacgggcagaggtcctgtggaagatttcatgtgacgggcagaagaggaggaggaggcaggggaggaagcacatccatgaacagggctgtctgggggcagcctgggtggtcgtgaaataggactcagtagccttgagtcctcatttaggccctgatgttctttagcctgcctggcctttggcaaatcgccagcttcacgcacaacctcatttttcacctttgggtgtgggggtcagagtcgggagagcacctgcaaagccacaatgatccagacacacggcaaggtgggcacattcccatcaggctcctcggggagagcagcgcttctgtgcccgggagcagcgaaggtcacacaggaggacccgcacctcctcgtgtcggtggctccgctggtataatcaggactcacgtggtgttcctcgtgtcgtggcccttattgcagagggagcagcacaggctttcctggaagctcccctcggtcatgtggggtgactccagagagccccaccttgcgagactggaccagtccaagtggcctggagccacagcggcctggcagtacctggggagggggtgatgacaggtgcacacggaggcccatgtggtctgtctggagaatgccggagatgtgaaatatgtaatcctgagtgtggcttctagaaggaaggttcgcaaagctgaatatccactcgtgctgttcccttctcacaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtacagtgccaagctgtacgggtcacttctttctaacccctgaatctcccggttctcccaaacgcaaagtagacaaggacccagaagtcaggtgcacaggaaggagaagcacagggctcacttagtgccccaattcccagcttccataaaccaccgtcctacaccagggtggacagcaacacttccagtgatcagaagttaatctcacagcagcatcaaggtaggacagtgtgatttgtaatgttgctttggagcggctgagaggagattaaatgctagttcatttcagaagatgcaaacacatacaaagcattttagaaacacttccttttgaaggtggaaatatttatatgttagcacttaggctccttatcccatgactaagtgacgcacgggaaaaagagaaaccgaggccgggtgcagtggctcacgcctgtaatcccagcactttgggaggccgagccagatggatcacttgaggtcaggagtttgaaaccagcctggccaacatggtgaaaccccgtctccactaaaaatacaaaaagttagccaggtgtggtggcaggtgcctgtaatcccagctactcgggaggctgaggaaggagaatcgcttgaacccgggaggtggaggttgtagtgagtggagattgcaccattgcactccagcctgagctacagagcgagactccacttcaaaaaaaaaaaaaaagagaaaccgaggcagcaccaagagtgggaagggacaggcctggctagattctgccactcactggctggtggtcatctcccaataccccacaggatgactgtggtgattaaattaggtcctgtctgcagacgtcatttataacctgaacagtgctagaaatcactgcagttgctgccctgagccctcactctgagcaaggtactgttctggttttaaaagtggctgcctgtcatccccagtgctgggaggagcactacgcctcttcccatttgcaggcgaggaggccgggcactcagcaggcagctgccctacgctgggtatgcagctgctcagtgcaagggcgaggtccgaccccaggtctccagctccaggcttgtggtgggtctcattcctgttgggctgccctctcagcagaggtgcagggtctttgttaaacttctagcaaaggctttgagtggtaggcagattgccctgtggaatgcttgtacctgtggctagtgttaccgtcttatctgtggttggcatatgccacagataagctggtatgtttttgttcctgcctaggtttttaatttgggaaatgccttgctttgctccctgagggagcaaattttgatttgggaaattgtcaggccttgtaaatgctctttgttgaatttactgtcacatgataaaaataagctcccactaggcagccagacacagtggcctttgtttccgtgcaggtggagtgcagcaacaaagacctccattctggggtgtacgggggctcggtgcatgaggccatgactgatctcattttgctgatgggtaagtgcgggatggcattcagtccgcagttgaggggaagtggatgggcgtgacttccaggctgtctgtcatcagcattgggtgcatttcagcattccacatgaaccaacttctgtctcagtttcctactgtgcctctccctccttccactcacttgtccctctgagaggcccccttgtttgatttttgcccctgaaaccctcctgtgcctgtcaccacctggtgaaaccttgccctgcctccagcacccaactcagtcacccccaggtcctgtctggccaagcccctcgaggcacgtggtgctgtcctttctctggtgtggtcattttccatctctctcagggcgtgtgttttggcctgtcttatgtataactggccccatccaggtccccccgcctgatcagctctttgagagcgggcatagcccatcgtgctgttcccggtgtcctcctgctctcaggccaagcacagccctcccttcccgcaccttccacaagctctccattcctccctgccaacgccagctgcctgcgtgacgtccactctgttatacccacagtttacccccctcagctcaggagcagcttgtttcttgtggaatgcgcattaaaaaggcacatggggcagtgtggtggttgttagagtggggctgcgtgaagccagtctgctggtttgcgtcgtggtctatgaccaaggacaatttcctttccccacttgttcctcagtctccttacctgagaaatgggaatgcccaagctgctgcctcattggctgtttggctgattacatcactggctgagcctgaggccccggacggtgcctgacaggcgatatgtgcatgggatgcatctgcgagcatcattctgtggacgcttgtggctgctcttggcccctcctcagccacgtggctgtggggcctgagccgcatctctcctgagcctggcttcctggggtcggtgcaggaaagagcagctcgccttggtgcggcctcccctgagtgctgtaaccctctccggcttccctcaggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaaggtctggttcagggctcgactctgccacctgcccaggccacgctgtgacacaggtgtcccccaggccctgtcaccttccctgggtccagggggtctctgagggaagagctggaatgtccgatgcacatgagtcactcagaaagcagactgtgaccaggttgctggtcgttggaattttttagtttcaaaatctacttttgattccatcagacctggagaagcatgcagaggggacatgggctggctcctgctggcagcggctctgctgtgtttgtgtttatagagtaacctccttaccgctgggcccagggctcatttaagccacatcagagccaagtgctaggtggaaactgtgccgaacgtttacctaacttaggggaaaagtgggtcatgacttttctcttaataggctgtaggtttatgcggtacatatgtaagttctgcaggctgtagggttatgcggtatagatgtaacttctgcgggctctaggtttatgtggtacagatgtgagttctgcgggctatagatttatgtggtatggatgtaagttctgcaggctataggtttatgtggtatggatgtaagttccgcaggctataggtttatgtggtatggatgtaagttctgcaggctgtaggtttatgcggtacagatgtaagttctgcaggctgtgggcttatgtggtacgtatgtaagttctgcaggctataggtttatgtggtatggatgtaagttctgcaggctataggtttatgtggtatggatgtaagttctgcagcctgtgggcttacgtggtacgtatgtaagttctgcaggctataggtttatgtggtatggatgtaagttctgcagcctgtgggcttacgtggtacgtatgtaagttctgcaggctataggtttatgtggtatggatgtaagttctgcaggctgtagggttatgtggtatggatgtaagttctgcaggctataggtttatgtggtatggatgtaagttccgcaggctgtgggtttatgcggtacggatgtaagttctgcaggctgtagggttatgcagtatagatgaaagttctgtgccattgattgagccagcatcagttgaattaagcaactcagcccctgggacacaagggaaataaggcccggctgggctcttgagttttgtctcccagagacagacaggcaagaactctggaaggatatgctgagggccacgctgggcagtaccaaaggctgtgggcctgcacgaggggagggtcatggtgctgggagcggctgaggctcatcagggtcctgtcagccagcagaggtgcagggcaaggctggcatgcccggtcagcaggagcacagacatatcagctgcttagggacagatgggcagcagggtgaggcctgggactgagaccgacatgccggcctgatggcctgggcgctgctgtggagctccgggtcttccaggagatggtgagcccggccaggatttgagttcatcagatctcacattgggaaagatcatgggtcaggatgtcagagctgagtcggtggagctaggagacccgttaggctgttgcaggcacgggagccttggctggcatcagggaggagcctctggaataggaagagaaggtccccaccggcagtgactggacagtgatgtcagggaccgaggggttgggcacggggaggagcgggcctgggagaaggtgggtctgtttctcctgccctgaccctcaggctcgtgtttgcttctgtgtacagtgttttagggccttgtctgttcctcccagataacactgagctgtttggttgacaaacagaaatctacacattcagtggataagtcactgaggaaccttctggaagccccctttgggggcacacctactctcttgacccaccttctgctactgcagggatgcagggggcgggggcaggcaggaaggtcatgatattgatgacacacttgggaaacaggagatgaagtctctcctggtctgaggagatggcatcatcggtattcagggggccataccggatgtgctggtcagcctggctctcctctctcagtaggaacgggctgctcgcctgtgtcccatgggcctgggagaggcctgcacacagcctgggctgcatcccctcttactcctggtgcctctggctcatcaagagctccaaagtctgtgggaccttgacacccccagttctacaggtgctcagtggccagcgtggctcgcctagttctgccaggtggacctgagccacccacgctgcagcgacgggcagtgaaatgcctcacctgagggtgtgcagcctgtcaggggcctcctttgtgctgagtcactcactgcagtcgcacctgcacctggacctcctgcctgtggttgtcaggctcctgggccaggccctgtttcataccgctcatttcccagacaacattcccagctcctcggtgagcagacagggctggcactgaatgcctgaggtgtccctgaccctctgatttttctgcagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggcatgtggggctgggacacggggtgggggccaagagctactgtgtccgggcagagacttgggtaatataggctgttactcgacagacacccgggccatgcatgcccccgcttcctggctctggccaagtcagtaattatgacagtcacggttcagaagctaatcaaagataatgcatcacatgtaagtgacctttgttactgatgaggcaggccaaaatctggcctttgacctcactcacctcaaggctccaggccaaacaccaactttggaccaagcgtgttctggtcagagtcccagagccgccccttaccatggtgccttgtggaggggactctggtggctggaggtcagcccagcttctgactgtccccctcagctgggattcctggggagatggagtcttcccactgggaatgggagcctggggctcacccttcatgctgaatactgaggtcttgtcacgaggaggtgtccccgggtcagcgcctggctctatcctgggtctggatgcagtgtagcctgtggtcattgattttatgaagtacctcggtctgctcaggctgccacaataaagaccacagacgcggtagcttacgtggcagacgcgatagcttacgtggcagaaacggattcctcactgtttcggaggcggatgagtccaggaccaaggtgccggcagctgtggcatctgacgagggttcctcctggccgtggccgctggcctcgcttgtcctcacatggcagagggcaggctctcggtatcttctcacccaggcccacccttctggcctcatttaacctttgtctaaataaggtttagaaagagaaaaaaaaactactaaagaaaaaaagctaggcttttaaagaattcaagttagttttattcaggcgcctcactgaggaatgcggactgcggcccggggcccaggagcagccttggagaggtttggctgggctgctctgagagagcggctcagcccgcagctcatctgcaggtggaggagcttcggtgcgtgctgaatcacatcgcacctgctcagatgttacattccagccaagccacactgagcctcggtgtaagagcacatgtggtcaaaggtcacagaggcgcaaccactaatgcggtcaggtgctatcttatgtgtgggaaaaggtaaggacagggtcatttatctcctaaggaatgcagcgactcgggcaagaggcaggggtggtgtgtgctcccccgttttgtcttcaaagcatctttcctgagagctacaggtagtggcagggtggagcctgtgaaaggccggcaagcagaatggcgcaaacgcagcttctcacatttgtgactttgtctcacaccttagttacttctgttaagtccccaagtgtagtcataatggagtttagggcttaaatatatgaattctgggggcacgcaaacattctgtccataatataaagcaggtcagggaagattgtttttaaacttaatttaaatagtatcatcatttagaagatctttggaaagagtgaattgcttgatattaaaactttgtcttttactttgaaataactgggttttattttttgataagaagtcccctctttctggccgggcgcggtggctcacacttgtaatcccagcactttgggaggccaaggcgggcggatcacgaggtcaggagatccagaccacggtgaaaccccgtctctactgaaaagacaaaaattagccgggtgtggtggcgggcgcctgtagtcccagctgctcagagaggctgaggcaggagaatggcgtgaacccgggaggcggagcttgcagtgagccgagatcacgccactgtgctccagcctggacaacagagcgagactccatctcagaaaaaataaaaaataaaaaaagaagtctcctctttccttactctagttatgtagctcagtattaagcaacagaaaatgagactcatcgtagactcagcatagacccatcacagacctgtcagaggccgattgtaagctcgctgtagacccatgatagcagacccgtaggtcactagcactggatcaaatgcaagcttataaagcattgtatacctctattctatttgtggtttaggtcacaagctacctaactaagaagtttgctgaactacgcagccccaatgagttcaaggtgtacatgggccacggtgggaagccctgggtctccgacttcagtcaccctcattacctggctgggagaagagccatgaagacaggttggacgctctccttgtggatgatgccgcgcagggcccttcgcacgtctgacaggactctgctatatcgcgtgggcgtgtagctatgtcgggggcgctgctgtatcgtgggggcgtgtagttaagtcagcatgaggacagctagtgtgtgggatgagcctggacccctggcggaccttgaacgcgggcttgctgtccccagggccttgcacagcatctgactgagtgctactgagtagtggtctgagacagatccccagccttagggccccaaagctcaccgtttattttatttcatttccccccagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtgagagtccagggtgcggcccaggttggcgtctcctgcacagcgtccctctcgccccttccccttccccccgtgtgcagctgccaagagaagcaggtgggggtgatggccccgtgacctgccctcctgtatttgtgtgaagtgggaacttcagatgggaggcaggacgaggccttgcaggagaggggtgctaaaaacaaggttcatgcagtgtttatctctgcacttcatctacccctctctccatttcctttttttcctgttcatttttctgtttcctttttgaggaattgcagtgtcattgctaactgcacacgttgctgctttgacacatccctgacttgggcggacgtgatgggaattcttcccacaacggggcgggtgcagcctctgagccagccttgggagcaggaggggcccaccaggcaggggtcttgggtagttccgggggaggcctctggcccctaaaattgctgaggagggcagaaggcaagaatgcatcctggggtaaccaaggcagacgatcaaggactaagacagaggcaaagaccctgcaggaaggagggaggggtgacagagacctggctgcgaggaccagtggggaggcctggtcttcagaaacaagcggataatgggaggagcccacgatccgagcttgacgtttactaccggggcactaggggaccaggattggtctctgggctgggcagtcagactgaagctgcacttgagaaccggggtgctgaattctgaaggcaagcagggctcagggcccccaagctgggatgggggatgctccccaggaagaaggcagagtgtgtctgggctcgggaggagtcaccccacacctgggtgttggctcacgacaccagccaacacaatgatgtgttcctctctaccaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctct

SEQ ID NO: 38196 - DNA, 9247 bp, Homo sapiens
ttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttaaaacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggccgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggtacacgcgagggctggggagccggcttacgggctctgcggggcgcgccatcgctcttcacgccgcttaaaccgcactcctggtctcctaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcggtgggtaacgagagagctgaggggaggaaggaggcaagctccaaaagcctgggaagggcggttcccgtttgtctgaggttttctcttggccctgtacccgtgcaggccggcctgagaacctggtgctgttgtggcaaacactctgggctggagttcaggttacctggatccttgtccggccctgctaccaccaacctttgcgtaatcttcgacaaagcactttcttttctttcttacataaaaagggagcacatctatcttttctacttacagaattattgtgagaatttagcttcataactagtatatttaaagtagcttcataaacatcagagtacgttattctttttgagggtcagtgcctggggaaagaactctccactctgcattctgaggcgggcagagtgatagatgatcaaagtactgctaagtagtgttgcagcagatgggtcaggtaggctggaaggggtagagacacgtggacacagtgatgtgcactgctggctaaagtctttaattcatattcttacagacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagaggtgggtaaaagcagcaaagctgtacctgaatgaagctacacagtgttgtggggttgggtttgtgtgtggcaaaaaagagagcaaatccagggtgagatcccagctgctacattctgcctgatactgatgtcttgtccacctccagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctggtaaggcagaggtgggtgtgattcctagtggaaacatctgtgagtaggagttgggacgagagcggggtggctggaagccagttactacaattagcggcccttggagctggaatctgattggattctttcatttcagtcacttgccccggatttaccaggcttttctcatgtcagctacttttaacgaggacgtacaagcactcaaggagctgatattacataacccggtaagaggcaccatggaagtgtctggagctgcagacatgggggcactcaaagatcttgatgctccttcttaggggattctttggtgttttgggtgggacagttgtcacttagtgtctcatccctggtcctgaggcactaaaagccagtggtctaaaatcactatatatttccaagtgtccacaagggatgtctcccatttcaggccatgctttgcctaaaatcctgagcaaggacctcccctaaggggcagctttgagcagcagagccaaaattctaaggccaaggttctcatcttaagtaaactttacctttcagaaggcctgttgctgtaggccttcccttctcaatgtagtcctttattgatgtgtttctctttgttctgtgcttggaagtattttatatatggtttatatggtatactctatataccacaacaataagggcattttggggttttaggttacaaaactggaggagagttagggtgccaggaatccttaaatgcatctctgccctgcactaaaatgttgatgctttggttggtgagtaagtggccatacatctctgtgttcttttcctttctgaccacaggcctgttttctcccccaggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtctgccacagccaacatcttggttgaaataagttgaagatagagatggaaaggggacccagttaatgttctgtttcttaagcacttagtaggggccaggttctagatgtgactgatactgacttctcccaactccaaaatacctatcatggccgggcaccatggcttatgcctgctgtaatctcagcactttgggaggccgaggtgggcggatcgcctgaggtcgggagttcaagaccagcctggccagcatggtgaaaccccgtctctactaaaaatacaaaaattagctggacatggtggcaggcacctgtaatcccagctactcaggaagctgagataggagaattgcttgagcccgggaggtggaggttgcagtgagccaagatcgtgccattgcactccagcctgggcaacaggagtgaaactctgtctcaaaaaaacaaaaccctataattatttccagctgaggaaactgaggcacaatgattaagtagggaaagagattaagaagaggaaaaaggaaagggtgatggttactgtgatactagggatggcagaggggccttgagcttgctctgctgagctgattctctgtccgctcttggctgcaggtgccacatcatctcacagttcaaccaaggcttctacgactgtgtcatagcaactgatgctgaagtcctgggggccccagtcaagggcaagcgtcggggccgagggcccaaaggggacaagtgagtccatgcctctttttccatccctccccagaaatgcctgtgtttttagctttttggaagactaaaaccagagtgcacagagcagggagccaaaccttccaggcctggctggtagtgtagcccagagagccccacaggttcttgctcagctgcctggatatagagaagggagtggatggtgcacactgcacatgcaccacgaagggcaaaactgccggggttgttggcatgcagagccctgcaggggagatggcccatcctgcattggtggtatggctgtgacttgcagggagcatatttctgaagggaaaaggaaccccccaactctccagtctctgtccagctgaaggcttgactagctcagagttggttttcagatcaccatgtagggcaatgagttctgctgttgtcccagaacagaggtcaggccgagatttgggtacatgtcaaagctccaggctgccccaggaaaccctgactcctggaacggttccattgttggagagtcctctgtatgtcagggtcttatgatctacaggcatttagaggaagttttgctgattcagcgtgtgaatacgtgcccagaggagaggaagggtccggctgacattgagttatctctgcagggcctctgatccggaagcaggtgtggcccggggcatagacttccaccatgtgtctgctgtgctcaactttgatcttcccccaacccctgaggcctacatccatcgagctggcaggtagtagtgtgacggcccaggcatctgcatggtaggcacactgagggacttggggtgtgctggacagagcctgcgggttggagatgcaagctgcactgtcttcccttgcaggacagcacgcgctaacaacccaggcatagtcttaacctttgtgcttcccacggagcagttccacttaggcaagattgaggagcttctcagtggaggtaagagcctggctcttgtggtcctgggccagggtcaggcttcttccacaatgctttaaaactccatgataatgatgacagaggtcacaacatagtgtgacaggccacttccaccatccatccttgttctgccctgagtggcaggcactgtcccccttgagagataaacaaattgaggtaatttgtccaaagttgtgtttactgtctgcctcatgagcgttgagtgacctgacaggctgctgtgacagctcaggacagcacctgaccccagggtgctgggtggtcctggactgctctctgtggccgtcgtcatgggggtaccttgactcccaaggaataccatggggtactccttgggagaggagaagagagtgggtgacgggttcttgggcttggggccacacaggccacccccatccacacacggggacagatgggtcatcactgtaagaggcccaggtgcagctaacctgcatgttcggcatcccaggaaggcggtgggtcccctgctgctttcccccaagggggaggtgcaggaggcctccaatgaagaccctatcctaaggcctcagcctgtgggaccctcgctgctttcttctccacagagaacaggggccccattctgctcccctaccagttccggatggaggagatcgagggcttccgctatcgctgcagggtgagctgctgtggtggggaggggaatgagaggggaggggctgtggcccagggattgcaccgtcttgctgagcatccaggtgtgaagggaggatttggggcagcctcactgtcttgaccttcagtgtccacccccaggatgccatgcgctcagtgactaagcaggccattcgggaggcaagattgaaggagatcaaggaagagcttctgcattctgagaagcttaaggtgagtggatgggaggtgagaaggggatagatcttagacggctgccctttttggagactggctgagctccgagtggtgagaagcagagaactgggcagttttctggcctttggcacggaaggggaggaaatggacccagaatcatggaaggaagccagtctgttctgcttggtggtaaattggcacaaccttatggtggacactgtccagcagaattacgagctcatgtgtcctttcatccgaaattccacttctggaacttaatcctggtcacgcttgtgaatgtgcacagtcaagcatgtgcctgcattcatccatccatggcattatcatggaaccaaaagatggaaacagcctggggccaccatagggggcttgctaggtaaactcaggtgcattcagagccgaaggttacatgggaaggaatgaggttggttgcgtgtccatatggaacagtctgtaagatgatgcccagcaaaaaggggtacagggtactgccatgtgtgtcatggagaagggaaaatggaaacatccactcccgggaggttctgagaaatgcacagaagcagctgcctcatgccttttgaaacacatgagtgtgttatcctttgaaaagctaggtctgtgaagtcacagaagaaagatgctcactctgtggctctccctcttcccccggcagacatactttgaagacaaccctagggacctccagctgctgcggcatgacctacctttgcaccccgcagtggtgaagccccacctgggccatgttcctgactacctgggtgagtgtggcctgacagggcaggaggcagcaggctggggaagtggcattaatttctccactgctgggtcagcccctgtgcttggtgctggggatgctcaggcagaatagaacctggagaccctggcagcacgcgggcatgtaaacaggcacacccctgtgtttctaaacttgtttgcttggtcccacgggttagctgttgctgtctccattttagagatgaggaaattgaggtagtgcagggtgggtggcagacccagcatttcaggccaggtcgtctccagagctgggccaaatggccatccatgggtcgaagggagtgaacaggtttgggagagagtcacgggcaggaggcagagagagccacctgtgctgcaaaagactcaagattagcagctgctgaagaggcatctgtggagtctctgggtaagaacagtcagcagggagacagactctgtaaggcctaaaccgacaaggtagcaagagaagagccagtggtggtgcgagggatgcaggggttggcaggcatgaggtcaggaccctgggattggtttctgtagtgcagcccaggctagagctttatgtggccattaatactgggcacctctcctcatctttggcaggctctgggtaatgacttctttcagtgtctcataggaggtgtttttggtaatgagtatgtgtgacttttatgcctaaaatggattgaaggaggagagtggtggagaggaggctgtgggcagcaagtgcaggacccttcccaatgccacagggtctgctcagcctggacctgcagccacccagcgggtgtggtgttgctgctatggaggtgacaaagggtggagatggaatgttccagggcaggaaaagcctgggcactgggaaaggaaggatccagaagagatgggaacatgaaaatgccagagagagcggtgggggccgggttcccatgggacagtgagctggaggagaccccagtccaggtcctggcctgagatgtgaggaggggagttgggagggtgggtagggagggagaaggtaaggctagaactttggcctcaggaacccagtctgctcgtatagcggagtcatttgccaaggtgtggccaggaggtttagaagggccaggagaaggtggaaaggtgtcaggatgtgggatgtttgacatttgaaggggagggcccaggtgtggttggcctgggggagtccatggggtgggcgaggtgaagatagagccaagatcaggtgcagctgggatgcggggccccctgtatcggtagtaatgggccacaggtgaagaaactacctgttgacttttatttcagctgcattttctttctttaaggatgtctgtctttttctttcttgttacatgtttgttgtaacaaatctaaacaatataggagagtgatttaaatagtggaagtctaaggtgctcacattctcctggccctgtgcagatgtggtagtgaatagatgtatgtcataggctgccagttgggtcagaattggagaatttgctgcagaatcagcgggagggcagggatgggagcagtagcggtgagcccactgctcaggcaagcatctcttccagttcctcctgctctccgtggcctggtgcgccctcacaagaagcggaagaagctgtcttcctcttgtaggaaggccaaggtacggctcctggggactgcggacagccccaggactcctcccaacctgctcttttgtcatcaccagaatgtggaggcgccttgccctagggaggggaagagagggtgccctagggaggggaagagggggcaccctagaaccgggccccaaaaatctggtgtgggataggggtacttttgcagccgcctgcaggccctgcttttctttccccagctgcctttccccatttccttatctgcagcaccttctggtcgtgttggccagttgccggcacggctccctttgtgtctttctcagttgggtgggtgggtgggtggattgtctgtcggcctgattcccccaactaacctgtgactttgcctccttagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccc

SEQ ID NO: 38197 - DNA, 19436 bp, Homo sapiens
gcgggcttaggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccggtgaggcgaccgggtcgcgcccgagccgcgcggggctgaggggctgggagggccgctgccggcggggcctcgcgccggtcgttgcgggtaacgagccccgtgcgctgtgctcgcgccggggcgggtggcggggttctgccgtcggcgccgcctttgtgccgcctggcgagccctgcgcgccggccccacccgggtccctgctgctctccattcattccttccacggagtcaggggctgaggaggccggggctggtcgcccctcggagcacggccggttttcgttaatcggaaccttcggggagggcttcgctttctcctgtgtgcatcccggctggtgcatccccagggtggtgggcttggccccccaggtgcccggggatcctttagggccccatgcatggtcaggtcctattgtcccattgatgggccacgcgctcctgtctctcccccgtggcatgcggttggtctcgctctcgcgcgcagccattggatccggagaccggatcgatcaggtccggcgggctccttaccctcgccgtgcccccactccttattcggacctacctgacaggtgcatgtgtggtcgagcggggctggtcatcgcgacccttcaccccccattgaggacccaatcgttcttcccctcttcgaagtgcctcccctcttccaagtgtctccccttcctaacaaaggaaagaccccttctccccatccctgcgctcatttctaaggcggggggcgggggcgggcgcggggaacgagccaacccgagtgggttttctgcgcttaaaccttcggaccgtggcctttgcatcctaccttcgcttcctcctttgacgtttgcccagtgagttcatccctggccctggttcccttgcaggaggaggtttcttgttcttgggcggggccggagacatccattgtctctaacgtggtagcgctacctgggaagcgggggatttttcttgcccttcttcccactgctttttgggcttggggcactgggtacagtgtttggacaggaacccttttccaagtccttgcttaacttacttggtggaagggtttggattctgtggaaggtgtccacattgtctcagctaattgcacactgttctttaaggtgggttacagttatgtctgggatcctcttcaaggcttggaagaagcttaaatcacttttttgagcatgtattttacatcgattatgacctgcattcatgtgtggctaccctcggggtcctggccaagtggcacaaagggagccattttgtggggctaagaagacacgtgaaatagccatatctcacaggggttagagaacttgggaacaaaaagcacgcctcactcagcaattgagccttaggaggaaagcatgggaaatgacattcctttacaactcaatactttcaggtttacaaggtcaaaaagactaggtaagattaaaaaaataaattggtgattactgggaggatggggtacttaagtagcacagacctaggaaactggtcgctccctttctgttttctttccaatgagatgatttcttcagagaacaggaagagattgagccttggtttttcattttgtgttacgaggccaactttctgccggttagacttcagtcgtcggaatgataatgtgtaatctggggttttattctttggggttgagttgatattagtgttttgtaaagaatttcagtaattaggtcaaatgaatcctcacacttagtttttcatgtgtacatttgaaatgtgagacaaatgagttctgatcctgtgaaatgaatgtttaattcacctttcgtcatcaatttccctccaatattatgctctagggactgtagtagcattgtcattttattgtctctctaccttccctttttctatattctcacctaattctcataaacttaattttgtccagtaatgttctcctggccccataaactcgttataaatttagtctggtagggaatgatctgcaaagatatacagaaacttcaggattttaagagagaagaaagaaaaggagcaattttttaaaaattgctatttacagtacatggacacatttttgttcagtcttaaatatataatcctgatttagttgtcgtgtatgattctgaaagaatagtaggatcctaaaacattgagatactttctgccttatgatctacatcctttgtttggggatatctcactattacaaatggtctctacaacactgacgtcatccgagttggttactacctgctattgcaggaggaacagagacctttaaaaagtgggactggttagagttttgacttgctcttaagctggtgttcgggtactagtgtctttttcttgattttttttttttttttgagacgcagttttgctctttttgcccgagctggagtgcagtggcacaatctctgctcaccgcaacctctgctttccaggttcaagcgattctcctgcctcagcctcccgactagccgagattacaggcatgtgccaaaacgcctggctaattttatatttttagtagagacgggttttctctatgttggtccagctggtctcgaactcctgacctcaggtgatccgcccgcctcggcctcccaaagtgctgggattacaggcgtgagccactgcgccctgccttattttttttaattaatttatttttttgagacagtctcactgtgttgccaggctggagtgcagtggcatgatctctggctcactgcaacctctgcctcccgggttcaagcgattcttctgcctctgcctcagcctcctgaatagtcgggactacaggcatgtgccaccacgcccagctaatttttgtacatttgtagtacagacagtttcaccatgttggccaggatggtcttgatctcttgaccttgtgatctgcctgccttggcttctcaaagtgctaggattacaggcatgagccaccgctcctgaccttaattttattattattattattattatcattattattttgagacggagtctcactcttttgcccaggctagagtgcagtggtgtgatcttagcttactgtaggctccgcctcctacagggttcaagcgattctcctacctcagcctccggagtagctgggattacaggttcacatcaccacgcccagatagaagtgctaaatattcttagaaaaatgtttcttggccgggcgcggtggctcacgcctgtaatcccagcactttgggaggccgaggcgggcagatcatgaggtcaggagatggagaccatcctggctaacacggtgaaaccccgtctctactaaaaataaaagagttagccgggcgttccggcgggcgcctgtagtcccagcttctcgagaggctaaggcaggagaaaggtgtaaacctgggaggcggagcttgcagtgagccgagatcgcaccattgcagtccagcctgggcaacagagcaggattctgtctcaaaaaaaaaaaaaaaaaaaaaaaagaaagaaaaatgttgcttattcaaactgccttatgaagaaacaaaaccagaccactcatatcaccagtaaaggaattgaatcagtagttagaaagtctttccatattctgcaattacacaggcagtaagaaaacaaaaaaaagaagttaaaaaaaaagttggctgggctgggtagctcatgcctgtaatcccagcactttgggaggctgaggcaggcggatcacctgaggtcaggagttcaagaccagcctgaccaacatggtgaaaccctgtctttactaaaaatacaacaattaggccaggtgcagtggctcacgcctgtaatcccagcactttgggaggccaggcgggtggatcacctgaggtcaggagttcgagaccagcctggccaacatggcgaaaccccgtctctactgaaaatacaaaaattagctgtttgtggtggtgggcacctgtaatcccagctactcaggggctgaggcaggagaatcgcttgaacccgggaggcggaggttgcagtgagccgagattgcaccactgcactctagcctgggcgacaagagcgagattgtgcctcaaaaaaaaaaaagaaaagaaaaaaaagtatttctataaaaccacctgcattttctgttttgagaggtggcaagaggagttaaattgagtttttccaaggaggagacaaattggtcaacctatggcagaaagatttggaaatgttaaaaaatatattaccatgttgaacagaaagctacagatgatattcaaaggaacactgatatagaccatgtcatggaatcttatacttaattgctcatactgactttgccctcatgggtagttacttatgtttattgtgagaatagtgaggtacaagtatgtaaatggctttttagtgaggttgagatagaagagactattatcagctcttcttgggcttctaaattggtcaagctgacttaagtgtgtgtgtgtgtgtgtgtgtaagtgtgtaagtgattagagatggggatctcactatgttgcctaggctggccttgaactcctgggctcaagcaatcctcctgcctcagcttccagaatggctgggactataggggcctgctactgatcgtgcccaagttatttatctagttgaaaataagaaggaagtgattttttaaaatttatttactttttttggctgggcgtggtggctcatgcctgtaatcctagcactttgggaggccgaggtgagtggatcatgaggtcaggagatcaagagcatcctggctaacacggtgaaaccccgtctctactaaaaatacaaaaaattagctgggcgtggtggcgggcgcctgtagtcccagctatccgggaggctgaggcaggtgaatggcgtgaacccgggaggtggagcttgcagtgagctgagatcgcgccactgcactccagcctgggcgacagagggagactccgtctcaaaaaaaaaatttatttactttttacattttgagacagagtcttgctctgtcacacaggctggagttcagcggtgtgaacacagctcactgcagccttgacctcccggccgaaacgatccttctgtctcagagtccagtgtagctgggaccacaggcatgcgccactacgcttggctaatttttaattttttttttatagagacacggggtcttgccatgttgcccaggctggtcttgaactcctaggctcaagtgatgatcctgccttggcctcctagggtgctgggattacaggtgtgtgccactgtgcctggaaatgatttttaaatgaataataacaagaaatacttctaaacttctttgaaagtatattcagccaagcccagtagagtaaggtccattagatcttttgccatttctgaaaaggggacaccaaccaggctgttatttatgatgagttccatgctgtttcagctgccttgtgtgatcgatgaccttattacaagtattataaagcagtatttagtatcttaacatccagcactgaatgtagacactgatggagttgattcttttttcctgttagcagctatctgttgtaggggtgagggagatgaatgggtgaggaaagtgaaatgaaagttgtctgaaaagatttatgccaagaaatgtttcagtatgatctgaagttgatgttttgccattatttgcagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtactcttgttatctgtgctcactgttcaaagggatgggcccagcatcaacagccacagatgcagcttgggcaccagcatgtgcccccgtgtctaaaaaacaaaacaaaacaaaaattagctggtggtagtggcagtgtgcatttagtccctgatactccggaggccgaggtgggaggattgctgagcctgggaggtggaggctgcagtgagctgtgattgagccactgccctccagcctaggtgacagagtgaaaccctgtgtcaaaaacaaacaaaagaaaaaccaactacagctggttttgaactaataacaaaatctagcttacaacagtttagacttagcctgagaggaaagaaatgggaaatactgagaggctgtgtgatggatcagagtaaggactgaagtcagactgggttaatgtttaagtgatcagcttaacttccttaagactgtttcctcatttcataatgtgagactaacacataacgtcaattgctgaagttttttgtttttgtttttgagataagagtctcattctgttgcccaggctggagtacagagtgcagtggtgccatcttggcacaccacaacctccacctcccgagttcaagtgattcttctgcctcagcctcccgagtagctaggattacaagcatgcaccatgacgtccagccaatttttatatttttagtagagacagggttttaccatgttggccaggctggtcttgaactcctgacctcaggtgatctgcccgcctcggcctcctaaagcactgagattacaggcatgagccaccgtgcccagcctgaagtgttttgctttaggttttttctattgtatttctgaagaaagtatattttgatttttaggtgccaagtctagtggtggcagggaagacttggagtcatctggactgcagagaaggaactcctctgaagcaagctccggagacttcttagatctgaaggtcagtgtgacagcatgaggccagaaaggctttcaggtcaatatgattctgaaatttgtactaagagtttcagttcacccactggaattttacattgaggtagttaggaaagggactgggccatattgataatggaagattgatagtaaaatcatagaagtgtgttaacatggtctcagtctgtttctgtatctcttttaccattaggatttgttttatctcccctattgatttttggaacttgtggatctttctcacttcctgtgtgtctcatatatagaagcatttctgagttcagaactgctttgcgttgaactccaggagactagtgctggcattaccattggttgtgtctgcagttgaatactgccaccaagccccccagggggtgtgctgcgaagtggaaagaccccgcccgactaagcactaaagccctcagagcacagtgaggcatcacctgtctgagtggggagagaactggagaagggctttggaactgataggggtccttccataactattatctagtttccccttatcggggaaaggagagagaaatgaaaggagagatttaccagttttccattctaataaaagatctctgaagtgctaattggtgttaggtcctcagaggaaatgttggggtttgttgtagacgtggtactagcactagagcaatttatcatgcagaatttttgcatagcattgtcctgagttggatagaggtagcagactgaccctgtgcttgattgcaacacaatgaaatgtcacattcggtttcaagtagatgttagctgctatgaactatgactgttttgcgtgttccaaaattaaaataggaagtaaatttttgaatttttttcttttctagggagaaggtgatattcatggtaagtacttctgaagaccaaatttctggctctgtccatggttttaggacagatctgaatcttgatttaaatcatgtcttggggaaagagactggggagtgaaacctggccatgccccaagtgccgccatactctaatctgccagtaacgcgatcaatgctagaaacataatagaagggaaaaaacagagaatcctttaaaattacatatattggctgggcatggtggctcacgcctgtaatctcaacactttgggaggctgaggcaggcagattgcttgagcccaggagttcaagaccagcctggaaacatggtgaaaccctgtctctataaaaaagtacaaaaattagcctagcatggcggcacatgcctgtagtccagctactcgggaggctcaggtgggaggattgcttgagctcaggacgtggaggttgcagtgagcagagatcacaccgttatactccagtctgggtgacagagtgagaccttgcctgaaaaaaataaactaaaccaaaatatatctaaacacacacacatacatattaatcaggtcagtatttgttacacttaatgagagcttttttttttgagaccaggtgtctctctgttgccaaggctggagtgcagtaggcaatcacagcttactgtggcctcaacctccttgggcttaggtgatcctcccacctcagcctccctagtaactgggactacaggggtacaacaccacacctcgctaatttgtttttatttttagtagagatgaggtctcactatgttgcccaggctggtctcgaacccctgagcttaagtgatcctcccacctcagcctccccaagtgctgctattactggcaagagccccagcacccagctgagagctttttgtatttatgtagctatttatcacagactagccaagtgcagtattgagaagaggggaaagagtaaaacaaggaggttgatctgtaactatgaacaagataactcactaccagccagagagagctttttaatataaccatttcaagctcagctcacagcatccactttacaaagttcatttgtttttatagggagatgcttattcagcaagacattggttacctgcttggtgattttgtaaatgatgatttagggggcagatgtaaattttcagctaaccaaccatattacgaattataggtggaaatgagctgtaatcattgacttaattatcttaaatcttggaggtatttattggcatttctgtaacaagtgctaaagacttgccgatgagtgcaaggtttgtaagtgtcaggcagtagcagtcagtgaagtgcagcagtcacaaggccctctggtctagacagaagcagcagcttcctcttaaggccttttcctacccttatgttttgtggtgtgcttacaaggacacacggaaaggttgaagaagcagattcctctcctgccttctcacacagtgttctgtttttttggttgtgttttttttttttttttttttttgagatggagtctggctctgtcatccaggctggagtgcagtggcaggatctcagctcacttcaacctctgcctcccgggttcaagcacttctcctggctcagcctcctgaatagctgggattacaggcacgcggcaccatgcccggcatgagccactgcgcccggcctcacagtgtttcttggtgggcttagaggagaagctcctgagcctttgggagcattgcctgggttcttccttataggacctgtttagggggaaaacactcaaacgtgtttttcctctttttttcacaccacaacaatcatcaacacagaagacgacacctgtgaccaaatatggggggtttctccccacacgccaatcagtggacaccagttgggagtcctccaatccagtttccacaccctctgcctgaagataacctcagattcagcaggttgagggtcagtcccacaagactgccccttccttcccaccagttgtaagtctgggcctctggaacttctgaccgactggcttcaaattggggttcctgtgaccccttctatggttttgattaatttgctagagaggttcacagaaagaactcagggaaacacttatgtttacaggttcattatgaatatatgatacatttttttttatttttttctaaactgaatcttgctctgttgtccagactggagtgcagtgtcaccctcacagctcactgcaacttcaaactcctgagctgaagcaatcctcctgcctcagcctcctgagtagctgggatacaggtgtatgccaccatgcctggctaattttttttctttttttgtagagatgtggtctcactatgttatgttacacaggccagtcatgtgatcctcccacctcagcctccaaaagtattgagattacaggcatgagccactgtacctgggttgttacgaaggatatttgaaaggatacaaataaacagcccagtgaggagatacttggggcctggtatggaaaggtcccaagtacaggagctcctgtaccttggagttggggtgtgccaccctcctggcacatggatgagttgttgcaccttcctgtcagcttccacatgttcagttatccagaagtcctcagaatccatccttctgggtgtttttttaagactgggttttggtcttaaccaggctagagtgcagtggcacaatctcattgctcactatagcctcaacctcctggactcaagcagtcttcctacctttgcctcccaaagtgagccactgtgcccagccccttttgggtttttcttttttttctcgagatggagattcgctcttttttttttctgagatggagtctcactctctgtcacccaggctggagtgcagtggtgccatctcagctcactgcatcctctgcctcccaggttcaagcgattctccttcctcagcctcctgagtagctgagattacaggcatgcaccaccatgcccaggtaattttttaatttttagtggagacagggtttcgccatgttggccaggctggtcttgatctcctgacctcaggtgatccaccctcctcagcctcccaaagtgctaagattatgggtgtaagccaccatgcctggccaagtttcacactttttgcccaggctggagtgcaatggcatgatcttggctcactgcaacctctgcctcctgggttcaagcaattctcctgcctcagcctcctgagtagctgagattacaggtgcacgctactatacctggctaattttgtatttttagtagagacgaggtttcaccatgttggccgggctgatactgaactcctgacctccagtaatccacctgctttggctttccaaagtgctgggattacaggcatgagccgctacacctggccccttttggttttttatggaggcttcattacataagcatgattgacaactgtacagaaatacgattagacaaaaaaggtttgatttcataccaatggactgaacaagggaactcagaaggcccgtctgttagattcttcttggcctctccatgtagcattccctcctccagggtatggagcaggaccctctggattaagggtcttttgacctgccatcagattacagtcctgccctgggcaggtaaaaggaggacaggaggtcacaaagagattctgtttcctgagggctgctcctgaggcttaatgcaccccattcaaaagacttttaagggctatgggagttaccagccagtagctgtggacaaaaacagattttgtgtgtgtgtgtgtgtattttcatatacgtatgtatatcataatatcacaggaccagttacttttgcattggaccgaagatgtatgtattaattactgtttgtgttctatttgtactgttctggaaagacttctggaggtaaaatctaggttttttgattccacttcttgcttccttccttcttccctcctctcccttcccctcccctcccttctcatcccttcccgttcccttcctcccccttccctccatccccccctcccctccctcccctccctcccctcctctctcccccttcccctccctccctccctctccctccctctcccctcccctccccccttgacggagtttagctcttgttgtccaggctggagtgtagtggcacgatcacggctcactgcaactccacctaccggtttcaagtgattctcctgcctcagcctccctgcgtagctgggattacaagggctgccaccacgcccggctaattttttttttattagtagagacagagtttcaacatgttggccagactggtcttgaactcctgacctcaggtgatccacctgccttggcctcccaaaatgctaggattacaggcgtgagccaccaggcccggccggttctactgctttctatattctgaatactttcactgtcagaccttatttaacaagaatcagctaatctttattcaattattttggtcagttaatacaactagaagttaggggaacttggagaagtatgtcaacaatgtgtcaatagtcctaccacataattaataattctgttcccttttcagtccccttcacagtttttgttttttcgagacagagccttgctctgtcacccaggctggagtgcagtggtatgatctcagctcaaggcaacctccgcctcccaggttcaagcgattctcccgccttagcctcctgagtatctgggactacaggtgtgcgccactacagctggctattttttttacttttagtagagacggagtttcaccatattcaccaggctggtctcgaactcctgacctcaagcgatctacccaccttggcctcccaaagcgctgggaggcatgagccactgcgcccagcctcgctcaactaattttttttatttttagcagacacggagttttcgccatgttggccaggctggtcgcaaactcctaagtcctttctttttccccccagtggttatctggttacctgttgttgttttttcctttttgttttttttgagagtctcactctgtcgccaggctggagtgcagtggcataatctcggctcactgcaacctccgcctcccgggttcaagtgattctcctgcctcagcctcccgagtagctgggactacaggcatgcaccaccatgcctagctaatttttgtatttttagtagagacagtatttcaccatgttggccaggctggtctcaaactcctgacctcaggtgatccccctgccttggcctcccaaagtgctgggattacaggtgtaagctattgtgcccggcctttttaagtttctgatctgatatattctgtgtggctgactgctgcaactttagttcatctgtcttaaaatgaaaaggggcacaataatatttttttctttactgagacaggttctcactgttgcctgaaccacgagtgcagtggcacaatcaccactcactgcagccttgacttccgggttcaagccatcctctcacctcagcttcctgagtagttgggactacagttgcatgccaccatgcctggctaatttttgtggttttgtttttgttttgtttttgagatggagtcttgctctgttgcccaggctagaaatgcagtggcatgatcttggctcactgcagcctccacctctttgattcaagcaattctcctgcctcagcctcccgagtagctgggattacaggtgcccgccactgtgtccagctaatttttgtgttttcagtagagacaggatttcaccatcttgcccaggccggtctcgaactccttacctcgtgatccacctgccttggcctcccaaagtgtcgggattacaggcgtgagccaccgtgcttggccaatttttgtagtttctgtagagacagggttttgctatgtttcccccggctggtcctgggttcatgttgatcttcctgccttggcctcccaaaattctgggattacaggtgtgagccgctgtgcctggctgaggtacagtaataagatacatctggaggattaaaggtcaaccccaattcagtttaaataagatagattccctttggatatacgggaaatttattttacctcttgggcaattaaacgcaggaatggctacaggaatgactttggagtttccatcttgagaaatctaagagggagaaggtccaggaagttcaggcagagaagtctccctgactgcgggcaagttagatggtcggctacatttcttccagttctgattctttgatgcttacaatgaatcattttctattcagatagagatgtctttgttcagttatcttattgatgtgccaaagaaaagagaccaggagtgtctaaaatgtatattttggtagaaataatttcatttaaagccctttttttttttaaattatcttcagcagacaaaagctttctgtgtcaaattggcataaaagtttctaaacatttggctgggcgcggtggctcatgcctgtaatcccagcccttcgggaggctgaggtgtgcggatcatgaggtcaagagatcaagaccatcctggccaacatggtgaaagcccgtctctactaaaaatacaaaaattagccaggcgtggtggcacgcgcctgtaatcccagctacttgggaggctgaggcaggagaatcgcttgaacctgggaggtggagatagattgcgccactgcactccagcctggcaagagagagagactccatctgaaaaaataaatcaaagtttctgaacacttactctcaattcctgtacttatctcattatgggctggaaacaaacaaacctccctcctctgtgggtggagtacttctgactggacagacatttatttatttttgagacggagtcttactctgtcgcccaggctggagtgctgtggcacgatcttggctcacttcaaactccgcctcccgggttcaagtgattctcttgcctcagcctcccgagtatctgtgaatacaggcgcgcacacacgcccagctaatttttgtacttttgtagacacggggtttcaccatgttggccaagctggtctcaaactcctgacctcaggttattcagctgccttggcctcccaaagtgctgggattacaggtgtgagccactgcacctggcctggacagacatttaaagtaaggcctactgctgcttgtttagtctccataggtgcttttttatttttttcttcttctttattagtatgttatgtatttgtgaaaaacaaaacagttctagtaataatgtaagacaaatataagattagtagtattgagcttgattcatctgaagaggattttatgaaaataaaccactatggcaggactgcaagataattttttgttcttcagaatgttcattaactgctggattcagagagagaatgaagacttcagtagatcctgtatgtatagcaggaggccatgtcccaccagcagaaatgaaactgcttgaactaacaagttgtctcagtccgaattctctttatcttgaatattttaaatgtggagttttgtttttcttttatatttacaattatatttaggttatttcagggacacttattgtaggacttgtgtgtctgatccagtgcatttgatcttgcttcttttacaatggatgtaaccaaggaaactaatgggtgaccctctctgagttttagttcataattgtgacagttgtcattctgaaaagcttcatactctatttttgcttgtagttaaatagtatagaacattttatgttactcccatagaatgttccagaaattcatgaaatgttaaaagcagcagtagtatgttaacattaacaaagcatgaaaaataaataaataaaataaatgtctgtccaatgagaaatactgcagccacagaagagggaggtttgtttgcttctagcctatcatgagataagtacatgaattgagagtaagtgttaaagacctcttcttggccgggcatggtggctcacgcctgtaatctgagtactttgggcagctgaggtgggtggatcacttgcggtcaggaggttgagacaagcctggccaacatggtgaaacctggtctctacaaaaatacaaaaaattagctgggcatggtggcgggcgcctataaccccagctattgggaggctgaggcaggagaatcgcttgagcctgggaggcggaggttgtggtgggccaggatcacgctactttactccagtctgggcgatggaatgagacacagtctcaaaaaaaaaaaaaaaatccattaatataggagcattattaactgcccttactgccttttcaggcaaaagggattctatgaaatatttttacgaatatcttagaatatgcaactgaatttgattggttaacactgaaataaacttgctattaaaaagaaaactaaggcccagtatggaggctcacgcctgtaatcccagcaccttgggaggccaaggcaggttggatcacctgaggtcaggagtttaagaccagccaggccaacatggtgaaaccctgtctctactaaaaatacaaaaaattagtcgggcgttgtagcgggcacctataatcccagctacttacttgggatgctgaggcaggagaattgcttgaacccgggaggcacaggttgcagtgagccgaaattgcactgttgcactctagcctggacaacatgtgtgaaactccatctcaactaaagaaaaaaaaggaaaactaggccgggtgcagtggcttaatgcctgtaatcccagcactttgggaggccaaggtaggtggctcacttgaggccaggagtttgagaccagcctggccaacatggcgaaaccccgtctctactaaaaatacaaaaattaatcaggcatggtggtgcatgcctgtaattccagctactcgggaggctgaggcaggagaattgcttgaacccaggaggcagaggttaaagaccctgtctcaaaaaaaaaaaaaaaaaaaaaaaaaaaggaaaactaggctgtgtgaagggtgaaggtggctcatgcctgtgatcccagcacttagggagggtgagatgggaggatcacttgagtccaggaatttgagaccagcctgggtaacataaggagaccccatcttttaaaaataaaaaaaaaaaaaaaacaaaaatagccagttgtggtggtgcgcgcctgtagtcccagctatttgggagactgatataggaggattgcttgagcccaggagtttgaggctacagtgggctgtgattgaggtactgcactccagcctgggccacagagtgagaccctgtctcaatatcctccacctgccaccccacccctccacaaaaaacaaacaaacaaaaaaactaaaaatatgtatactattaagctcttagtaaaagtttcctttcatagaaaatatagaatttttgcattcactttgcactttgaatcagttttttcccggtttagaaacaaccctaatgagagacaattcatttggaaaattggatgggttccagtttttttgctgtcagagaattggataaatagcctatatcatgtgataattactataaagcaatgaagcttgacagtgaggtgagggatttgaaaacatacagttaataagcaaggcgaattactaccctgtttgtaaatatggatacatttccaagagtgaaaaaaagaagttgataccatttatgttaaatataaccaaaacatgttacatgttatctggctacatgtaaatatacataaaacaagtggactagaaggctgcacaggacttgcagtgggacctctgggaatagggggagcaggatccacccggagctggaaggggccgtagagctagagttccctgttcttatttaaaaatcttcatgtccttgggccaggcgcggtggctcacgcctgtaatcccagcactttgggaggccgaggcaggtggatcacaaggtcatgaattcaagaccagcttggccaggatggtgaaaccccatctgtactaaaaatacaagaattagccgggcatggcggcaggcgcctgtaatcccagctactagagaggctgaggcaggagaattgcttgaacctgggaagtggaggttgcagtgagccaagactgcaccattgcactccagcctgggcaacagcgagactccgtcaaaaaacaaaacaaaacaaaaaaaaacttcatgtccttatatatttgtgtaatttagaaaagaacataaacaacaaatatgggaaaagatgaacaatggttaattctgtggagtgggagcatggtgggtgattattttgtttatgcttttaggtatgtttccaaccatcaaaccaaaaaaaaaagaaaaagagaaacagatccttgatcttaacaggaaatggctgtcattatgagtattatttctattccctgttttcatagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 38198 - DNA, 57324 bp, Homo sapiens
agatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagtccttcatttattgcagatttttctttatatcattcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaaccaaacatggaacaatgccctggagtataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactaggtgatttttggcatgtaatgcagaagttgcaagaagtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacagctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcaccagaggaccatttttggatggagccattgtctaatcatgagctgaaaggcaaatatttaaaatgcaaacatccatggttaggtaacactcttaagaccttattagctgcttaccacaactgagactgtgaagtaatggctcactttctttgaggctcagattccatatctgtggagtggaagcgagtgcttaccatacaattttcacagggctgctgaatgtgtgtatgtatgtatgtgtgtatatatattttaatgaaaattctataatttgattagtttttgtaatgtccgcatgactgagagcttgcttactttttacagcaacttgaaggtaaaaatagattttacaacatgaacaaatgtaactacatatttttatttgaattcagatgttcacaaattgttccttaaagtgaagcatgcctacaagttttaatctgtttaagacctacctcaagtaaaatgttcactgccatggcatgtgagggaaaagggaaataattcttatgcatggccttcaacggccaaatttcatgctcatcagtacatcttctcttggtgtagaactgatgatgataattatgatgatggaaaaaagtgctgttgatagcaatgcctctcttccttcactttcctctaactgaaccgtctcattcccaggcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtgagtgtggctgtttgacttaatatacttggttcttttagtcagggtcatagggatctagtattctgtcagatgaggctttgggaggttggtaagaactgcaggaaggaatccaaatgtagcaaactaagtatagaaattaaggagcaatgcatgactctccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggactgacaggaacacatcactccacactacttctaagagtaaaaattgtagaaattaccctgagcaaaggtgtaatatctcttcagagttgtccacatgtgagatgcttacagcctagtgtcagtaaaatacggggtttttttccatagcctgtaaaacatgcttcgaccatgcccttttagcatgtaatatcagcctggtaaagctcagcgtataattgaatcaagactgtttctgtgagctgtatgaaggtgtgaatctcacttacaacctctcttactgatttattttcctccaccttgtgtcctgtctccccatttgtaaaatggcagaagtgattcctgtccatgccaactttccctgctgagaacaagggagtgaagttaagtaagaagggcaagatctccagggaagagtgcaacagcaaataggggaggagacctgcgggtgctgaatggggtttcaggatcggtcctgtatttcaggtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacaggtatgaagaagcctacagacaggacaacttcaaaaaggaaagatcttcttcccctggatgttccccaggcaaagttcctataatcttggttccttaatagcttgtcttaccagcctacaggcctactttgggtttgggggctcatgaaaaatatttctgtttcagtgaaatttcgtgttgtctccatggatgaaaactttcaccccctgaatgagttggtgagttttctattatctacataaaatgattgtctgtataaacaggctgggaacctgttttttgtgctgagggaagaccagggagaggaagaatctggtatcattaacagtaacttctggcattacaacagcacaagatcctaatctaaaacatcattccaggtaaagaaagtaggtaattctttctgtcttggtgctggtactcagtcagttgtcacacaattaaatttacttttcggatggttcttaattaggacaattagaaagatacattcaatagcagacacagaaaaatcctcaaagaacctaagctcaaaaaacattttaaagatttagattttttctatacacatctaccaaaatcttcactataaaggaaagtcagggtaattaatttgttcctcaagactaactcttggtatctgtgataagaaacagttctttctattgtaatgcagacatcaacccaaagtcttcatttttctctcccaaattaacttcttcacattttcttatctcaaaaagaggcaactcttctcttctagctccaaagacaaaagattatggcctagttcttgtttctctttctctcatacccacatccacttcactggaaaatcatgttggcttaaaatatattcagactatttcttatcatctgaactactgctgcaagctagtcctagtcaatgtcatctctaaataagatcattacaataaccttcaaagtggtctcccagcttctactttcactcctctgtctaaaatgaggcaccacacccatcactctgtcagcctaacttggctttgtttttctatttgcacttaccaccattctatacgtattgatttttaaaaatctgcctatttctattataacataagctccattaaaacatggtttattgttcttttgtgcgtggttatattctcaatacctagaatgatacacagcgcatgagaaggtacttaataaagattagtttttaaaaatgaataaacattcatagtagcttcttatcaatgtttattcatttttaaaagtaatatttattaaactaaatttattaatgaaatatgtccattcctcctcattcttagaactacgtaagaattctatgacccatcttaatgattacatctgaacatatttacttatagttacataagtgtttatttctcaacctgtaaaattgcatagcaaaggattgatcttcactaggatgctataagcacttaagacatgttaatccatttttagtaaatggcactttacatgtatatttgttgctgaaggcctagtaagttcttaacattatttattaattgcttaaaatagattaatgaaaagttctataaaatttaatctggaatatttctgtatttcactatagagggaattattctatatgaaactaatttagattttttaaactttttattgtttttaatttttgtggaaacatagcaggtatatatatttatgggttacatgagatattttgatacaggcatgcagtgcatgataatgattatggatgataatcattatcattatccatatcattatccaatcatggataatgattattatcatgcattgcatgcctgtatcaataaatggagtacccatcccctcaaacatttattctttgtgttacgaacaaatccaattatacttttagttatttttaaatgtacaattaaattattttttactatactcaccctgttatgctagcaaatactagctgctttgcttataaatgagatttaagaatatttgaaaataattataaacttcttttttcttttgtctttcagattccactagtatacattcaggtaagcaacatgaaacattccatattaaaaggaaagcaatacatatagggaaaatgttcttatttcagaggtttttacaatatctcagaaacttgtcattaaaggagaagccttcaaactcccatagagctagatggctataactcatctcctctactcaccctttactactaccccatttgacctttttgtagataacttagggtttccatagatatcttttattagctccaatgctccaggtgcttttgtaagttataattaatttactcatataggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttggtatggatcatgaaaagtcatcaagcattatttttcttcatatttaaactcttaggtcctggaatttaagttcatttggagtctttccatttcccatgggtgacattgggcttggagtagaattaattacacctaagtccaatgaggacatcagtgatctgtgaataggacttcacatagcttcgttattttctgtagcaatatttaataccaacccccaaaattaaaacattcttgttttaatggagttttccataattaattaagcacacagtgatctctcatagtccctcaactgaaatcttcatttgagaggaggatagataagaatagattggagagcagagctaccttttcagagccctaaaatattattagggaactgttacagggaacctgaaaataggaattcccccaaagttgaaaaccaatcaccaaccttctttatcaccaatcaacagttcttcccaagtttgaagtacaagtaacagtgccaaagataatcaccatcttggaagaagagatgaatgtatcagtgtgtggcctgtgagttcattttttaaaaatcttttgtgggggattatttaaaagagactcaccatttgggatattttaactactctctccgggagcagtggcaacacaaaaattttaagtgctttgacagcatcctcatctgtagaatgttattctcctgttgcttttctatttttattttctttcacgttcttatcagtattattctatcatgaggtaagaaactgtttctagagaggttatgctaataggattgattctgaaagtgacaaaactgcacacacacacacacacaaaatgggaagggtggatagtgttgaagggtattggttctgccttaaccaaaaataaccaaacgtatattagggagataattaacacatggctataggggaaattcaatcatcaacagatcatttacctgaccttgcatgcttactggaaaaatcacttagattcagaatttgtagagataggcatacaactgaaatctcatctaactcactagtccacctaaggcgggtctacatacctgtctgcactgacatttttacgaagagactgaacgtgatttctcaagacagtctgttccaaccttgaaaagtcttgtttcctggatcttatgttcccatccatggtggcacacagtagcagtagcaggaagagcaggtatagtcctgtccaaagatcacacatgtaatacacctactattcagctaggcccctgctccagttctgtctcacagtgatggccaagttcctggttcctcataactggtgtgatcttgcaaatagacatacagaggacattctcaaataggaaaggagacaaatgcacttggaaacccagcaattgtctatgacatatttacgacacaatcccacttttgtaaaaaagtaaacaggcccggcgtggtggctcacgcctgtaatcccagcactttgggaggctgaggtgggcagatcacgaggtcaggagatcaagaccatcctggctaacatggtgaaaccccgtctctactaaaaaatacaaaaaattagccaggcatggtggccagcgcctgtagtcccagctacttgggaagctgaggcaggagaatggcatgaacccaggaggtggaggttgcagtgagccaagatcgcaccactgcactccagcctgggcgacagagcgagactccatctcaaaaataaaataaaataaaataaaataaaataaaataaaataaacaagtgaaactcgatatagagatggctgcacatggggagaggatgatggaagaagagacactatcgtactaatagtttgtattcctaggtagacttgagggcgtttgggttttttttgttctgttttgttttgtttgtttcgtcttgctggtattgtttctcttttaagaacgggtttaagttttataataagaaagacttttttaagataaaactaaaaaaaaacgaggaaaaaaaagaaatgataaaagaagaatgtaaatttcagcatgttgcaatggagatttctataagagccattagtgactcttgtcttcaatattgtgtgagcccagcagagagcagagggaagtacagacagggaatatactgtagctaaaggggagatataaatagctagaaaatggggaggttcagtgtctgctctgattcctttgggaatgttctcatgacagatacacatatgggaagcctgtccctggacatgtgactgtgagcatttgcagaaagtatagtgacgcttccgactgccacggtgaagattcacaggctttctgtgagaaattcagtggacaggtaggttgaacactattttttctagagaatagcgataaaggcattgttgaaaagcagtgagttgcagcatttttctgacgcaggaagagaacaatctagaagagaattccatgttggctattgtaatttttcaaaaaaaatcatgaacttagcacaatgggaattatttatttctcgtaattgcccattgtgagtgtttcagaacgatagacactgagccatctaaagcctccatgggcattcacttctacaaaggaaggaaaaaaccatacacctcttaattgccttagctggccaggccatcagttctgctctctctgtgaacaagaacctatcacatggccccaccaagatgccagagagttgacaaacacagtccccatatagaaggccgcttcccagccacagctgaatattatggaggaggaaccagactttgatgaggagttctaatggtcaagagcagatgtactgtgtatttcaaaatagcaagtggacaggacttgaactatttccaacacatagaaatgatacatacttgagttggtaggcaccctaaatcccgcgatgtgatcattacacattctctgcatgtaacaaaatatctcgtgtaccccataaatatgtataaatattatgcatcctttgtacaaaaaaaattactcctcaaattttaagacatttctatcgcaatatatctagggaatttcagataccaaggaatacatctgtcaattatacatgagatattgttgtgaaatttaatatttagttgctagagaatatttattgtgtcctcgtcatagaaaatgcctacatgatgttgtccccccacaaaaatcacaccggttatctgaccactgatctatttagtataatatgcattatatttttgtattttattttctcccttcttagctaaacagccatggctgcttctatcagcaagtaaaaaccaaggtcttccagctgaagaggaaggagtatgaaatgaaacttcacactgaggcccagatccaagaagaaggaacaggtttgtgtactacatgggtataagagaaaacacaacaggcattgattttcttagccaaataatgaattgtaagttggggggaggtgatagaattttagagacatcattcttcccaaaaataacagatttttttctcttttttcagtggtggaattgactggaaggcagtccagtgaaatcacaagaaccataaccaaactctcatttgtgaaagtggactcacactttcgacagggaattcccttctttgggcaggtggagtattttccagttcactcatcaacccatgtactgttacctaattagcacaatagttatggtttgtgctaaaaccatgcctggttaatgttatcatttaatataaccaaaagtataaaatatcaccaaggcttgattagtataaccaaaggtataaaactacataaaaatagatttattcttctgtaaatttgtgtatgaaatgtatgtaattatcctaaggccttattaaaattagtagagttttccccccttcttttgaaacagcattgtacaagtcactcaatctccttctcatggtttaccaggcagtctcaggtttttatgacattttctcacaagaatctcaaaattcatgctgaccagtttcattacgatgctaacactaactttgtatggaaacaggtgggtaggtggttttaatttttattttgaagtattaaagattctacaataatgtttatttcatggatagtatatttacactatttttctataacaagtatatttctaaaacagtgaacatggggtaaaacactgctatttaaggttctcagatttttgaattatgaattttcatgttatctaccaaaaaaatcttctcttacaatttttctgttgtcagcagatgtgcaaatggatctttatgactctagaagtctgagatcacagttacatgtgcctcaatgtgtatttactgtgtatcattttcttaatgtaaatgttacaggatttcagctatgaagggtgtaaaagaggcatagactcaacaaagtggagtacattctagaaggcttggttatgtcatgacaccaaaatgtattcaacttcctaaaatgaaagtgtagctcatttgtaaatttctcagaaagatagtgtactttgtaagtacattttattgctgttaaatatcctatttgtcataagactctctagctagaagaaaatcagaattatgtgcctattcttgtctttgtacatgcagccaacatttcactggcaaacttagattttgtaaatcaattatgagtactgatgggggtcagcctattgttcttcctgctaccaactgtagcttatactgaaaaagaattgccacctttacaatctgaactggactactcaactgccaatacaatattagcagtaaattagatttggcaacttatttaatactgtgtgcctcttttcaattttatatttttcacatgggaagtgtgtcataaaatctgcctaccttccaaaaggctgaagatctaggttgagaagcagagaccatgtctaaggcaactggagaaacacacaggacaatgtattggcaattgtttacttgtgcacttatgagacttcagacactaatctataggaagttaatggtccactccaaaataggtgtttggggcacaaataaatttagttaatagattaatagattaaaatatttcattatcatattactctagtgctctgtgactctctaagagttatatataataatacacagcacttccaaaatatctagaagacatttttcaggtcactcttgttattatccctatcactctctatcccttcacactgctctgtttttcttcttaggattgattactactaaattagtgtatgttatgtatatatttatttagcatctatctctttcactagacagtaagctctgtgatggaagaaacttcgttttttttcactgctgtgtcctcagtgcctggaaccatgttcaacatagaggaggcactaaaaaatgtgataaatgaatatgtttggtgcctattagttattaccaatataactaatccacagcttttaatcttcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtaagtttggaaagaaattaccaatgacatgaagtagccttggaaacaaggttgcaacctaagggtgagaaaatttccaaactgtgtctagttctatggagagaaaaaaactagcaattagaaaccgattgaaggttaacttttttaaagtttatgaaaagaaggcagtatattgtgattaaaagtgcgggttagactttagcagtgttgctgggaacgtaaaatggcggagccactatgaaaaacagtatagtagttcctgaaaaaattaaaaaatagaattaccaaatgatccagtaatcctacttctggacatatattcaaaagaatcgaaaacggggtctcaaagagctatttgcacacccgtgttcatagccgcactattcacaatagctgagagatcgaggctacccaaatgtccatcaagggatgaacaggtaaacaaaatgtggtatataaatacaacagaatattatgcagcctgagaagggaagaaaatcctgtcacatgctacagcatgaatgatccttgaggacgttatggtaagtgaaataagctagtcacaaaaagaccaatactgtatgattcacgtacatggggtttctaaagtagtcaaagtcatagaaacagaaaacaggatggtggttgccaagggctagggaaagagagaaatggggaattcctcttattggtattcaggtttagttttacaagatgaaaagttctggagatctgttgcacaacagatatacttaatactaccaaactgtacactaaagaataatgaagatggtaattttatgttgtgtgtgtgtgtgtgtttataataacttttttgaaaagtgtgaattccagaatctgaatcagataaagtggttaaaaatactggctcaaccctattttaaggaattaactaaaacctctgtgcttcatttccttatctgtaaaatgattgcaatactaacacctgactcttggggtggttgtgaagattaagtgaaatcatacatgttgaatcacttagtaagccccctttaactgttagatacttttactataaaagccaattctaacataattagcatttagttttaaatatatatactccaaaaattattaccttactttattttgtcttgctattctaattttctccagatgacctgttcataccaatataagttattcggtatagcatgcagtcctctattcatcaagagagatgtagacatgtctatagatacatggatatacaatacatatttaatatatattacataatcatggtaatggaaaacgcctgcctctttagagttttaccttgttatagagaaataaataatacattttatttatttagctttaatagatggcataaaagcacctccctctaatttgaatgtttactcatttcaaaaagtgtcttgaatgctttccacgtgccagcactgtgctagtcttgacaatgaaattattatttctacctgttccctgtttggggtgatcatatatgtgttgtcaccaaaatatacattaagatatgaacaaaatgttttgctcaaggattcactagtgctattgggagctggggatgaaggtagaggaagcctgaaaggagctaaggaataacttctacaggaagaaaagttggaaatataacccaaatagggcctctgaggtattagaatccagattgcagggagcattaaaaatagtcagcctaggccaggcacggtagctcacgcctgtaatcccagcactttgggaggctgaggtgggtggattgcgtgaggccaggagatcgagacgagcctaggcaacgtggtgaaaccctgtctctacaaaatatacaaaaaattagctgggtggggtggcatgcacctgtagtcctagcaactcaggaggctgactgggaggatcacttgagccccagaggcagagattgcactgagccaagattgtgccactgtactccagcatgggcgccagagcaaaaccctgtctcaaaaaaataataataatagcaatcagcctaagatagcccagaagaggtagacttcagctaattcatcagctcagctcttaaaccaatgctttctaccaatgtcttctcagacccctaaggttacaatattttatttattcataatacccattcaaaatccaccctaaaagaggcagctgctttctgaaagcacagttcttccatttctagagattatttactctcctcaatgaagtttcatagctccagtgtctctaattgcacaggtaaagcagtcaaagaaatttcaagcaagctaatcagagcaaaggatgcctccttttatgctcttaagaaatataaatctcaatcccaggaggctctgcagtgtaaagtcacaaagcatgcctacatttgaagcagagaaacaaaatcaggggtccttctcccacttttcattgtggaacaaaagatttctagctactagttaaggtaggacagtaaacttacgtagttttgtgagaacattaatctttatgacgtataatctaaaaataatataatttttctaattcattaggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctggtgagaagggaggttactgcgttgacttcactgtagacaaaagctctctgtggagcaagtaatcatgaagctctttagatgtcattacttcaacttcttatccatgttccttttgaaagtttgatttctcttgaggtgaattattgccggcagggactcaataaaacaagtatattgaagtgagactgaagcgtgttctctctggcacatttaatttctttttatttccttttttgcagataatggcaaagggaggcattgtccgaactgggactcatggactgcttgtgaagcaggaagacagtgagtatttccatcatctctgcattgctgccccattctgacccattcagccttacaccacggaagtatcagaatactttccctttttttccataggtttttgggggaacaggtggtgtttggtcacatgaatgaataaattctttggtagtgatttccgagattttggtgcacccatcacccgagcagtatacattgtacccaatttgcagtcttttatccctcacccccttccacccttccccctgaatccacaaagtccattgtatcattcttatgcctttgcatcctcataacttagctcccacttcctaatagcttagctgccacttcctaatagcttagctcctacttctgagtgagaagatatgatgtttggttttccattcctgagctgggaatatcaggaatactttcaagtaacgagagaccatttccatctaatattaattaaaagaaagttgagggagggaaaacaataatggtttttttctcaccctttatcaaatatgtgttgtcttttttttcagcctattttctttgcgttatttaaaatattggtgtgggccagctatgatggcttacgcctgtaatcccagtactttgggagaacgggatgggaggatctcttgaggtcaggagtttgagaccagcctggtcaacatagtgagaccccatctctataaaagtaaataaataaataaataaataaataagaacaaagggggaaaaataaaatacataaaatattgttgtgtataatctatgcttattccagatttttaaaccataaatattcttgaacctcttctcaaaatgagaattgtgttagagaatggggtggagaaaatgtacgatttcaaggtatgttgtatataccaggtcttgtgctgagtcatttatgtcatttatattattataaatatcttttttccctttcaagatagttatgatttatgaagcattaaattgggtacttctaccgactgaagcggactcttgccatgagcaaatatgtcataatataaacctttgaaggttgctcctagtctagtagactctaaaagataacttgctagaaaagtatcagtaatctactctctcattagttcttgtagcaacacagaagcaccatagcagactgaaggaaacttaatgcaacctctaaagaatctacataggcatcaaaaaataacttctgaaggagcatggtgttcctcttatggagaaagaaccaaatattggctcatagaaggttaaagagcatgtagcatgaatacaatgtgttgaactcttactcttacatctcataacttcaggttctatttccctcttctagtatgaggcctagatcaaatggtagtgaattggatgtcttcatacccttaactagcatcagaacattaggtgggtgagctgaagcttaaagctggtgaaaaatcaacagagtatatgatttatgagaggagagagggctttgatagggtttttttctaaagctagagtccttagaggtaatcatccatttgttacatctactgtttattatgtctgttacatctactaatggaaatagtcattaacctatgatggcttcctctcattctctttgtgccccagtgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtgtgtgttttagatcataaaatcttcaacatgtaaaactagaagttactattgttatcatttgttttacacatgtgaacattagggccaaaagggttaaacaaattccccagagacattcagcaaggtagtggcagagtcacactaagaagcagaatcacttgattccttatacaaaactctcaaacttctcctagcagtgcctcttaccaattacacagttcagagtatgttattcccttcttctatgatgaaacgttgggaaatatgtaagcaagtttttaagactactaaggagccaaaagaaaaatgcaagagcacctagacccatgcatgtcccaccacaattaatgagcaccttgccgtgtatcaaagataaaaatggcatttcatgactagtaatttataagaataattagaaataattctactggctcaagtgattcttgagaatgaaagagaagtgtagggaacaaaaagcttcaggattgacacaatgccaaccctccacgaagtcaagcagagtggttatacattgtacatgaggaacactctgcaaatgcgagtgaatgcatgggtaaacctggaaatttgcttttctgaccttttgttccaatttcacaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtgagttcctggcagcctcaggaatcaagaagggccgtgccaggggctcagagcaaggaaaaatgactggataagtaggataagatcaattaaaattatatttatctaggaattaattgctttgagctctcttgtgggctttcattggtaaggaattatatatatatatatatataactactcacttctgcagttaaaaaaataaacaaaatacaatatattgaatcaaataaaagaatttttaaaaggacaaaatgtgatgaaaattaacaaccaaaaaaggactcgttattcagacacgttaagcttcttgctcaagagcacatagcaatacaaattcaaatcttctgattgtgtcaggacatccgtatatgcaaggctggagagaatacagagcagattgtgaaaagtgctatatgagaagtgcagttatgcaaaataaaagaaaggattaactgagcaaccggggaagccgttcgaaaattatatatttaaaatgtaaaaagaccatacagtacccaaagtccttaaaatcccagagctccatgcaaccagtaataggagttgtcaaactagtttcaacatttcaaaaagcctaacaaaagtgatacatatacctgcactgaggctatacaggctaaatgaaatatcagatttccgtttttataagaattatggctgggcctggtggctcacgcctgtaatcccaacactgggaggccaaggcaggcagataacttgagatcaggagtttgagaccagtctggccaatataatgaaaccccgtatctactaaaaatacaaaaattagtcagacgtggtggcgggcgcctgtcatcccagctactcaggaggctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaaacttagggaaattgaactactatataattgacattgataactgaactctttgaaaatatggagctaatagaagaaataccaaaaggatatgctgaattggaacaacaaaaactagttaatagcatgtactaatagtagtttgctcacatcttcaaatttttaatatgagaccaattgtaataacctcttactgaagctttttctactaccataatttaacaaagagaaatttatatttttattttcctgaaatagaaacttataaaaaaatgtttcttacttgtttgtccttctaatgggattttaactgaaaatattagaatacttctaaaggaagcatcaagtacatttcaacagtaggatctcaagaggatatgtgggaaaataatatacatgttttatacttttataatataattttataattctcaaagaatttttcaaattataacaaccctgatgggtagataaggcagacagtcctatttattaataataaagcagaagctttcagggatttagtagtagacctgagttaaaacaccaactcttctcaagctttgattagtgtcttaccaatgaaacactttgctgctactagtgtaggtcattcattcaacacatttatttaatgcccactgtgttctaggtattatactaagtgctagtagagatcaagcagtgagctactggaaagataaaaatgtatgtctcatggaacttacattgtctgtcccatagatgagacagacaataattatgcaatatgccacaataaaagcagggagaggaaatgagaaatgttaagatactttgagaaagtgtctaatttcatcacaccactcactttgctcatctgttcttgtcaatcagttttaaactcctacgaatataatgcaatgtaactatcacaatttttatgtctgtcttacttctcaccttcaaatggacttgaaagcatcatgcctagaattttacggttaaagttgtatgtattatatgaagatctggagcattttgtttccactaataatacctaagaaaatgccatcgtgtcctgtggagagaggatattcctattcgtgtgcctgtttagaacatgcacccattaactttgctatatactgagtcagttgctcaccacaagataagcacaaaactatcatttccttctatcatctcaaagctttgtgcaatgtcacaaatacagcagacctcgatttttcaattaataaagttttatttcattccagtgttgagtctagtggtggcctctgaactgtgtaacgaagtagtacttagtacttagatgagtacttagatggagtgtttggtttttcctaaaattgttaaacatcttcaaaatgaaaacactgtgtcaagaaaatgatccataccctctataaatcatcaaagcaatgagagcgctcaaagaaagacggatgttcattattcctgttcttttctccttgaacttaaaaaatgtcacaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtccggcctgggcgacagagcgagactccgtctcaaaaaaaaaaaaaaaaaaaaaaaaaaaagtcacaaataagtttgcctttttgtctttcgtatttgtacaggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggtaaactccttatgttgcagatggtctgatcttaagcttcttaaaatattacacatggaaaagagtctgtatttgaatgccttcatgtcctagttgagggtaatgggatataaagaggtaagtggcttctctactaatagcagcagatctgcgaaaagctgctgaactaagctggaactttttggagtattattcaagttttcttttttcacaggaattaattgctctgtgatgtttattaaaatcacatatacaaaataattactgttgaaagagtttaatgaaaagaataaaattacatccttaagtatataaatatcccttctacagatgtgaatgttaaaagtttaatttaagttaactggattgcttgtcaaattcaataaaaagaagtagctacctatgtatattttataatatatatttactgattagatgataattttctttgcaggacatgggcttaaaggcattcaccaactcaaagattcgtaaacccaaaatgtgtccacagcttcaacagtatgaaatgcatggacctgaaggtctacgtgtaggtttttatggtaaacaaaaaattaataaatatatattgcctaatatattcaccaaattttaaattttttaaaagatacaatgtgacaaaaattaacaaacaaaaaggacatgtgagtcatacatattaaggttattgctcaaggtcatatagtaatataaactcaaattctagtaaatggaggtacatgtgttaggctgaaaggaaagagaaagtttccaagcgtaggattagtgtaaacagaaatagaaatgttcacacaacaacactacattctccatcagtcaggtaaaaaagctgttcaacttccccaaaacatcagccaatatttatgttggaaccacacacattcatcaatgacatgagctacttctttgatgaactgaatagtaatcaagcatttatttatagtcccatattgtcaaatcatgattgaggataagttgagtacagagaaaagagggtcaaaaatcaaggaaagcatttaaggagaatcagttggctctatggaattcactatgaagcctaccgcatattttattatttataaattatattgtataatcctttatcagtaagatatatagtaaatttatgcatgtataggtatatatatatatatatatatatatatatatatatgcacaatttttttttccagagagctggttgtgaaatattgaccagcacacccttaatagaaggtgaatagagtgaaggaaactaactgtaatcttctgacacgatagagaataaaaagtctttattattattaaacttttccctcctgtaaactgtttctcaaagccactgtcataacatgtgtgtcagtttttccttgctcctgcagaggagcacaccaatggaaacttggattcctgcccctcttcacggccttgtgtcataacactctccacttagcacagcggcagcagccacataggactccacagagtccttgtgccccacagacaatccaagcctctgtctgccaaagtctctatagcctctgcttatgaccctcctcccccagctcactcctagcttattcttgtttttttttgttgtttgtttgtttgtttgtttgtttgagacgaagtctcactctgtcgctcaggtcgcccaggctggagtgcagtggcgccgtctcggcctcggcctctcaaagtgctgggattacaggcatgagccaccgcgcccggcctctcctggcttgttaagtcaaccaacatatttcctcctcaaagaagctttccttgatgacccaagcgccctctcctccttcctctctatttcatcagacgatttgttttttgttttttttttttggtggcaactattacattctctcataagctttatctgtatgtttattgtaatgtcttcttcctcactcaccatagagtcagatgtaatgggaagaggccatgcacgcctggtgcatgttgaagagcctcacacggagaccgtacgaaagtacttccctgagacatggatctgggatttggtggtggtaaagtaagtaacttcctgcatatgcaatatgcaacaatagaggtccctgactattttcaactctttgctagtttttctgtttttattgttttatatgtttatgatgtacaacatgatgttttgatatatatatatacacatacacatagtgaaatgattactacagtcaagcaaattaacacatccattagctcacattgttacctatttttgtgtgcatagcaagcacacctaaaatctatcctcttagccaagtttcagtatccaatacagtattatcaactgcagtcctcatgctgtactttagatttctaaatttattcatcctacgtaacttcaactttgtaccctttgacctgcttcttcccatccctgcaaccccaaccacctttctactctctgttcctatgtattcaacttcttttagcatccacatacaagtaagatcacgcagtacttgtcctgtgtctggcttatttcacttagcataatctcccccaggttcatccatgttgtcacaagtggcaggatcttcttccacttaaggctgaataatattccattacgcatagccacaatttatttatccattcacccagacacttaggttgtttttatatcttggcaactgtgaataatgctgtaatgaacaccaaaacacatatatctctacaaggtgcttatttcatttcctttgggagtatacccagaagagggatttctgggacatatggtagtttccattttaaaatttttgaggtatctccatactgttttccataatggctgtggcaatgtacatttgcaccaaggggagtgaacaaattccttccagagagacactggaaacagagttttatccgtgaaacaagccagtggggcaggtggagagaaagagccggaatggccatatactccctttcaggctcctggagtcttgtttacttctccctttcactcccagatgcaggctgtttagaagcccaacccttaggagacagccagaaatgggagattttgcctgttctctctgtattgagccaaggggtggtgggggcgggtagccactggcattgctcaaaggcctatttaaaaccacctctgtgttcactgtggtctagggagactcctgattgcagagctccatctactcctggagctaggtgatttaggagccagacccttaggtacgagctgtaaacattggggtgcttgatgcatagacaaattattcccaggggtatgttcagacctggttttatccgtggggcgagccaggggaaggaggcatgggaagtgcccttactgcttttcagccttcctgtaagtctgtcgtttccctgctccttctgcttcccagtgcaggctagttagaagcccaacactcagtcagcaactgataaagtgggtagacgaagcccttccagggagaaactgggagctgttagctaatttttcagtactgaagtacttctttcaaacgcattgctaatttcaggagatgtttaacataaatacatcagctaagaagtcttactaatctaattgcatcagagctaaaaaattttgtgcaaatttaattctaagatttccagaaaatgggcataaggacctaatacaaccaaggactgcacagattgcctgtaagagatccctcactggttagcaatcctgagttaaatacagattcagtcaggcccactatacacaatagtagtagaatttaaaattataaagcagccctcagtgaaatagcattttagagaagagaacttaagaacaatctcaaactgcatgttaaatttataactatattgtctgtaaaagattatgctacaattctgatatactacaattaaaaacagttggaagaaaaggacttatattcccatctcaatccttgattatactctccattattggtatttctattgagtgtttttaagtcatggcagtagaatcattcctagggattctctccctagaaaggatgtatttaactgcttactttctgttcttcacttacactcctctccagctcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtaaggatctctttcctaaattaaatacaaggtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggggtgacaaaagtcagtactctattctcatgacagattctacaaggtttcaacctctacgatctcatatatttaacttttcgtagctcattcattatattaaacctaattttaaaagtcgtttgtgagcatcttacctttgctgaaaccataactgtttataagtcttgtatcctctgccgggagatccgggggaatggtcaaagttccagaccaaagaggtagagcagcatgccatcattacctttcccttcctctggtcccatcatgtgaaagagcaggttgcttccaaaataactcagatttacctgtgtaaatctgatacattaagatccacttaaatatatttcaggtacttgatcttcatttatatcatctttaatgtgaggcaacctgaaatctaaccaattcctcaagatgctttacttcaaacccattctccctctgttctccttccctctctactccctttcttatgtgtggtttcaggtcagtgtgcagctggaagcctctcccgccttcctagctgtcccagtggagaaggaacaagcgcctcactgcatctgtgcaaacgggcggcaaactgtgtcctgggcagtaaccccaaagtcattaggtgagcaaaaaactgctagagataattctctactcaaagattgtatatggcagtgggaaccttatattgagtgctacttccttcaggaaaagaccactagatgctgcgatttttttcctttgccttttattctaagatgcctacaaggatatcctcaacatctccaccttgaattctcagtatcattcacctctcatttgcatgtttccgttcctgcttctgtgttttaataaaacaaaagtttacagagcattgaacatttctaaatcttgagtttggaggcatggaggaaggggaagatgctattcatttctactggccttttttttcaggaaatgtgaatttcactgtgagcgcagaggcactagagtctcaagagctgtgtgggactgaggtgccttcagttcctgaacacggaaggaaagacacagtcatcaagcctctgttggttgaagtaagtaaacctaaataatatatagtccacaataatatataatatatgtgggtaatataataatatatggatattttataatattattctcatgtatctctctgtcctatctctctcttgatttactttctgttttgttgggggtttttgtttttgtttttgaggcagagtcttgctctgtcatccaggctggagtgcagtggcaggatctctgctcactgcaacctccgcctcctgggttcaagcaattctcgtgcctcagcctcctgagtagctgggattacaggtgtgcaccaccacgcccagctagtttttgtatttttagtagagacaggatttcaccacgttggccaggctggtctcgaactcctggcctcaagtgatctgcccacctcagcttcccaaagtgctgggattataggtgtgagccaccatgcacagcctccctttgatttactttcttaatttttccttcatttgttcatgcatcgaactacctcctacgtatattgcttatatgtacagaattttcttagataatacagttcaaatccttctcttcactatccaaatatctgtggtccctccattaaaacacatgttctgaaggtcagtccattctcactagcttttctttcttttacctaaagcctgaaggactagagaaggaaacaacattcaactccctactttgtccatcaggtaagagtcaaccatcataatttaaaaaacattaaagtctaacatttaaagttcaaagaacatttatatattattcctacactttctctgtgatctaagacctgaagcaccatcaatgcatttgacaaatgtggaaaatagttcttaggaaggccaagtaatttgatcagaatatccctaggcctgcattctgagtcttgatcttttgcagcacctgtgcaaacaccaaatgactttctgaccagtgtatggtatgggcataggtagaaagtgggtagaatcaaaattaatattaccaaaagggatgtttccttaaataattaataatgcaaactatggacggctgaatttagggcattctaacactgagttttacatagccaacagtatttgataacgggattgctatttcccaaaggaaaagttgtcatggcctttaccattattgtcatattaatatctgtttgatgcctatcccgtacctaatgccctatcaaacatttgagaaggaactgaagaaacttacaggaaaaatttaatacactaagaaatttatcagcacaatgcattctcaccccaaaccaacattgaatcaacatcatacataggttcattgcctttctctgactacctacaaatttagtatgtttttcgtactaaatactttatctattcatctgttgccaagatgtaacacataaaatgtaccctaaaaacataacttccttgtcatttagccttatttctacatttaagtgaactgattacctatcattcaatccttttatcatgacttctccgtttctgagttactcattttgatgtatctcttaagtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagatgtatatgtttgtggatgtgtgatttacatataataaactgtataagtttcattctataaatcactgtttgtttttcactcagcatcctgtcttggagatttacctatgttaaattgtagatctaggtctttccttggaattgcttttaagcctataatataaatacatcacaattctgcttagtgttttagtcttcctatattggttttttcaactattcactagctttaaaaaattagttagttaattataataagagcctcttaatgaacatatgcaagtacagctagggtagatccaaaatgttaaattcctgagtcagagagcatatgcatagatatgcatagttttgtttggttggttgttgttgttgttctttaattacattgtaaactgaccatttataattgtatatatatacagcatacaaagtgatgttatgatttatgaataaaatgtgaaataattaaatcaagctaacctgaaatacttatgttttgtggtgggaacatttgaaattctctaagcaagtttgaaacataaaatacactattattaactatattcaccatgctgtgcaatagatcccaaaaagaaaaaaatgtattccttctgtctgagactttgtgtcccttgaacaccaccttccttttactccagcttcatcctccataaccaccattctactctctgctcctgtgaatttgaatgttttagcttccacatacaaatgagaacatgcaatatttgttttcctatacctggcttatttcacataacataatctcctccagatttaatcatgctgccataaatagcagaatgttcttgttttttaaaatggaatggaattctatgtgtatataccaaattttctttatctgttcatctgttgatgacacttatgattccataactagacatcagtaatttgttagggattacattcaatatgtagattgctttgggtagtgtggacattttaacagtattaattcttccaatccatgaacattgtattttttttcatttatttgtgttctctttgatttctttcatcagtgttttataattttcactgtacatttcacctccttgattagatttatttctacatattgtttatagctattgtaaatgggattgtttttatttctttctcaatcattcattgttagtgaacagaaaatactactgatttttatgtgttaattttgtatcttgcaactttattgcattcatttataagttcttgcagccctttggtgaagtcttttgagcttccaatatataagataatgtcatcaccaacagtgaaaattttacttcttccttgtcaatttggatatttttcatttctttttcatgtttgattgctcttgctgctacttccagtgctactttgaaaataaatggtggcagtgggtatccttgtcttgttccagatcttaaaggaaagtctttcaattttccactgttaaatatgtaagctataggtttatcatacatgccctttattgtgttgaggaacattgcttgtatatctaatttggtgagagttttatcataaaagagcattgaattctgtcaaatactttttctccatctaacaagatgatggtatggtttttacccttcattctgtaaatgtaatgtatcacatttattgatatgcatatgttgaacaatttttgcatctcagggataaatcccacttgactaggtagatgatccttttactgtattgttggatttagtctgctagtttatttcgtgtggttggttggttggtttagttttttaagtgatgagcttttgctgtgttccccaggctggacttgaactcctgagttcaagcaatcctaccacctcagccacccacaggtgtatgccaccatgcttagctgctatgctagtattttattgaggatttttgcatctatattcatcaagaatattggtctgtaattcttttttgtaatgtctttttatgacattggtatcagggtaatgcttgcctcataaaatgagcttgaaagtattccttcctcttccagcttttggcagagtttgagaaggattggtattcattctttttaaatgataagtagaacctagcagtgaagccaacagttattaggcttttctttaatggaaaactttttattactgattcaatctctttactcattatttgtcagttcagattttctatttcttcatgattcagtcttggtagtatgtatatgtctaggaatgcattcatttcttctagatcatccaatttattggtgtatacttatgcataatagtctcttatgatcctttgtatttctgtggtatcagccataatttctctttcatttctgattttatatatttaaggcctccctcttttttcttagctaacctagctaaaagtttttgtctgtctttttaaaaaaacaattcagtttcattgatcttttgtattctttttctagtctctatttgatttatttctgctctaatctttattattttcctttcttctgccaattttgagcttactttgttcttcttttcctacttctctgaggaatatcattagtatctttattggaaatttttcttcttttttggtgtttattgttataagctttcctcttagaattgcttttactttatgctatgttttgttatgctccatttccatgttcatttgtcttaagatatttttgaatttccttttaaatttctttattgacccattggctgttcaggagcatgtcatttaattttcatatatttgtgaattttttctaattcctcctgttactcatttctagttttcatagtattgtggtcagaaaagatacttgatacgatgaaacgatttcagtcttcttaaatttgctaagacttgttttgtgggctaaaatatgatctatcttggagaatgtttcttgtgtgcttgagatgaaatgttctgtatgtatccattaggtctatttgatctaaagtgttggtcaagttcaacgttttcttattaattttctttctggataatctatccatttttaaaagtgagatgttgaaattccctgatattactgcattgcaacatatctctcccttcaacctttaatatttgttttatatatttaggtgctccaatgttggatatgtatagatttacaattgttatatccttttgatgaattgacccttttatcattatataatgttctcctttgtctctttgtacagtttttgactttaagtctgttttgttgaatataagtatagctacccctgctctcttttagtccccatttacctagaacatctttttccttctcttcactttcagtctatgtgtgtccttaaaaattaggtgagtctcttgtaattagcatatgtttcggtcctgtttttttaaatccattcagtcactttatgtcttttaaatggggaatttagtccatttgcattcaaggtaattattaatttaaaaatgacttggtactaccattttgttgttttctggttgttttgcttctttgttcctcttttgctgtcttcctttgtggtctgatgttctgtagtggtatgatttgaatcttttaaaatttttgttctgtgcttctattaaagatttttgccttgctgttactatggggtttacagtcaatttcaagctgataacaacttaactttgcattctttcactcccccacacacattttatgtcgttgatgtcagaatttacatattttgtaatgtgtatttattgacaatttatttttagctatgcttgttattaatattttgtcttttaacccttgtactagagataaaattgctttaaataccatcattacagtcatagagtattttgaatatggctctatattacttataccattaaattttgtgcttttgtgtttttgtattattaattaggggccttttgtttcagcttaaagaactcccttcagtaattcctgaaggcaggcctaatgttgacgactcccttagcttttagtttgtctgggaatgttttatttctccctcatttctgaaagacagctttgctggatgaagaattcttgattccatgttgtttttatttttgttttccttcagtactttgaatatattattccactctccctcagcctgccgggttactgctaaaaatccatggatagttgtattggaattcctttgtatgtgatatgtttctttatcaccttctgcttttcagaatttttttttgtctttgatttttgatagtttaattattgtgtcttagtgagcagttctttcatttgaatttcactggagacctctgtgcctcctgtacttggatgctagcatctatcccctaattagggaagttttcagcccttactgcttttttttttttctgattctatactcttttttttcattattgctttaaatgtgctttatagtctctttcttcttcttctggactttctttaatgcaaaggtttgatttcatgatgatgtcccataatttccataggctttcttcattcttttgtctttctgctcttctgcctggataattccaaatactctatctttgagctcactgattcttctgcttgatcaagtctgctgttgagcttactttgaatttttaattttagtcattgtattctttatttccaggatttctatttggtttctttttgattgtttctatttattttttattttacaatattagctaagttgcagataattgtttctatttcttttttttttatactttaagttctagggtacatgtgcacaatgtgcaggtttattacatatgtatacatgtgccatgttggtgtgctgcacccattaactcgtcatttacattagctatatctcctaatgctatccctcccccatcccctcaccccacaacaggccccggtgtgtgatgttccccttcctgtgtccaagtgttctcattgttcaattcccacctatgagtgagaacatgcggtgtttgtttttctgtccttgcaatagtttgctgagaatgatggtttccagcttcatccatgtcccaggaaacaacaggtgctggagaggatgtggagaaataggaacacttttacactgttggtgggactataaactagttcaaccactgtggaagtcaatgtggcgattcctcagggatctagaactagaaatacatttgacccagccatcccattactgggtatatacccaaaggattataaatcatgctgctataaagacacatgcacacatatgtttattgtggcactattcacaatcgtttctatgtcaaacttctcagtttgttggtgtattgttttgcaaatttcatttaattttgtatttatatattcttgtagtccactgaatttcttcaagaggattattctgaattctttgtcagtgatttcatagatctttatttctatgaggtcaattttttgagcttggccagtttcttttggaggtgtcatcattccttgattcttcataatcctgtgtccttgcattatttgtgcatttgaggagaaagccacttcttctggtttttataggtattctttggcagggataaaggtttgctatttagtctagcctataattctggaaagatcagttggtgacaaccttgagcaggcagagttttcatgggttccctagttggctgggccactgcctttgctcttatgtttggtagggccactggttgggccttgctctctggcaagatcactgttttgtctctgctatctggtggagctgctggctgggtactacaatggcctctggtcaggccagtcacaagatgtgttgcctggctggatgattctgctatttgggacctgaagttaggcagggtcacaatccgggctgtgaggttaggtagagttgttgcttgggatgggcagaaataaatactatacttcttagatgtgcataatagaggattgctaccccacccttgtgaatggagccatggagtgaggttttggctgagttgagctaccctttagactcccaggtcaagcatatttaacccctacacttctatgaaatacacagaggtggtgtctgctacctgggtggggtcactggcataacctctgaagctgggcttacagactggccatctggaaactcaagctaggttgaacttcccaacatgcttctgaaagtgaccagctcagttttgcagatgggctatgcagttggctggtatctctgaatgggtgccatagctggcagaaacacagaagcactaccaaaatccacatgctggtcactgtgagctctgtccttctttgtttctacctgacctcattacttcctgtgttcccggtgaaatgagaccagagtgggcttcctgagaagtgtctttgaatacttgagaatcttgatgtctacccctggttctcttccccgctgtagaaactgtgaccccagggaactcctctctatctggcattgtgctaacctaaaggagtgggaacaatgacatggtcaaagtgagaccattcttcctactcttctaatttgtcttcactcagttctatgaacaatgtaggtgtcctagacttgtttccaagtattggggttttcaaaatagattttctgatctgtggatagcagctagttggactttctgtggagggaggaagatcctgagactttctagtccatcatcttgctttattctgaattttaattgaactacaaaacgaaaatcctcctctttattacctaaatgcatttatacttccaccaggatacatttccatagtgttatatttgccatcatctgttaccatcaaagtttttaattttaatttttgccaaaaatttagaaaaaaaaattttgctgttgttttaatttatattttcttaattacaaggatgaccttatttttgcatgtttattaattgcctttataatctttggctatttgtcttttgagtagtttttttctgactcagttgtatgacactaattctttatctgttgaatatgttgcagatattttctttcacttggtcatttttttaactttgtttatggcatctgtttttttacaaaagttttaacattaattttatgagaaagggaagataactgctacatttttcatttgtatataattcaccaatactaaaattgtagtaaatgtatgttcatcagtagcagttattttattttcagtgagtcaagcattttattttgcttagccatttgtcctttaactatgcttatggcttttttttaagaaacattttaatatgaattttatgaggaagggattcagtatgaaaataaataccatacttctctcattttcatttcatataatttaccaagattaaaatggaagtaaatgtatgttcatgagtagtaattattttattttcaatgcatcaaatactgttcgtcttcacttccttaccctcaattttctaggttttccataaaaatactatctttgtatatgaaatttgaagaaagaacatagcattattatagaattcaggaccttttgtgggtaattttacttatgtatacttatagggctttgttgttggtgttttctccatacaactgttgagtaaggaagttggtggtgggaactaaatagatcatcttgtgataaccgtcttgtgtcagccatcagatgacagcaactgaatcacaacatcaccaggctcttacaatttgttgtcttatttggcatgcgattctacataaattactgaaaagatcattgaagaagaaattctgaaaatcacaggaaaccagtagcccatttttaagatatttatatattactgttgtattaaaggcggacaacttttcaggaggagtttaggtataaggcatagtcctagcttctgggtcatagagctgtttagaaagatataatgcagaaataattttcatatgtctgatttgcttatttctctaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctcttcttctttgggcttgtttattgctttcaatcatacttctatccctggaagaatcatccttcctaaaaattctcaatttctaagctcaactaattatttctgcttaatgactttgatagatgataatctccaagctttatgacttcccatctctcccattctctaggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggtgagtgattacttgagtaagggaaaacttgaatgttatttcaactggatttcccagtaggtttcagttacttatgaatattatgatacattagcttagctcactatgatagctgctatgatagttaatttcaaggaaactatccactctccaacctccaataaaatatttaaggctcagaaactcctaatctatgacaacaaaatttaagaaatgtcacaagagaagccaaggtacttttagtaatttctccaccctcagcatgcacattaatccattgtgctgtttcgttaatcttcctttccaggttaccagagacagttgaactacaaacactatgatggctcctacagcacctttggggagcgatatggcaggaaccagggcaacacctggtaaggaaagaacaattttttgagcttctttttgtgtgccagctcttttacatgtattacctcaattatattcacagcaacactatcagatatgtattatcagaccgatggtttgttatactagataaatccaccaagattagcaaggtaatcagaagaaaacctgatatccaaatacatgttatgttaggcttgtttccaaaatggatcctattaataatgtaccaaggttttctttctgaaatggctattctttctaaagtagctaccataaccatgagttttaaaatgatattgccagtgaacatatataacttccagataaaccatgttaacttcagcttatattgtcacattctaagtcattcagcttgacttggaatgaattcattaataagaggaaacaattgagaaggaaacagtaatataaaacatttttttaaatccctaaagtaaagcaatattaaaatttactgcatgtaagagctgcatgtgagaagattctgtcatctgcagaaggaaatctctaaagataagagagatttaaagccttactcaagtaactaacaaaaataagtacattcaaattacttgaatgtaaatttgttcaaccattgtggaagacagtatggcgattcttcaaggatctagaaccagaaataccatttgacctagtaatcccattactgggtatatacccaaaggaatataaatcattctactataatgacacatgcacatgtatgtttatcgcggcactatttacaataacaaagtcatggaactaacccaaatgctcatcaatgacagactggataaagaaaatgtggtacatatacatcatggaatactatgcagcaataaaaagaaatgaaatcatgtcctttgcagggacatggatgaagctggaagccatcagcctcagcaaactaacacaggaacagaaaaccaaacaccacatttctcactcataagtgggagttaagcaatgagaacacacggacacagggacaggaacaacacacaccagggcctgttgggaggtgtggggtgacgggagggaactaagcggatgggtcaataggtgcaagaaaccaccatggcacacgtatacttatgtaacaaacctgcacgttctgcacatgtatctcggaactaaaataaaattaaatatactaagactccctgtggcaaagagagagttagcaaggaaatactacatctagcagattaatcaggcagactaaagattaatcaaggagataagctctctaagtacacaagaattttgttagctaactcacatcatatgaagcctgttgctgtgaagtggttataaaaccattttgacaacataaacatcatgattgcttcctccctggtcaggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaaggtgaatcattctggagctagttttgatttgtccattatgatatctgcaaggatgaggataggaagtgataatgtgaaaaattctaagggaaagcctcagaggaaaataaaacctggatggcaccaaaaaagaggggatagaacaaaagttgattgtgatactttgccctatagggatggatatgggtaaggatgaattccatgacacagcagaatagaaagaactaatcaatagcattctcagaagttgaattattcagatctctctctcgtattcacagggaggagtagaagatgaagtgaccctctccgcctatatcaccatcgcccttctggagattcctctcacagtcactgtaggtaccaccccattcctctgctgaaggagagttctggatgcaatgaaactgctgacctgctgtctgaaatactatcctattaaaagcaaagcatcagctttctttctatgcaatgccagtgcttcccagatctacagagaatttggtcagcccattaagaaaggtttaaattttcccagtaattcccctaggctatttaccaccaccactcaaaaaagaatcttaaagatgtatcttttgaatgtgagaataacagataaaaataatattatatctattgataagaatgaggaatcgttggaaaaatgcgtttgaaaaacttctgtgctgtgatccgtgtatttgcctgggaatgctaatatgcctgtttacatagcttagttcccttcttgttctgccttcacagcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaaggtgagagcacacctgagatccttctcctggcccatcctctgtatcaagaactgcatggcaaaaatccctcactcctacctcctgtgatccctgtctcctctcttcttttctatatatcatatatattttgtccatattgcatcttataaaatctaggatttcttaatcaaatcagaaatcagaagacaagaggccgtgcagatgcttctcaattacgatggggttatatcctgacaaactcattgtaaagtctaaaaaatcttaagtgggaccattgtaagtcagggaccatctctatagtatgctggtaagaagagcattctctggagactagctccaaaatgtgctacctatgtgagcttgggaaagtcattaacttccttgtgtttcagttccttcatcagtaaaatggggataataatagtatttacctcacagagctgttgtaataaatgaattggtacacgtaaaacacttagtagagtacatgtcacatagcaaatcctataaaagtactagttattacaattaacatatcagttctcaatatatgcccaacccttacctggtacattatataaccttaaacataagaaaataatcatggaagtaactccttgaatgaattctggtattttaagcccatttcataagaccaataatgttgaccaatctactcatattcacacagtacttctacatataccatggtctatatgagcggttgaagaaatagaaaataaaatgcaaatcacaagatgtccattaaaacagtctacctttttcctttgacagccattaattcttcttaaaatgtattgagaaatattttataatagatatacaaaagggcataagctataactagaaaacactgtacaactctctcatagattaagaaatagaaaattaccgacatgggaaaaataaatcccttgtgtatcactaccacctccagaggcaatcattatcctgaatttgtcgttacaattccatggatttccttatatttttgctgcatatgtatccctaactaatatttagaatcttcacatgtgtttcatcttgagagaaacaagatttttatttctctcttattcaagaaacaagagaaacatttttgaatatttcagcagcttagttttttgtttgtctgctttttattttctaagttcaacactatgttgatgaagacccctatacaagtatgtgcagagtcagctcattaattttcactgctgcataatatattacagtctataaattagtcataatttacacatcgagtttctcctcatggattttttttatgttttgctattaaaaaaaatgctgcaatgaatactcatgtgcctgttttcttgtgcatctgtgtttctccaaattatgctttgagaagcataatgactgattagtgggctaagcacatcttccccattgctgaatattgccaaagagcagttggcttcccacagcagtgtatattggttcccattgtttcacatccatgtcagcctttggtatttcaaggattactgtattttttttttcaatttaatgagtagaaactctactatttcatgtgatctgtgatcctcacaagaaactgataaagacacactttataggaaatgtaacaaactccagctatagtctaatataacatcataaataggaaatagccagactcaatgagacaactgctgtgccatttctttctcccaccaacccgactatagcaacgatttgaaaacatagataggcataggcttctgactccagcatcaatatctgccttagctgggctaaaacacaccaaattcagatttacatgaagggaaaagcatctacatacagtacaggggattataatgggcatgcaattctcatttcagcactggcttgggtactttcaccttgaattaaatataaatatgtaggcacttataaatatctttttctcatctttaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggttggtgatttgccaaaaccttttatttcaccttcaggtagcaaaagatttgaatgaaaaagaaacaaacacatccaagaagaaaaaaatacagatgacagtaacttgaaatgaggaaaagttttcagtatccaaggataatggaaataaaagcaaatcaaagtcaaagagggccaaaaggaaatgctcagaatcccggcaccccatcgctgtgttattatccatctcctatttcccataacaacactgccttcctcaagcagcagtggagcaccagcagaatgaaggagatgtctcctgccattctcctgaaagctctagggtctctttcaaactgttcaaaggaactctactcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaagcgattctagtgcctcagcctcccaagtatctaggattacagtcatgtgcaatcatgcctggctaatttttgtatttttagtagagacgaggttttgccatgttgcccaggctgatctcgaagtcctgagctcaggcaatccatccgccttggcctcacaaagtgctaggattataggtgtgagccactgcgtccagccccctattcacctcttaatacacaaacatttattcatcaggagcataaagaactgtctttattcatccaacctcctaaatctagctatataaccatgtatctgaacaattcattgatatgtacacagcagaaagttttatcttcagagaattcggatgtttgcttatataccctaaaacggaaaaaatgtgacaaaatggcattccatcctatttccattgtattaatcttttatcatatgaatgaaaaaaactaagtaattttgttaaaggttatcattcatttattagaaacatattatttgaaggaggccaagcaggtttaatgttgttgaggatacataccagcagacattcactgggaacaggaaatcatccaataaaaagggaaagccaaataaaaatgtcattaaatccagaagataattataatactcatcttttatttcttttggagaaactgaagcatgactctgctcatggctgcaaagaaccttgggttctctccaggacactgacctcagcaactgagcaaagtttaatatgggagagagccagactgaactttgcttgagtggtggcagatatgagcatagttgtcaagaaagacatgttagcaaatagctgatgccaataactgattgccattcacatgttttccacattccatgtcccacatatacttacagagagaaaaggatcaattttctgataaataaaataaacatgtagggcatacagtccaaggtagatatgtgaatgttatggttcttcaactatctaaagattataatcaatcttgaaattacagctcctatatttaagtagtgagggaagtaggaaatcaaagtccctcacatgggtctttgaaaaatatctcagccctcaaagccttataatgcccaatgggttctctcactcatctgtctctaacaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccaggtgagactcttgggcaggtgaggacaggacagatgaggacagcagctgttctctctgagaagtcctaactcagaaaacaatgggacagatcagagaaagggttagggacgtggacaggaattctgggaaagggcaaaaaactgattttgtctttgatgttctatagacatccttgaaatacaatattctcccagaaaaggaagagttcccctttgctttaggagtgcagactctgcctcaaacttgtgatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaatagaaggaagtagtgactccttagttagaattcctactggcaataataaatctcaggttatatatgatataattaatttggggggaagatacacttatatgcatcaatatttaaatagctgcagatctgataaaaaactctctctccacaaacatattattacttggttggagatactattcaggaaaaaagttaggacaaaatacatgtaacaaataactggcacacatcaaaaagaatgagatcatgacctttgcaggaacatggatggagatggaggtcattatccttggcaaactagcacaggaatggaaaaccaaacactgcatgttctcatttgtaagtgggagctaaatgatgagaacatatggacacaaaaaggagaacaacagacaccagagcctacttgagggttaaggatgggaggagggagaagatcagaaaaaaacaacaattcagtgcaaaatttagtacccaagtgataaagtaatctgtacaccaaacccccatgacacgagtttacctatataacaaacctgcatgtgtacgcctgaacctaaaagttaagtatatatatatatatttttttcatttaatttggtgtatatatatgccaaaaaataaattaagcagtccaaatttcggatgcaaactctcggggacaagacgctaggtgtttctaagtgttttgttgaaagccagtgtttaagtaaacattataaattattgttgtttttgtaaataatgtagactgaaatttattattcataatatacatcattttgtcagctgaaagaaaataaaagtaaacaaataaataaaataactggcatagattagaggtcacaaacagcctgtgcatcacttgtagagctttcttaaaatgcagatcctcagccgggcgtggtggctcacgcctgtaatctcagcactttgggaggccaaggcgggcagattaccttaggtcgggagttcaagaccagcctgaccaacatggagaaaccccgtctgtactaaaaatacaaaattagtcggacgtggtggtgcatgcctgtaatcccagctactcgggaggctgaggcaggagaatcacttgaacccaggaggcggaggttgcggtgagccgaaatcatgccattgcactccagcctgggcaagaagagtgaaaaactccatcaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatataatcacatgtgtttgtatgaatgctgaccatgtgcagagcactgtgctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaagggaacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaaatcttcacaaaatgtgtttattatgttgacaagttttttggatacccagtaatataaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagatgcctctttgagtctacgcaagtattcctgcaagacagagaagtcaaactataccaaatctctggatattaaaaaatgaacacagttagtcatccaataaaaagtatatatcatttacccccatgaacagagctatgtattggcattgacagaggtatatgcgttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcttcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcccctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgccccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcaccagaaaagactttttacattaaaatgaagtagaatgaaatacaacattgaacatgtcatattgagaggcaagataattgggacttgacctgaattgggagtgatgtgtcctatgttacaccaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttcttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggccccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagacagatgaagaggagcattactgagcaatggaacagaaggataaggaagatgaagaggaaggagacctgcagttagtagctcatttccacagtaaggatgtcctttccacagcaagggtgtcccaacgagtgttcagcttctagcagaacggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggcttcaagccctcaccagcttgagggtgggacttcactggggacccatccccttccacccaggaacctgtctgcctcctgctcccaggctgttcatgccaaggagcgcctgcaagtcagtgtccagctgtcttcagacccctctcagcctccctcccacgcttgttggtgcccaagttccaaagggggccgagacggcagggggctggcgtatcagcactgtcctgagcgtgtgcacgctcggccaggctgtgacagtacccaggctcggcccgaccttgctctgagttcagagtgggtgctaacagtggagagaagccaggcagccggagtaggcaccctggagcctgcagtgggcaggggactttgctgggcctctgagagcacagaaaatgtccacagccgcggcaaggtggctgcagctgcaccctgggagctcctgctccaccagttcggaaggggcggggctcctgcttgtccctggctcacctgctcctgagtgtgcaggtccggtggcgcctccttgcaggctgggctgatgggcgggggcggggggggggggggggaggaagggaatgttccaggtcctccctgggcccgggactgtgtccggggcagggatgacgtcgctgcaagttcttcccgtggccccggggctcaggggcagcccaggactctccctcgcccggctcacggccctgcctggggggcgcctccgggagcagatcacgagccctggggctcagccctcaggcgcgtctagctcggcggtcaccccagtgccgggaggaccctgaagacgcgccccaggcggccctactcagagcctcctcccaaggcccaggaatgcggcgctgtcggaggtgtgcgcggtggccacaccgctgtccgggtccccaaagcgggccccgctcccacttctcgccttggccccgaaccctgggtccagccccagcgctttgtgtgcgaacaccgctccgccccggacccagctccgccttggggcccctctctgcctgcccctccgtgcccgactacactgcttcccctccggcgggcgactcagcccggtccatcgtggcggcttccagggcggcaggctccgggagtactcccggggccggctccaaggactgttcccctcctccccactcccactccgcggcggcggcgggcgagagcggcgacatagggccagggtccggagcggtggaggctcctggccggggagcacgtcgccccacccggcaacgcgaggatggtggcggcgcagtcggctgctttggggtctcaaggcacaggggacgcgaggcacagatgtcccacagcagccactgcggctcccgcagctgctccgccgccgctgcccgcccctccctgctgcagctggcgtgatggcagcggcagctctggacgccccactgctgccaccatcagccttgtgaaataggtactaccttaacaaatgaaattgaagcagagacatgtaatttgcccaaagttactaagttagtgacaaagctagaattcaagaccaagaagtctagcttccatgctcttaacttccaaccatggtgacacctcaaacaacttcagacaaaaaggccaggagaaagtatatttcagagcttaataaacattataattagctgtcaaattaagtatcaagccagggcacagaacataaaagaaatcagagtatggctatgggaacaagacaacaggattataattttacctcttggttctagtttttttctttgttcatatggaaatcgttactgaaaaggtactttaaggatatgcttgttgcaaatcattagctgtatcactgaccaagagtgtttattcctgaaatactaactgattgcctactatctgccaggcacaatatcccatgctataatacaaaattaaacaaaataggattcctcccttagaaaaactcaccgcagagtaaaagaaaaagatacacatctgggtcattataatgatcaggtgctcaagctattcattgccccagtggactggagatacaatggccttctcaagttttggggtattacactcaaattcatatgtaatactggagaaaaggcctaattacaacttaaactggatttcccaccagcctggtggcatgggaatcttggaattaaaattacgtagaatttttaaaagtgatgtatcttctacatctgattttgtgaactgaagtttattctttccaggaaagcatatagatacacgacaggaaatgaaatggatacttgttggggtcagttttatgtatagtttgtattttattttgaaatatgatacactgctattctcttgcattttcttatatgtgactcaccactaaccctatattcccccatttcaggccagttggtcataagcatccatttgcctcagagaatactgggttgttatgacaagaatataaagttggaaagaaatagaatatttgagtctaccctgtaagaataaaaagaataaaaggggtttaaatttatttagaccctattgtttaatcaagaattctggccaggagcagtggttcatgcctataatcccaatgctttaggaggccaaggcaggaggatcatttgaggccaagagtttgagaccagcctgggcaaattattgctcgggaaaaaaaggtcttatttagtattttagtctttacaatgtttttttctattatgcaatattctctcaaatactttatgtccatccacgttgtctgagacatgccactttaacattctagttatgctgtagctgtcattttaccctaagccgttagtagtactgatccacataaaattgggctgtttaggtgtttaactgtttaaatgtataatatatctgatatatttatatattgtataaaaaatcacctaacacaatagatatttactatgtctgctataaatatatatcatataacatataacaatatattataaatgataatatactataatataaaatataataaatatattataaatgtacaatatatccgatataaatatataaatatgtcaactatattatacatataaatgtatatgtataatatatacatatatgtataatacaatgtatttattatgtatatatataaatgtatatgtataatatataaatgtataatatatctgatataaacatatcagatatattatccatctattgtgtcaggtgattctttatacaatatataaatatatcagatatattatccatctattgtgtcaggtgattttttatacaatatataaatatatcagatacattatccatctattgtgtcaggtgattttttatacaatatataaatatatcagatatattatccatctattgtgtcaggtgattttttatacaatatacaaatatatcagatatattatccatctattgtgtcaggtgattttttatacaatatataaatatatcagatacattatccatctattgtgtcaggtgattttttatacaatatataaatatatcagatatattatccatctattgtgtcaggtgattttttatacaatatataaatatatcagatatattatccatctattgtgtcaggtgattttttatacaatatataaatatatcagatatattacatatctattgtgtcaggtgatttcttatacgatatataaatatatcagatatattatccatctattgtgtcaggtgattttttatacactatataaatatatcagatatactatacagttcagcccatcaaagcaccatattttggggggttggtttccgtgtcccaacactagctacgaaaatattagctattagctacctataactcttcagtagtaaattcaagaaacgtaaagtaattctcttcattaagttcttgccttgtctactaaaaaaatggtcatcaccgatgtggacaatgaagacctgtggggttaaaagctctaactagtatgcctccaagattctttgattgcctgccatcatgatcgaagaataaataacttctttttcatcttatttatttattttttgtagagatagggtctcgctatgctgcccaggctggtctcaaactcctgggctcaagagatccttctacttaagcctctcaaagtgctggaattacaggggtgagtcaccacgactgaccattaataatttctttcaatgacactttaacataggctcattcatctttacctctaaagaaaagtctttctggtctttttaaaattatattttttggccaggcacaatggccaggtgcggtggctgacacctgtaatcctagcactttgggaggccaaggtaggaagattgcttgaggccaggagtgcaagaccaacctggcaaacatctggaaaacatagcaaggccccatctctattaaaaaaaaattaattctatttttctaagagaaaaaagattcccaattcaacaacacttttcaaaaactttatctggcagctactcaggagattgagatgggaggatcatatgaagcccaggaattcaaaaccagtgtgggcaacatagtgagatcctatctcataaaaaaataaaaaataaaaaaagctttacttggaatacaacccatgactctggttataaatacaaaattcttcaaattcatttaaaggaatttaatcctagcttctcggatgaaaaaaggaaataatattcacaatttgatccatcatcagtagacaagttaaatgtgtttcacaaaagcaagacatattaattaagcaaaatcatattcgagtaaccacaggaaatataaatatactgtctcttacctagagaaatcttatagtctaattgtgaagatagtcttcacgtgacgaaaaagatcatcattaatccaaaacatataagttataaagaagcgacatataccagcaattctaaaatctggttagcatcctttgtagaatttattttaaaatgcagatatccaggtctcatcaataaagatttaattaattatttttggggatgtgctcagacatctgcgttttttgttttttgttttcgtttttttgttttttgagatggagtctcactctgttgcccaggctggagtgcaatggcgcaatctcagctcactgcaacctctgctcccaggttcaagcaattcttctgcctcagcctccctaggagctggaactataggcgcccaccaccacgttgggctaacaggcatctatgtttttaatgaactctgtaggtggttctatcatgcagttagttttcagaaccattcacactgacagtaaaggctatttattcccagcagttgaaagaccactaaggacacaggaatagttagcaaagctacttaaagatgccagggctggggccgggtgcgatggctcacgcctgtaatcccagcactttgggaggccaaggtgggcagatcatgaggtcaggagatcgagaccatcctggctaacacaatgaagccccgtctctacaaacaaacaaacaaacaaacaaaatacaaaaaattagccggatgtggtggcgggcacctgtagtcccaactactcgggaggctgaggcagcagaatggcttgaacccaggaggcggagcttgcagtgagccgagatcacgccactgcactccagcctgggcgacagagcgaaactccatctcaaaaaaaaaaaaaaaaaaaaaaaaaagatgccagggctggctgggcacagtggctcacacctgtaaccccaacactttggtttgggaggccaaggcggatggattgcttgagttcaggggttcaagaccagcccaggaaacatggcaaaacctcatctctaccaaaaacacaaaaattagccgggcatagtggcatgcacctgtggtcccagctactcaggaggctgaggtgggaggatagctggagcctgggaagctgcagtgatcagtgatcatgtcaccacactccagcctcggtgacagagcaagaacctgtctcaacatacatacatgcatatataaaattaaacataaaaacaaaaataaataaagatgtcagggcttatgttgaaccttaactgagagcaagattcaaaagacactgaggcttatttttctttcttatatctatagttacacagggagctgtctaatcttggatgtatccaagttgatatctggttttatccattgaaacccacagtgaaaatggtaaataggtgctaggtgtttggatttttttaatccaatgtaagaataaaacaatggtatcctaataatgtcaaagcaacattggtcataatctaaggaaattgaattcatatagtaccaaatatatatttagcattgtgctaggtgctgatacattctagataaaaatattacacatgggtaaccaaaactgtcaaatgacatttcagggcaagatataattaagtaccaaaatcattggcatagtctttaagtactgtgaaatgtagagaaagctgagatgaatggcagtgtagagacagatggctttgcaaatcatctcagatgactagctatccaatgtgaggacacttctccctcaccttcaaacaaatgctaaagacgcctgttacttaatcatatgaatattcaatcttgtatctaatgtggtggtattcataatactctgtatatgttttcatcttactggacaagtgtcttcgaactcatttaaatgaatttaaccccagctttgtttatgtatagacttcttcaatctcatagtctatttgtctctttgtaccccacaggctttctttattcagtaacactggtgatttctcttattttccttagcttgaaagatctagccacgtgagcaggacagaagtgcacaacaaccatatcttgatttctgtggaccaggtggggcccctgccagccttgctagacagacccaggtgaacagtccttctaggggatctcatcaccaggcaagcacgtggtacgagaagagcagtcattaggaaggccatttggaaaagcacatcctctctgttcacgtgagatattttacatcctcattcctcatcgcaagcttcctgggatttggagtgtcacagacaagagggttgggggaggcc

SEQ ID NO: 38199 - DNA, 21609 bp, Homo sapiens
gagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaaggtacgcgagcccaagcctcgcagagcgtgcgggcgacgccgacccccaaacgccgcgcacagcccagcctcctccaggtgccgggcagcggcctgggagccgcggcatgctgcgcatgctcagcagcgggatttgggggttcgtggcggctcccggtgcctggggtgggctgcgcatgctcagcagtggggctgggtggtcagggcctcctgcgcggcgcctgggtgtgctgcgcatgctcagcagcggcgttgaggggtcggcggtcagcccccagcgcctgtggtgtgctgcgcatgctcagcagcgaagtttacggggttggcggtcggcttccggcgcctggggtgggctgcgcatgctcagcagcggggctggtgggggtcggcggtccgtttctgttgcctggggtgtgctgcgcatgctcagcagcagagttggcgagtcaggggcctcgcagccgggactcgctgcgcacgcgcagctccgggattggcagcgacctgaagggtcggccggcagggctgcaagattcgccggaggcgggctgcgagttcgtgggctcgttgggcttgtccgacgccctgcctgcctggctaacctcggtcaaaggcccaggggtttcttctatcggaggaagggggactccgcttgaaagtgtcctgggggagggaccgggcgccagcagatcgaggcggggtcctgccgcggtctgtcggggatccccggggggtagcgctcggtggtggggtgggggcgtctccagtgggcggtggagctggcttgggtcccggctgggcccggtgtcagccctgcctctgtaacgctagctttgcaaggcggggctaggctttgcaccggtgtcccgttgcttgcacagcaccagtccagatccgctcaccttgtttatttgcaaatggttttgcagtaacaaaggtttactgcaaaagagagggccagggtaggcctcagggataggctgaggggtgactggatctaatcttcattcatgtgatttaaatgaaatacacagggttacctggacaccacactttttcccttgggaaaggattatagaatattccagcataatctatttggatatcatcttgttctatcctaaataacagaagagggaagtgacaattggcataccagtgcgaaacagggcatgcatgttaatgtttacatagtatttgtcttttcctaggataaggtttaacacttaccttgctggagggtacttcttcaaagcaatcaagtggtttatagttttccattaatgagaggagaataaattttgacttattatgtttatccacaatccaaacaaccagagggttcaaattaatacacttggggagtttcattgtgcatttgacggttttaagaacaagaacaagagtgagattacaggtcagcttcttaatgtattcaaagaataaaataagatttattttaatagacatcttttagattattacatgggctcaaacatagtttttcctaccgtctagttctgctctgagtcagggctatcaaaattaaatcatgtttactctgtggttttaatgtcctgtgtgtttttatattcttcctttcttttttttttttgctctttttgcccaggctggagtgcagtggcatgatctcggctcaccgcaacctcatcttcccgagttcaagccattctcatgtgtcagcctcccgagtagctgggattacaaggtgcacagcaccatgccgggctaattttgtatttttagtagagacagggtttctccatgttggtcaggctgatcttgaactgctgacctcaggtgatccacccacttcggcctcccaaagtgctggcattatagacacgaaccaccgcacccggcctatatgctttcttaatatccattctggatcagtgctgttggaagacaaaattacaacaaatttagttaaagatctaattagcttttattcttgatttgtgaatagggcaacctccgttctacaaaatagaataagagctcgatagggtaatagcacaacagtgggttttgtagggcggcaacaaagaaacagaacaataggtaaaaaagctgattggttaacgtcaagttacattaggttacttttttcctaagggttaaagcagaagcgacttccttattattctgactcaggaagactggaatcttctgatcgcaggaaaagctggtctgtttgagatgcacctccttctttaaagttttagtttgatcaagtggcatatggcatgagtggctgcattttggtttggtctcatcctggggcctagtgcaggggctcagtccaaaacagtgacctctcctgggccaggcatggtggcttctgtcatcccagcactttgggaggctgaggcggcagattgcctgaagccagaagtttgagacctcatctctaaaaaaacccaaaaaacaagccacacacacaccccatattaacattatatatatgtaacatctcccataatttttaacagaggtaacacatgtggacatgtttgtgtatctgtttaatcaatctgttattagtgacatagagttctaaaaaaccttttgtcatacatacaaacaattggaagattattttagcttggaataaactaaatacctgctgctataacaaaatgacaaaaatagcttaaactgggcaatttataaacaacagcaatttatagaattcttatagttctagaggctaagaagtccaagattaaggtgccagcagatttagtgtctgatgaggatcctgtcctcatagacggccatttccttgctctgtcctcatgtggtggaaggggcaaactgctctcttacatctctcttgctcttttttttttttttttttttttttgagatggagcctcgctctgtcacccaggctggtagcgcagtcttggctcactgcaacctctgcctcctggattcaagtgattctcctgcctcagcctcccgagtagctgggatcacaggcgtggaccaccatgcctggctaatttttgtatttttagtagagatggggtttcaccatgttggacaggctggtcttgaatccctgacctcaggtgatctgcccaccttggcctcccaaagttctgggattataggtgtgagccacagtgcccagctccatctctcttacaaggccactaatcctataaatgagggcttgccctcatgacttaatcacatcctaaaggtcccaccccttaatactatcacatttgtgttaagtttcaacattcgtatatttaaacttatgacacgtgtcatataatgtgtcatattacatattatgtgtcataatatggacacattcagaccatagcaaatagtactgtgcatatcatgcagtggatatgctaagttttagagtcaactttgtagaaaataacgtattgatgactagtactttaatatgttctggagtatcgggggaacccgcccccaatatttcaacataggttccattttccataagtgtcggccagctgagaaataaagagagacagtataaagagaggaatgttacagctgggccgccaggggtgacatcacatatcggtaggaccgtgatgcccgcctgagtctcagaccagcaagtttttattaagggtttcaaaaggggagggggtgtaagaacagggagtaggtacaaatatcacaggcttcaaagggcaaaaagcagaactactaataagggtctaacaaagatcacatgcttctgagggaacaggacaaagggcaaaagcagaactactgataagggtccaacaaagatcacagggcaaagggcaaaagcagaaccactgataagggtctatgttcagtgctgcacatattgtcttgataaacatcttaaataacagaaaacagggttcgagagcagagaactggtctgaccacaaatttaccagggtggagtttttccccaccttagtaagcctgagggtactgcagaagaccagggcgtatctcagtccttatctcaaccgcataagacagacattcccagagcagctgtttatagacctccccccagaaatgcattccttccccagagtattaatattaatattccttcctaggaaaagaatttagtgataccttctctacttgcacgcccatttataggctctctgcaagaagaaaaatatgggtgtttttgcctgaccctgcaggcagtcaaaccttatggttgtcttcccttgttccctaaaaatcgctgttattttattttttaaggtgtactgatttcatattgttcaaacacacatgttttacaatcaatttgtacagttaacacaattatcacagtggtcctgaggtgacatacatcctcagcttacgaagataacaggattaagagattaaagacaggcataataaattataaaagtattatttgagaactgatagatgtccgtgaaatcttcaaaacttatgttcctctgccgtggctccagccggtccctccattcggggtccctgacttcctgcaacactggagtttgttgttcagtaagtagtgatgatataatgtgcagtttattgcaaaacataaagtgtgctagattcactgccagtagttttaaataagagttcagatgaattctgcctggagcttcatcagggaagtgcttcgtcaggaaggaacagtaaaactgaaccttaatagagataggattgtgataaatgaaaatgttgaatgggaattttaggcatagaaagctgtcatgagcaaggttgtggggatgtgaaatatcaaatatttttaagatagccgatcatcctatttggtttagaatgtagagttctttaaaaagtaggagatgggaacagatagaagtagaaaagtcagctggggccagatgatagaaggtttctcattgcagtttaattaacttgagttttatttgcaagctgtgagagcatacaatgttttggctcatggaaacaaactgaccaaagagatggcattgaggatcaatgagactcatgagtgggatggtggcagagaaacagggcacagtgagggacctgtggagtggacagaaaggcctgaggtggtgagactaccatctcaaaatgggaaaaagaatcccctgggatggactgttgcagagaagggaggcagaaatcaaacagaactccattgtatgtatagctggtgttttggagaatggaaaatccattaaatggctagaggagatgaagagagttagttgagggttgaaaaaataacaaatgataaatttggagtataaaatcatattggagatccagaaagagaatgtttctacatctccttgttaatctgagctcttgtttttggtgggttaactcttttagctggatgctgacaaatatgagaatgatccagaattagaaaagatccgaagagagaggaactactcctggatggacatcataaccatatgcaaagataaactaccaaattatgaagaaaaggtaagggagccctggattacctggaaaagaagtatcattatattcactactaatagacgcaatattttctttcttttttcttttaatgtctgtatgaggccattcttgctttgctataaataaatacctgaaactgtgtaatttataagaaaagagatttaattggcccacagttctgcaggctctacaggaagcatgtgcttcctgtcaccaccatctgcttctggggaggcctcaggaagcttacatggcagaaggcaaagagggagcaggcttctcacataacaggagtgggaatgaaagagagagcaaggtgccacactgttttaaatgaccagatctcacaagaagttactcactgtagtgaggatagcaccaagaagatagtgctaagctattcatgagaaatccaccctcatgatccagtcacctcccaccaggtcccactttcaatactggggattacatttcaatatgaaatttgggtggagacacaaatctaaactgtattattctgccccggcccctcccaaatctcatgcccttcttgaatttcaaaatacaataatctcttcccaatagtcccccaaagtcttaacttcctctagcattaacttaaaagtcccaagttcaagtccaaagtctcatctgatactcatctccttttacctatgagcctgcaaaatcaaaacaagttagttactcccaagatacaaagcgggtaaaggcattaggtaaatattctcattccaaaagggggaaattggtcaaaagaaaggagctacaggacccatgaaagttcaaaactcagcagggcagccactaaatcttaaagctccaaaataataccctttgactccatgtcccacatctagggcacactggtgcaaggaatgggctcccaaggccttaggcagctctgtccctgtggctttgcaggggctcctgaggttgctctcatgggatggctttgagtgcctatagcttttgcaggtgcagggtgcaagctgccagtgaatctatcattcttgggtctgcaggatggtggttctcttcccacagctcctaggcagtgccccagtggggactttgtgagggggcttcaatcccacatttcccctctgcactgtcatagtagaggttctccatgagggtttctaccctgcaacagacttctgcctagacacccaggcttttccatacattctctgaaatctaggtggagaatcccaagcctcaacccttgcactctgtgcactcacaggcttaataacacatggaagccacaaaggctcatggcttgcaccctctggagctgtggcccaagctgtacctgggcccttttgatctgaggccagaaccctagcagaacccgagcagctgggatgcagggagcagtgtcctgaggctctgtagggcagaggggctctgggcctgacccatgaaaccattctctccttttagacctctggctctgtgatgggaggggctgctgaaaggtctctgaaatgcctctgaggttttttccccattgccttggctatgtttgaagttatgcagatttctctaggaagaggtctctgaaatgcctttgaggttttttccccattgtcttggctgtcagcccttggcttctttgtagttatgtgaatttctctaggaagtcgttgctctacaagcctgcttgaaatcctctctcaaaaactttttctttctttgccatgtggccaagttgcaaattttccaaacttttctgctctgcttcccttttaaatataagttccaacttcaggtcattcctttgcccttgcatctgcacataggctgttagaaacaggcaggaaacatcttgaacactttggtgcttagaaatttcttctaccatataccctaggcatcactctcaagttcaaacttccacagatccctagggcatgtacagaatgcagccaagttctttgctgaggcaaacgtgtgatgtttgttccagttcccgataaattcctcatttccatctgagacctcattagcctggactttattgtctgtatgactatcagcattttggtcacaatgagttaaccagtctctaaaaagttccaaactttccctcatcttcctgtctccttctgagccttctacacacttctagtctctgcgtgttactcaattccaaagctgcttccatattttcaggtatctttatagcaatgccccactccttggtaccattttttctgtattaggttgttcttgcattgctataaagaaatatctgagactgtgtaatttataagaaaatttataatctgcaggctctacaggaagcatgtgcttcctgtcaccaccatctgcttctggggaggcctcaggaagcttacagtcatggcagaaggcaaagagggagcaggcatcttacataacaggagtgggaatgaaagagagagcaaggtgccacactgttttaaatgaccagatctcacaagaagttactgtgtaatttagaagtaaattataagaaaaaggtttaattgcatctcagttcttcaggctgtacaggaaacatctgcttcctggcaccaccatctgcttctagagaggcctcaggaagcctacagtcatggcagaaggcaaagtgggagcaggcatctcacataacaggaatgggaacaagagagagaatgaagtgccacccagttttaaatagccagatcttgtgagaagtcactcactgtggtgaagacagcaccaagggagtggcgctgaaccattcatgagaaatccattcccgtgatccagtcacctcccaccaggccccatctccaacactgagaattacgatttaacatgagatttggttggggacatattgccaaactatatcaatgttttagtttggatttcatatcagagtaatgctgatctcataaaatgagctggaaagtagtccctcctgttcagtttcttggaagagtatgtgtagatagtattattctttccttatgtttggagattcaccagtgaagccatctggccttgtagttttctttgtgggaaggtttttaactgtgagttcaatttctttactagatgtagggctattcaggtaacccattttttcttgaatgagcattatttgtttgtttctctcaaggcatttgtccatttcatttgagttgtcaaatttattgccataaaaacatttggaatattttctattatccttttaatatctgtagagtatgtagtgctgtcttctctcattcctgatactgataatttgtgttttttctccctttcctgagtctggatagaggcttatcaattgtattgatcctctcaaaaaactttaggtttcattgatttttctctttttctattttttgtttcattggattctgctctgacatttataatttgtcttcttttacatgttttaatttgctcttttttctaagttccctaggtggaagctgaagtcactgatttgagttctttctttgtcattattattattattattctagaaacagacattattattattattactttgctctgccacccaggctaaagtgcagtggtgcaatcatagctcactgcagtcttgaatgcctaggcttaagcagtcctcccacttcggcctcctgagtagctaggactacaggtatgtgccaccatgccaggctaattttttttttttttttttttttgagacagagttccgctcttgttgcccaggctggagtgcaatggcacaatctcggctctccgcaacctccgcctcctgggttcaagcaattctcctgcctcagcctcctgagtagctgggattacagacatacgccaccatgtccagctaattttgtatttttagtagatacggggtttctccatgttggtcaggctggtctcaaactcctgatctcaggtgatcctcctgtcttggcctcccaaagtgctgggattacaggcatgagccaccgcacccggcctgcctaattttttttttttttttaattttttgtagcgttggaatctcaccaggttgttcaggttggtcttgaactcctggcctcaagtgatcctccctcctcggcctcgcagagtgttgtttttctttccttagtacgggggtttagtgctgtaaattttccccagagtactgctttagtggcttcacacaacttttgataatttcgatatactttttattttcatttcattttaaatacattctaattaatttactttttaattttatctttgacttgtgtggatgttttgttttgtttttagatatttgttagtttccaattatttgaggatttttctagatttttttatttgtttctaatttatttctggtgtagtcagagaataaactttgtataatttgagtcttcgtaaatatattgagacttgttttatggtccagaatgttatctgtcttggtgaatgtttcatgtgagcttgagaagaatgggtattccattgttgttgaatgaagtaatctatgaatgccaataagaacagttgattgatggtattattcagatcaactatatctttactgattttctgcttgctggatgtcaattactgttagtattgaaattgccaactgtaatagtggatttgtctatctttctttgcagttctatcagtgttagcctcacatattttgatgctcagctgttagataaatatgtgtttaagattgttatgttcccttggaagattgacccatttattattatataatgtccccctttatctctgatgattttgctgtttttaaaattaagatagctcccttggcttcttcccctccctccctccctccctcccttccttccttctttccttccttccgccctctctcccctcctctcctcccctctcctctccttttctccccttccccttccccttcccttcccttcttccttttttgacagagtattgctctgtcacccaggctgaaatgcagtggtgccatcatggctcactgcagcctcaacctctcaagctcaagtgatcctcccatctcagcctcccaggtagctgggactacaggtgcacaccaccacaactggctaattcatttttattgttcatagaggtggggtctccctatgttgcccaggctgcttttgaactcctgggctcaagtgatcttcttgccttggcctcccaaaatgctggaattactgacatgaggcactgtctctggccagcatttttttgatttgtgttaatatggtatatctttctccattcatttacatttaacctatttgtgtctttttatttagagagggcttcttgtagatgacatgtattatagttagtttttttaatccatttcgatggtttctttctgttaatggtatatttagatcattcatgtttaaattggttattaatacagttgaattaatgtctaccatatttgggactgttttctatttgttgtgcttgttctttgttattgttttttttttttttttttttttttttgagacagagtctcactctgttgcccaggctgaagtgcagtggcacgatcttggctcactgcaagctccacctcctaggttcatgccattctcctgcctcaacctcctgagtagctgggactacaggcacctgccaccacgcccagctaattttttcgtatttttagtagagatggggtttcactgtgttagccaggatggtctcgatctcctgacctcgtaatccaccctcctcggcctcccaaagtgctgggattacagatgtgagccaccgtgcccggcctattgttgtttttaaatattcccctctttttctgccttgtctggttttaattgaacattttatatgattctgctttctctcctcttagcttatcattaaaaaaaaatttagtggttgcctcagagtttacagtatacatttacccaataactgagtgttcccaattcctccctcccatctcttacaatgttgctgttatttattttattctccatatgttataatcacctaatacattgttactgacattactttgaataaacagttatcgattagatcaatgaagaacaaagaaataaaagattttagttttcttcttatttctgttctctctttccactttacttagatctgagattcagacctatataattttctttttcatttgaagaacttctgtaaacatttatttgcaaggtaggtcagtctacgggcgacaaattcttttcatttttgtttgtctgagaaagtctttatttcttcttcacttttaagggataattctgctggatacagattgctaggttggtagttttttttttcttgcttgcttgtatagtttctgaggaacggtctgatgtaattctttttcttttttcttctataggttaggtgcattttttcctttggcctttttcaaggttttctgtcttttgctttctgcagttttaatatgatatgcctaggtacagatattttggcatttatcctgcttggtgttctctcagtttcctggatctgtgtggtgtctgtcattaattttggaaaatttgtggacagtatttcaaatatttattcacttttttctcttctacttctgttataccatttatacatatgttacatcttttataattgttccacagttcagggctattttgttctcccccaatccctgctccccatggacatgtcttcaagcttgctgattcttccttcacaattgtgagtcaattaaacttctttcctttataaattacccagtcttgggcagttgtttatagcagcataagaacggactaatacaaagggctctatggaaaaagtagacaacatgcaagaacagatgggtaatataagcagagagagggaagctcagagagagtcaaaagaaaatgctggagatcaaaatcactctaacacaaacaaagaatacctttttttcattgtattgcctttggtcctttgtcaaagatcagttgatctatttttctactatttcaccagtgtctcagtcttgactactatagcatgatagtaagtcttgaagtcaggtagtgtcggttcttcaactttgttcttcttcaatattgtgttgggtattctgggtcttgtgcctctccagataaacttcacagtcagtttgctgatatgtgcaaaataactagctggaactttgaattggattgtactgaacctatagattaagtttggaaaaatggacatcttaacactactgagtcttcctattcatgaacttggaatttctctccatttgtttagtttttgatttgtttcatcagagttttgtagttttcttgtagatcttatgcatattttgttagattcatacctaagcatttcatttttgggggtgcaaatgtatatggttttgtgttttgaatttcaaatatcacttgctgtgtttctggtatataggaaagtgattaacttttgtgtattaaccctgtatcctgcaaacttgccatgattgcttgttagttccaggagcttttctttgttgattcttttggatttcctacctagacagtgataccatctgcgagcaaagggagttttatttcttcctttctaatcagtatgccttatatttcttcatattgcattagctaggacagtctcagtcttgtagtcagcctgtgcctctgggctgtgaacttcaccagcgtttctcagactccctcctttaagtgggacatgatggctggaagcagctggacttggggtttcccttcctctcctgtcttagtcagctcaggcttccataagcaaataccataaactgggtggcttaaacaacaaacatttatttctcacagtctgcaggcagggacgcccaaggtcaggacactggcagctttggtgtcttgtgagagctgcttcctggtttatagacgactgtgttttcacatggtgggtgggtagaagaagcaagctcttttgggacttttataaggacactaatcccattcatgagggctccaccctcatcacgttatctaatcctaattacctcccaaagacaccacctgctaataccaccatattagagggtagggtttcagcccatggacccgggggagggggatcatagtattcagtccataacatggagttccgaaggggctggagtttcgtgtttcccttcacccaggtcaggctctcatgaaagcccagcaggctgggatctggctggctgagctctcctgagttgaggccttcataagaagagatttcagatgtatcctgatagacttcagaatggccccctttccctccctctgccagaagcacagggaattttccctgatactcactgttgggacccagtagagcttttgcaggtaaaatttacaaaagtgtgaggcccctgatgactgggtctggagttttttttagctctcagacttgtctacactgagcccccaactggtcaagtacagtttgggtttctcgaccccagccctgcttcccataggggtttctgctctggttaggtgtggatctttctgtctgcctgtctctccagtgtgaggggctgtggtttgctctgtgacttcgcttctcttacagatttaaaaagagttggtttttcagtttgttctgcttttacttgataggatggagtggtggcttctaagctctttagaaaacatatgcaggtgaacaaacaatataaacatacgcaggtaaactgacaatacaaacatacacaggtgaaccaacaatgcagacatacacaggtgaaccaacaatacaaacataggtgaaccaacaatgcaaacatactcaggtgaaccaacaatacaaacatacacaggtgaacagacaatacaaacatacacaggtgaacagaaaatacaaacatacacaggtgaactgacaatgcaaacatactcaggtgaaccaacaacgcaaacatacgcaggtgaaccgacaatacaaacatacgcaggtgaaccaacaatgcagacatacacaggtgagccaacaatagaaacatactcaggtgaaccaacaatacaaacatacacaggtgaacaaacagtacaaacatacacaggtgaacagacaatacaaacatacgcaggcgaacagacaatacagacatacacaggtgaaccaacaatacaaacatacgcaggtgaaccgacaataccagatagaactaagagcagaagagcttaaggatgtggaaattgttcaaaaatagatctgtcgtgtgagttccttttctctatgtcaaatgattcttcctggttagagtccacatattgtctttatttctcactgagtgccctacagttcattagattctggtggatgtaaatggtgtgactctgacgtggaagttgagatgagccagcctcttctcagccacgttttatctcacataacagaggctggcctgctgctgatgttgtaagttacattagcttcatcattgctgttttctggaattacttctctcctggtataaaaccctcttgctgataccggcttattctttgtttttctaaaataaccttattttctgacgatcttgtgattgccactggtttcctcagtgttaggtcgtgtgtttgtagcggaatcctacgcagtggtgttgtgagtaagcgtgtccgagggcccctcactgctgatgtcaacgtgccctgggtgaaatcggcgtccgtcaagtctctccatggggaagttccttttcttttcctctgtaactagtaagaaatgtgtggaaagttacttttagaccatgaatatcccatttcccctcaaactttcactcaacgtttttcgtaagtcgtgatgattcctgcctttgtgggctgtgactgtcatggccgtgcagtggcgctcacccgggggttggttttcactgtcaggaggcatgtccccctcttctctgttcactcggcatccactggggctggaggccttcttgtctcacttgttggtctagggtctattcttgctgggatttatgttgatcttcacgttgtcccagacctcaggcttggcaagcagcagcctcgttagctgacttctgtcccctggcgcatccccagcccattactttctggacctacagcgtgtccaggcccacctcctgcttttcctgaccttgtgcggggtcagctgctcttcctggcacttagccctggcacttagaaactcggatgggagtgccctgcagagtcgctgtgctcaggtgctttctgtggacgggatgagtaccatgcgagtgaatgcacgtgtgtgagtgtgtacgtgtgtatgtgtgcatgtgagtgtgtgaatgtaggcgtgtgtgtgtacgtgtgcatgagtgtgaatgcacacgtgtgagtgtacgtccgtatgtgtgcatgagtgtgaatgcactcgtgtgtgtacgtgtgcatgtgtgtgaatgtgcgtgtgagtacgtgtgtatgtgtgcatgtgtgtgaatgtgcgtgtgagtacgtgtgtatgtgtgcatgtgtgtgaatgtgcgtgtcagtgtgtatgtgtgcatgtgtgtgaatgcacatgagtgagtgttacgtgtgtgcatgtgtgtgaatgcacatgagagagtgttacgtgtgtgcatgtgtgtgaatgcatgcatgtatgtgtgcatgtgagtgtgaatgtacgcatgtgagagcgtgtacgtgtgtgtgcgtgtgtaggtttgtgtgtgaatgctagcatgggagtgtgtgtgcttgtgtgacagtgcgcctgtgtgagtgtgcatgtgtccctgtgtgtgtgacaagtagttcaaacagacacctctaattccagttacatccacagggctttcctttgccttcctcatcagtatttgtatctttcctctcactgtgagaggcctggctcccagtcatatcaatgttttttcccatcctctcaatccccacaacacacacaacagcatcagcatggcagcacccagaccatgacaagcagcaggcctactgagtgcaacctaagcttgggttgcggtttttctgtcttagcctgaggatgtagtcaaaataatatgttcaagagttatttccgtttgtcgccgtgtgcggtggctcacgcctgtaatcctagcactttgggagactgaggtgggcagatcacccaaggacgagagttcgaggccagcctgaccaacatggagaaaccccgtctctactaaaaatataaaattagctgggtgtggtgatcatgcctgtgaccccagctacttgggaggctgaggcagagaattgcttgaacctgggaggcggaggttgaagtgagccgagatcgcgccattgcactccagcctgggcaacaagagtgaaattccgtctcaaaaaaaaaaaaaaaaaaagagctatttccgtttgtcttttctttctgtgtggctatgaatagactgatttcaaatttaaggttttcctcctaatcttgttttcattttatttatgattttgtaacacataacaaggtaggctgggggcagtggctcatgcctgtaatcccagtgctttgggaggccaaggcaggaggatcacttgaggcctggagtttgagactagcctgggcaacataataagaccctgtctctagaaaaaatttttttaaaaaattagccaggtatggtagtgcacgcctgtagtcccagctactgggaaggctgaggcaggaggatctcttgagccccagagtttgaggctgtagtgagtcatgattgtgcccctgcactccagcctgagcaacagagtgaaaccctgtctctgtgtgtgtgtgtgtgtgtgtgtgtgtgtgtgtgtgtgtgtggagcgggaggtgtggagatatgaacagtgcaggcagaatcagattataagggcacagtcttggtgaagggggtatggatatttactgtaaaatactctcaatgtttttgcatacttgaatatttttattataaaatattaggaagaaaacactttcagaaagacacaaaagtcagaccaggcgtggtggcttccacctggaatcccagcactgtgggaggccgaggcaggtggatgacctgaggtcaggagtttgagaccagcctggccaacatgttgaaaccccatctctactgagaatacaaaaattagctgggtatagtggtaggtacctgtaatcccagctacttgggaggcacgagaatcgcttgaatcggggaggcggaggttgcagtgagctgagattgtgccactgcactccagcctgggcaacagagcgagactccacctaaaaaaaaaaatacacaaaagtcaatgtgaagacatagaaaatgcttgtggagtctgtgcctgcctccctgcaatgtccactggcttctcactcaccctgtgtgttgtgatttcatgactgctgtgtgcagcacactgggtgggtgtgagcatggggccagggtgtctttggggcagtctcgttgtgtgaggttgggccagtgacttagcctctctgtgccaccatttccacatctgtaaaacggggctgatagagcagccacctcgtggggccgtgcgggttgggtgagttggcctgtgtgaagtgttcagaacctttgcttcaggtctgttcactttcagttactgcccatttgttgacaggtttcataaaatattctagctctggcccttgtactgttaggaaaataattcttagcaagtgtagtttcatttttatggagagaagtcccattcacctcagctctggcccaccaaaggctcaggctgctgagtgggtgggtgtgagcttgcgtgacaggtctctggtagactcacaggaatgttccttctgcactagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaaggtgggagtgctgtgctttctccccaggcccggcctgtgtggtggccctggccgtggcatctctgccgctgaactgcgcggcttccgcagactccaagcgcggtcgctgggctcgggactcctcgacctgtgcttcaaggagagtctgtggagccgcaggcgatgtccgaggtgacagctgtccttccgtggcagcctccgtggcccctgcctgcgatcctggtggacaggtgtgcatttcatacccaggcggggcaggtacaggcggcggcaggtacatgcggcggcaggtacacacccacgagcctggccctgccccagcccttgcttggcggtgaggcatctctagggttgtcaccccagcccgtgtttggtggtgaggcgcctgtagggttgttatgttgccatactgtcacttttaaaaacatttcagttttggaattgaacagtaacgcagtccagtcaggattggcaataaacacagataaggtagttttggggttcactggaggcgattggggtaatgctgatttaagggtaatttttgaataaatactaaatgcacatggtttaaaatttagaaatatgaaaggggacctggtgaaaggtctccctctgacccctgttcccagcctcccagtttctctccctgaaagtaaccagtattccactaaaaaaattatttttagagtgactttacacatatccaagtgcatgtcagtcaggattcttttttttttttttttctttgagatggagtctcactttgtcgcccaggctggcatgtagtggcttgatctcggctcaatgcaacctccacctcccaagctcaagcgattctcctgcctcagcctcctgagtagctgggattactggggcacaccaccacgcccggctaatttttgtgtttttagtagagacggggtttcaccatgttggccaggctggtctcaaactcctgacctcaggtgatccacccaccttggcctcccatggttctacattttacttttttctacatgatgttcactggggactgtttcatttcagtgtctacaagcctcagccctgattacagctgcacagtactctggcgctggacatgctgtactgtatttaaccattaatttatttcagtgagtcattgacccccaacaatgagtatatacattgttctcaattttttgctcttgtgaacagggctgtaataaatacccttacatgcttgtcattttgcacttctgtgtgtttttctgtagggtaaattcctaaaagtaaaaactgaattaaaaggcacgtgcgtttttagtctggacggatgtggctgaattgtcctctcctgcccaccagcaacatgtgggccctgatgctaattcttaggaaaactgtagccaaatgaggcggagaggaggtggagggtacatggggttggagccagtgcttttcctgactgtgtgtctctatagagagcacggaggtgcggagttcaacaccaagcctcagctccagatgctcttacctggcacgtgaggacaggcagggccagctgcaccacctgatacaaattttccttccacgaataaaatgtggcctaaattgttaaagacgcagaataaaaatagcaagtaaagtgtttatagcaattaatgttaacaagttgatatgttaataaatactaagtagaaggccggctggtttaatgagatgctgggtgtgtttgtctgttttccagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactg

SEQ ID NO: 38200 - DNA, 154283 bp, Homo sapiens
ggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggtgagtcctggccgccacccgccggcggaccccggcccgcgctctcgcgccccttcgctcccctattccctgcgcgctcagtccccgtgatcccctcgctctccgcacccctctcgtagcccccgtccccctcgtccgcgcgccccctggttccccgggtccccctggctcccctagtccgtgcgcccctcgctctccgcgcccctcgctctccgcaccccgcctgttctccgcctccccgccgtccgtgcgcccctctggtccgcccccgctctcaccctgccggggtccgggtccgagcctgccccgggcttactccgctctttcctcccggcccgcgagtccccggatccgcggcgacctcgcggggacccccagcggggacggggcagtggcggcgagtctggggccccgagggctttctcctccgcttttgatagtttccttccggcagaaagtttaagttgctcagccaagtcgctgagtgctcttttgcctcctgggggcaattgatttactcacgtaaaacagaaaaataaaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccgcccgtgtcattggcaaagctggtctcatgaaaaccatttcctaaaaaagggcagcgaaagggtcgcattcttgtgcgaactgatctgtcaagatgggggtacaagaactgtagaaagaggaaatgatttcggtgaggactgaattgtgccagcgtctctaggcttcctctaggctcttgtggaacctccggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcccccgacttgctcagccacagccaggatctagtctggtctttctctgttgacctttttgtgtggcaggagtgggttttcctgttccccaggccctctaatatttccagacataaattccaggaatcccatgcttccctcttgaggggccatttcagcctcaggaaaggccttcagagacttagaaggaatgtcgtgttccaaggaatgaagaggcagccttgatgtgccgtgtttgtcaggactggccttgggaaaggtgaaataggacatatttttgcctttttttctgcaactcttttctcttgacttttactgaggtggtccaagccctgccgtgtcacaggaccccttattttcagtttcggtgtttagggacaggtctctatgtcctcctaccaggacactgatcaggtggcaagaaccctgtgtcaagaggcaggaaacctaggctctcgttctttcccaccaaagagctgtgtcgttttagcaaagcaactcagtggcctcatctatgaaatgggcataataacatgttccccctttaggcagaggactacaccagatgatctcttaagatacatgttaccatttcctgctaatctatgagttcagggtgccaattagcaaacctgggagaggaggaagctggaggaaatctctttacttcttttatctccaagaaagatacacactctttgagtggcttcctgcagacagtgccttacctttgccagttctgtgtgtaggaatttgaacttggagttggaagaaccatgccaaagcagagaaagaagaggtttctgggcagacggaggctttgaaacatcaatcgtggccggtcgcgttggctcacacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccgggcgacagagtgagactctatctcaaagaaaagaaaacaaaagaaaagaaacatcagtcatatcacaccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcaggctgtgtttctagctgctcatccaattaggctgattctctgggtgggataacattgagggagatcaaaaccatttgactgtcttcggtttactctcttctctctctctctctctcctcttttttgttttgagacaaggtcacattctgtcatccaggctggagtgcagtggtgccatcatagctcactgcaccctccaactcctgggctcagtggatccttctgcatcagcctaggtttattctcttgattcgagagaccctgtggatcagtcagtgctaagtccaaaagtcctttaaaaaatatatgtatatttttgagatagggtctcactctgtcacccaggctggagtgcaatggtgccatcctggctcactgcagcctcagcctcccaagctcaggtgatcctcccacctcagcctgccaagtagctgggaccacaggtgtgtaccacccagcccagctaatactttttattatttttgtagagatggggtctccctatgttgcccaggctctttcaacattttaacaggaaccttgggctcatttgtgctttgcgtagggaggtctgtcttttctgggtgaagttttgtgtgtggctggcattcagcttcctgttttttagccatgagacacctccctgaagtcttgctatgaccaagaccctgacagccacaccttctttctgcctgttagaatcactttctgtcgggtttcccttataaggtgatagagaacatagacttcataacaaaatatcactctcactgggaaggctgaggggttggtctttttgtgcctggtactgtgctcagtggggacttggggacatgcttcgcatttaaggtataggttgttttaggcatgggcagtaggcgctttcagcacaggctccctgctggtcactctttgctgtagtttcctgctccatccatggggtcggaggtcttacctcctgacgttagagtcatttgcagcaggtgggagtgaaagtgggccgggtgccaggtcttctttacctgaacctctcctgtcttcctggcacattaggaatgtccaagcttatttctattggtgaatgctcccacatgggatggataatggcctgtggaacattctctgaatgctttgtgttcttggaaaaccaaggactgaagagcgttgggtttgtttaggttacctgttataaattcttggctcacatttcatgtgtggactttcttgggtttattccacatggggacagcccagcaagcctttgtgaacgccctttcctggcctgagccgagtcacctgtggaagtcagccgtgcaggagggtgtgcttgatagggggaagcaccctgggcaggaccccatgagtttccttcttaccaggaaagtgtcattcgtcccactttgtgatctgaactggtattatgaaacatgaagcttaaaggcaacaaagtatgttaacaacaacaacaaaaaatacttaacaaaaacaacactgaggcagcagctgcttcaaccccaaaggtggaaaagtttcccagtatgcatttttaacacacatcaccatgtggcaagaagcaggaggaagggagagagtggggaggaggagaaagagaaggaggggacctttgttttgttatctccttggggtatttgtgtgcgtgcacttaaaaactgcgtgcacttaaaaactgcttcctgatggaatcccaaagagatttatatttggactttggttgtcttgacaacaatttagaaattcctaccacttcctcaatagctgagtgatcagttaaaagagccgatggcttccctgcttctggtaaggagcttgttgaagcatcttgtgatctttgttggaatgtatatggtggctcattaaagagcagtcaaatacctgggatttggtgagacatctgggtaatgggtacttcacctatgtccagggccttcgcatggaaggcctcttgtctccccagggacactaggacgcaagagtagaacagatttatactcacagtaaggcagatcatcagaactgtgcaacctcacatgagttgctatgagcactgtatgacagagtatccaataaggtgataagaatttgttagtgttattgtggaaggaagtaatgcataggatagtgggttgggctaggtaatgatcacatttgctttccaagtctgagattctagtaacttactattttttctcccgagactggcatttcttggggaagggggatggtggggagggttgagtggctagccacagcatttatttcttggcacaactgattcctctactaaattgaaccatttgtggaaagtatgttcagcattggtgactctgggtacgttctatgttacacgagaataaatatgatatagtgggctatcttcccagcagtgcctggcatatggtaacactgtgtcttatgcacccatcccaggctgatggaatccatcagggtccctttgttcctcctttgttcagggtcagcattgctgctttcatcctccctcagctttcagagctcagtgcatctctggagtgtgtatcagaatcatttgaggagcattttcaagcttctcatggtcccttcccccatcccttatgtcttaatttgagctgctgtcacaaaaataccataggctggagggcttaaacaatagacatttaattctcacagttctggaggttgggaagtctaagaccaaggcgctggcagatctagtgcctggtgagggctcgatttctggtttgcagacagctgccttcttgctgtaacttcacatgactgagagagtgctcggtctctttctcttcttataaggacgccaaccccattcatgaaggctctaccctcacaacctaagcacctcccaaaggcccacctcctaatatcctcacattggaggttaggcttcaaaatgggaattttgttggagggacacaaatattaattccatagtaccttgtcaatagtgttcaggcatgtggcctctacttttgccctggcccaatgacactgttttagtgagtgtgatatatcctttaggtctgctctaaggccacagccatgagaaaataggaaactttacattttaagatgctaggacagtggtccccaacctttttggcactagggatcagttttgtggaagacgatttttccacagatgggagcaggaggcgggggatggttttaggatgaaactgttccacgtcagatcatcaggcattagttagattctcatgaggagcatgcaacttagatccctcacatgcgcagttcacaacagggtttgcactcctgtgagaatctaatgtcaccattgatttgacaggaggcagagctcagctggtaatgctcactcactgttcacctcctgctgtgcaacctggttcctaacaagccatgggtcagtaccgccccaggggttggggacctctgtgctagaacgcaaaagcttttgagttcactaattggaaaagacctttaaaatttaattaagcctggtagataacgcttatttggtgtttgcatgcctgtgcagattttacactttcatttatcttagtttttatcacttatgacatgtgtttgaaaatggaataggtattcattcattcagccattcaccatttgtggagtgtttcttttatgctgggagctgtgggtggctgcatgtagacaggatggcagtgattgttgccttcccaaagacacgaacacaccagcagtgagctctgtggcattgactggattcttattatggtgcttaccatggcccaccatgcggaacagaagtagtgtgttgtgatgatgagaaatactgactgtcatcccgcttagtagacttgacggcatgggagggacagaaagttcttgctccaggtctgtcttgggtacctgctgtcgcacagtgctgtgctaactctgctagagacagaaagtaggtcaggcagggatctggtccctgcctgggatggagaggcttctggttggttcctgtgccacacgcacaggaacacggcccttgctgatgggtgtgaggcaggaggtgttgcatgtatagtgggatatggtgggagtcaaatacagcgggggctgtgaagtggggagttgggaaggtttcttggagtaggaaggatttgaacagtgcctaaagggacagggaaggaaaggtgggtgtgcactccaggccctggcagggggcttggatctcactgtattttctggcacagtccctcccctcccagcctgcccactcttccattgacaccccctactccctgtctctctagcactgggtcttttatttttaattccctttgccccctttttttttttttgaaaaatttaaaacttacacagcagttgaaaggactatgaatgtcccctagattcagcaggagtaacattttgtcacttgtcctttgtctctctctctctctttttttttttttttttttgacatggagtctcgctctgtcaaccagcctggggtgcagtggcacaatctcggctcactgcaacctccacctcctgggttcaagcgattctcttgcctcagtctcctgagtagctgaaatcacaagtgtgcaacaccatgcccagctaatttttgtattttttttagtagagatggcgtttcaccacgttggccggctggtctcgaactcctggcctcaagcaatctgcctgccttgacctcccaaagtgttgggattacaggcgtgagccactgtgcccagcctgtctttctgtttataaataatactaaacatttttttttgaaccatttaaaagtaagttgcagacatggtggcactttacccacaaatacttcagtatgtgtcttttaggaaaaagggcattctcctatgtaaccacaatactatgctcccatcccctaaattgaacatgaacacagggtatcaaacatatggtccatgttcagatgtttccagttgcccccaaatgtcctttccagctatttaaagggtccagttagagatcatgtatttcatttggttgtcctgtctctttagtcactgtgcatctaaaacagttccccttcttttttccccatgactctggcatttttgaagaagccaggccagttgtcttgtaggcggtcccaagatctggaagtgtctgattgtttcctcattacttctttcaggttcattgtttgggtgagaatacaacgcaggcgatctcgagtggtcttattttttaacgtgatcatgtataatattaaaatactctttcccacttatctctgtggcatttatttaaaaaaatttcttagcttctgcaagtgtcaggcagtggtgtgtctgacacagaactttgacctcttggagcctacattttagcaggaaggtagggaaaataaatcatatggtctgttaggaggtggtatgtgctttatgggaaaagaaggcaagaggtgggagtgggctggcgggggtgacaattgagtgtgctcagtgtcttcagagcccaggatggaggcgtctgcctcttatttacccggggattgacgctggtcctacagcttcctcctgtggtaagctgctgagctgtggagaggagagtatgtcctgaggagccagagtggtcttttttgttacctaactttgtcagcagaaatgaggaaaagaaaaatggaatttttatttgagacggagtcttgctctgtcacccaggctggaatgcagtggtgtgatcataactcattatagcctcgaactcctgggctcaagtgatcctcctgcctcagcttcctgagtagctgggactacaggcgtgccaccacacttggctaattttctttctttctttctttcttttttttttggtagagatggggtcttgctgtgttgtccaggctagtcttgaattcatgggctcaagcgatcctcccacttcagcctccccaaaaatattgggattacaggtgtgagtcactttgcccagccaaaaagtgggcttcttttttgtttttttgttttttgagacagggtcttactctgtcatccaggctggagtgcaatggtgcgatcacagctcactgcagcctcaacctcccagtctcaagtgatcctcctgcttccgaaaagtcggatttaacatcaggtcaccaaatgggtttttcactgtgggatcttttgatgagtttttttcgaatacatttccttggtttagatgtctcagacctgcttgaattctctagaagtcatgaatgtggcttctgtttgcaccatatttaacccagaagatatcttaggctactttcagttcccccagaggtgcctaggagactcgagttatcagaaaattgaaggggcctgcaggacagcaaacagaacacagggaggtcatttcccttctattttctcttctttgaacaggatgtcacagagagctagatgcctttctatcaatgtatttttttttgaagaaaaggatacctgcattctccaggactactctctgccttcatggaatcactttcctaactaggatctgcaaatataatgtgtcgctctgggagggaaggacagagggagaaagtggagagaagaagagagaaagaggagaagagaagaagaaagacagagagacacgcacgtacacacacagacacacgtacacacagtatgtggagtatcacataaaatttgcccactgctggcaaggagaaagagcaaggtgttcttgtgtgtttgtttgttttttaaataatcagattattggccagggcatttacatttatggcaaggttaattaagaaagttttatttatttactttttatttattttatttactttttttgagaccgggtcttgcccaggctggagtgcagtggtgcaatcacagctcactgcagccttgacctcccgggttcaagcaatgcttctacctcagcctcccgagtagctgggactataggtgcccaccaccacacttggataatttttttggtttcttttgtagagatggggcttgccacgttgcccaggctggtcttgaactcctgggctcaagtgatccacctgcctcagcctcccaaagtgctgggattagaaagtgttttttaaagttcatctcatggcatcaatactacgtagttaatttatacttcattttagcagctaaaatattttctgaatttttttgtttgtttgtttgagatggagttttgcttttgttaccaaggctggagtgcagtggtgtgatctcgactcactgcagcctctgcctcctgggttcaagcagttctcttgcgtcagcctcccaagtagctgggattacaggcatgcgccaccatgcctggctaattttgtatttttagtagagatggggtttcactatgttggtcaggctggtcttgaactcttgacctcaggtgacccacctgcctcggcctcccaaagtgctgggattacaggcatgagccactgcaaccagccttattttctgaactttcataataaacttctaaagagctaattttttaaattatcaagtagtttagtctttttgggctgttatagtaaagcaccatagactgggggctgaaaaacaacagaaatgtatttccttcagttctggaggctgaaagtccaccatcagggtgccaatacgggcaggttctggtgagggctctctaaggggttgcagactgagtcttcccattgggtaagggagctccctggggcctcttccataagggcactaatcccattcatgagagctctagccttctgacctaatcaccttccaaaggctctacctcctagtattgtcactttggaggtcaggatttcaacatacaaattttggggatcacaaatattcagaccataacataaagtgatgcatgctaattacaatttgaaggccaggcatggtgactcacgcctgtaatcccagcactttgggaagccaaggatggtggctcacttgaggtcaggagttcgagaccagcctggccaacatggtgaaaccccctctctgctaaaaatacaaaaattagctgagcgtggtggcgtgcgcctataatcccagctactagggaggctggagcatgagaatcacttgaacctaggaggtggaggttgcagggagccgagattgtgccactgtactccagcccgggtgacagagcaagactctgtctcaaaaaaaaaaaaaaaaaaaaaaaaaaaaaatatatatatatatatatatatatatatataaataaataaatttgatctaattatgagggaggggaaatgatctagtagtgaaatgatacatgctgttgtagttttagactgtagaggtgaggaatacaggatgatggctttaatcccattttttaataatgacacatcattgtattagctggcaatatcctatttgttctcctctttagtttgtttgtaatcccacagccaaagataagtcatcctgcttgccctccttttctgtaacactcacctcctcatttaacttcttttttttctgtcttttgtttcacgttcggaggacggctttatattttaggaccaatgtcaacctcaccatcctgccctgtatttcttctgttatgtcgctgctttttttctgcccctgcaggatcattttcttccatcattttaatttattttcttattctctccacttcacacgatgagtcatcagcccgacctccttgaaagaggcatccaaggcttcgcttttacaggaaagtgtttctaaccctgcttttcacttgctcccaccctttcagtgggagtgtgccaaactccttcccgccgtgccacagcaggcactcagcaagccgcggggcacagcagggtgctgccagggatgccgtcaagcctggccaggctcaccttttttttttagatggagtcttgctctgtcacccaggctggagtgcagtggcacaatctcggctcactgcaacttccgcctcctgggttcaagcaattctcctgcctcagcctcccaagtagttggaattacacgcatgcaccaccatgcccggctaatttttctatttttagtagagatggggtttcgccatgttggccaggctggtctcgaactcctgacttcaagtgatccacccgcctcgacctcccaaagtgctaggattacaggcgtgagccaccacacccagcctgaaatctttagttatcaaagttgtattacatgggtgctatgcggtagtttctgtccttgaggtttacagtctaacaatgtccttggcctgctagggcgtacatgggaaaagttaggtaacagtaccagacatcccagtgggatatcgccagatgcttagttgccagatgttcagaaggtgagggctggtggagtttggggtgaccagggagagcgtgtggtgtctgctaatgaaccagaagaagggctgatgtcaggtgaggtgcggagggggcgtgtctgggagccggtgggagtggcttcacttacatgagacacacacacacagggagaaggttccccaagattcggtgtcagagtggttacctgcctggtgcggggggtagatttgggcctataagtaattttctctttttttttttttttgcttctctgtattggtttatttagtgagcatgtattactttgtgtaatttcgttaaaacctgcaaaatgtgttgcaggggacaaggagatgcttgacagggcgagatccatttggttcttactggaaataagtggtacactggtaatgaaattggaaagtgactctaggtccgattataaaggggtcttgcagtttgagtttatagcttcggtgaaatgacaggtctggcatcaacaggatgcagatttggcttagcaggtagtgctgtgctttcacctgtgcaggtcgttctctggggtccgtggtccatcatgggagggcagccacctccttttggggaatggtgacctcttcatggggtgatatttgggctttttcaccattctctgatttcctattcctcaaaatggggtctaggaaagttatgagcctgtctatccgtcttagggttctacaggttttctgtgtgtggcatatctgttttctgtgtgctgttatttgaaaaataaataaaagtatatcctgtatcttccaggtcatcatcctgtcacagaattctgtgtgacaacgttaacgtcattaatactggctaaggagaaaataaccgatgtagagttagtatacaaataattggggtcgaccggggacagtggctcatgcctgtagtaatcccagcacttcgggaggccaaggcaggcagatcacttgaggtcaggagttccagaccagcctggccaacatggtgaaaccctgtctctaccaaaaaatataaaaaattagctgggtgtggtggtgcatgcctgtaatcccagctactcaggaggctgaggcaggagaattgttttaacatgggaggtggaggttgcagtgagctgagattgcgccactgcactccaacctggctgacagagcgagactccatctaaaaaaaaaaaaaaagaaataactggggccatgtgaagaccatgtgattctgcagcacatgcagcaggtgtttactgagtgcctgctgtataccaggcagtttctaggggttgggggaatagcaggtaacaacatggactgtccctgacctcatggagctgatattctagtaggggtgacaggcggtgcacaaataccgagtgtggcagatggtgaggggtgctgtggagaaaaggaaagtgaggaagggccctgggcatgctggttgggaggagtgtggtttcaggtaggggcttgagaaggcatttctgaaaggaggcatctgagtgaagatcaaagagacagtactcagggcagccatgtgtgccaccagacagagaggtctgtgaggctggagcagggtggatgtgcctggtgagtctgaggaacagcaggcgagcagtgtgactggggcaggaaagagaagggagggagaggagggtgtagaagggggttaggtcagggaggtttggggctggatcaggcgcggtcttgcgggctggtgtaggaactttggcatttccttggaatcaagtgagagagcttgctaaggttttggtacagagcaaggacatgatctgacttagcttttatgagattgccctggcagctgtgtgagggctgaccacaggaggatgcagaaggaacatgggagcggtggtgacttccagagtgtagcagcaaggtggtgcacatgatcccatgtaagctgtgttttgaaggtagagctgacaaacgttgctgatggactgtgtatggagcacaagggaattaaaccatgacatggtgcatgatgcgtacctcggaatccagccacagtggagcaacactgttcatcatgtgaaactaatgtcaagtggaaggtcgttggctttatagtttaatttgtatttaatcaatgtatctgtgtctattttgtagtttcagaatagcacagtttatgtgtacccttattatttgtgtatatttatacagtggaatagttaatgactacctcagggtccatgagattgtttttccccttatgaaagtatgtggagtcttaaaggggcctgagaaaccctgctctaaccactgtgattatccagggactgatggaaccgatctgttcccttacgaagtgtcacagtattggcaggactctggacaaggacaaggaaggctgcattcctgtggcaccaccaggtggaagatggaggtatgttctcaggtatggccagtgtctgccaagatgcaattcctcagctctacagttttactactttttctggtatgacacaactaatagacaaccttgcaaatcctagctactcccatgactagatgcagatactattgaaacctcagaagtctgtgttgcaaaataaagcaaagaatgcaataggttttgttcataaaagcattttttttttgagaccaagtctcgttctgccacccaggctggagtgcagtggtgtggtcttggctcactgcaacctctgcctcccgggttcaagcaattcttgtgcctcatcctcccgagtagctgggattacaggcgtgtggcaccatgcccggctaatttttgtgtttttagtggagatggggtttcaccatgttgtccaggctggtctcaaactcctgacctcaggtgatctccctgcctcagcctcccaaagtgctaggattacaggcgtgagccaccgtgcctggcctgtaaaagcatttttatgagcatgtgaataatgaactcagtcatttcaagatcttccaaaacaattcatttgttagggaattgttagtaaatatggcaaataaaaatttttaaaaatacctctatttaaaaagatgagttatatatattatttttcatagattaatcttagcaagacaattttcttagtccattttgtgttttgtaacagaacacctgcgactgggtaatatataaagaaattggctcacgattctggtggctggaaagtccaggacggggcagctgcatctggtgagggcctcagtctgcttccactcatggcagaaagtggaagcgaagtgggtgtgtgcaaagagatcacatggtgagagaggatacaagagagcaaaaccaaataagccagactctttaccaaccgattgtttctggaactaatccattcctgctagagtcagaactcacccaccccagtggaacggcattaagtgtattcataatgatccatccctataacccaaacacctcccgcgaggcccacctcccaacgctattacactggtgatcaaatttcaacacaagttttggtggggacaaacagactacatctaaagcatagcaagaacctagtgtgtaatattgtataatcaaaatataagtatttaaaaaacattattcactttgggaggccgaggcgggcagatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtaagccgagatcccgccactgcactccagcctgggcgacagagcgagactccgtctcaaaaaaaaaaaaaaaaacaaaaaaaaaacattattattgaaatgatacttcacataatgtactgatttacacatgttgctactgttaatgagaattgcatgactggacacttcatttgcatcagcgctttgcttctgacttgttaatcttaactgttgtgtcacaaataaccagatgtgcacattcttatttgtgcttatgaacaaagtagttacactctacttgtgccttctttatatgcccttggcttcttccttattaaaaatatccgtgggtgaaagaaaaacagtaattgtagactcacaggcactataataatttgtaattgcttctgctgtgaatctcggcaacatcaggaatgattgagaaggattggtacatagccctggaatgcacgcctttcttttaaggaagcgcttcagaatgcctttgattaagaaggatgtcattatgcagatgagcttgtaattgttctagtgtttgaaaaaggtaatagccccataatcctaagcacgtagacttgtactgagtataactcatgtgccagggactgtgctcagtgtttgctacctattgccgcataacaaactaccctgacctcagtggctccaaataacaacttgttaatatttctcacagttctgtaggttgactgggctcagatgagcagtggttagttatctgaaggctttgttgcttacctgtctggtgagcggaccgggcaggctgggtcggttgggtgctaatcaagcaactctctccaagtggcccctctacctgggtagcttgggcttcctcatagcatggagtctcagggtggccagtcttgtcatatggtggctggttgagttcacagcaagtgttccagagccttgggaggtgggtgctaaaagacttcttctgacctagcctcacagatcccagaatgccatttctaccacattttattgatcaagcattttaccaaggtaaatgctttgcttcagcccagaagcaaagagaggagaattagactccacctcttgatgggaggaatagcaagaatttgtgatcatccttaatctaccctactgaataagtgctttacataaattatgacattaataggcttataagggcaagttctattctcatctttatcttgctaatgaagagactgcagcacagggatttaagtaacatgctcaaggactgactgctaataaaggatgcttcgagcaatagaactagctttgtatgattctaaatcccaatgcacataataacttaactgtgccacaaaccagttatttttgttattgttatatgttacaaattatttgttcaaaactggcatgtagtagggagagcaccactggtctgatagaatggactttttaaaaataaggggtcttgtattaaaaacataatttaataattttattgaataatttgaaccaggtttgaagcatttccgtggaaggaaaacatgcaaattcccacaatgttagggtcctggtcaggttctttggagttacaggtaactgtttgtcatttctgggaatgtatgagatgtgcagaggcaaagtccagtatcagagatggtctcaccttgatggcagtaaaaggctcaaatgcgtttataataataccaacagcagcagcgacaacaatatatttgtttagcactttacagtttacagtgaactgtcctcatgttatttcatttagtcctcaaataactctatgtggttggctttttgtcttcgatctgcaggtgtgaaggacagaggcttagccatgtgaaatgtttttgctcaatgtcataaaggccatgtgggaagtggaccctaagccaggcagtgtgactgctccagggttcccagctccacagtgcaggaggcaaccatttccagttcttttcttcctttactttctcataggatactttttaagcactataaattgggttcaggaaatgtcagtttgtgaaatgtgatcaatccagaaggccaacctgctggactgcaggggactgttagagatcagaggttcccaggtctgctattacagctgttgggtcactgtgcaagcactgctgtcagggtggcacagtggagggcagatgagccctggcagcaggtggacttgggcacgtattcgctgtggcaaatcatgtaatctctggggctcacttttctcattgcaaaatactgacagtttgcgtagataatgcctctaacggggaaccttgcctggcatgtaatattcaagatattaccttagcagcctcttctcccagactgttttacatcctcgtaactttaaggcttaagggagtttaagtagattgtttccacaagaggagctctggctgagctgttctctttatatactttgctacggggtctggcaagtaaaaggtgctgagtaatagctttcaattcactaaatgaatactgtagaacatcattattttcattcattcgactaaatttataacatactctaaattttttattgaagtataacatacaaagtgcactaatcttcagtttaatgcacgatggactttcacaaatggaacagacctatgtaaacacctgggtcaagaaataatgttaccagctgtccagaagcccaccctgttcccccttccaagcattaccttaaaaaaaaagtaactagttgtcttgacttctaacactgtaacatttatttttgcttgtttttaagttgtagcagatgcttactgtaggatctttgttttttttaggtacttatactaagatggcattaatagacgttcttaggaccaaagggctggggcagaatgtgctgccattgggccacaagtgtgcagagacatggatgctggcctggggagatgggctgggtaggctgtggccctttggcttcttccagctgtagccatgtgggcccgtatgccctggtgctatgtagataatagcactttctctgtttgctgggatgtgaataaggttggaaagcagtgtcttcagaggccttgtaaaattgattaaaatgagaagcatattacttttattttgctttgttttgtttagagacagggtctctctctgtcgtctaggctagagtgcagtggtgtgatcatagcttactgcagcctcaaactcgcaggctcacacaatcctcccacctcagtgtcctgagtagctgggaccacaggtcctccagcacacttggctaatttttaaattttttgtagagacagtgttctcgttatgttgtcgaggctggtctcgaactcctggcctcaagggatccttttgccttggcctcccaaagtgctgggattataggcatgaaccactgtgtccggcctgagaagcatgttaattgtgtataattaagccattttaaagtgctcaagggtgtttgaaaacagttctctcaaatattaaaaatgtcttgtttccatttttaatgaacaaaacctttctatgaagaaaatctttgctaagatcagtctttcctcttaccccagctttactgaggtatagttgacaagtaaaaattgaatgtccacttttaaggtatgcaatatgatgttttgattgtatacattatgaaatgattaccacagttaagctaattaacacattcattatctcacatagttatcttttttgtggtaagaatactttgagatctactctcttagcaaatagatcagtctttttaaagttgtttttaatgactaaacttaatgtatacttgtaaagaataaaaaaggtacacataggtataaaatgaaaagtaaaaaagaccacctttctctactaatgtcttctatttcttgtgtattttttaagctatggtctatgcatatgcaaacattttcttgcctttttcctctaaaggtaaaccttgagtattattccttggccccatgtatagagcaatcccacttattttaaaagtcacatagtgttctctcacaacagtatatcatgatttacttaactggtgccctaatgataaatgttgaggtagttttcattttttggctttacaaacaattctgcaataaaaatctttgtacctgaatcttaatgtacgtgaatgaaatgtatttgtgggattttctagaaatagaacgttgggtcagagaataggagattgatatctaaaaagatattgcaaaattaacctcaaatattgcgccaatttacactccctttaaatgtttgatgacatgattttctacacccttacaacacaaaatataacctaattttttgtttgtttgtttgtttgttttgagacaggggctcattccatcacctaggcaggagtgcagtggtacaatcttggctcactacaacctctgcctcccaggttctagcgattctcatgcctcagcctaccgagtagctgggattacaggtgtttgccaccacacctggctaatttttgtatttttagtagagatggggtttcaccatgttggccaggctggtctcgaactcctgacctcacgtgatgcacccctccttggcttcgctaagtgctgggattacaggcgtgagccaccccacccaaccatgaatataataaatttttttatttttgctaatattatagattaaaaatgataatctattttaatttgcatttctttataatgacaatggatattttaaaaatttgtttattgactgactatatttttctgttacctgccccttcacatcgtttacccattttcaactgggttgtttttgttactgatttgtgagtaatctttgtatattaagaagctaaactctttgttatttgtattgcatatgtttttcctcagtttgttgtttcatgtttcactgtttactgtcttttaaaaaatcataccgatatttagaaatcttcatttagttaactatatcaatcttttgtgattttgatgttttatgtcttgcttagaaaatccttctctactctaatattataaaagtatttagcgcgatggctcatgtctgtaatcccagcactttggaaggctgaggcgggcggatcacgaggggaggagatcgagaccatcctgtctaacatggtgaaaccccatctgtactaaaaatataaaaaattagccgggcgtggtggtgggcacctgtagtcccagctactcaggagactgaggcaggagaatggcgtaaaccagggagggggagcttgcagtgagccaagatcacgccagtgcactccagcctgggggacagagtgagactccgtctcaaaaaaaaaaaaaagtgtttagctatattttgtcctagtactttcatattttcttttttacattttaaattatttgagcacgtggattttgggataaagaaccagctagggatttagtctcccctcccccacccccctctaaatgcctagctggttgctttaataccatgtattgattaattcataatcattatctactggtctgacatgttatctttgtcataaatgagatttccatgtgtatgtgtgtctgtttttggactctatgttctattaaaattttaattaatttctgaatttgagaaaaatcagagccagtagtgtccgaattatgaatttacccctggttgtttttttactcttctcttgatgtacttctcacacactgcattctgttgcataaaaagaataacatggtgttgaatgacagatctaaagatggacatttgtctatgtggtaaatacgtggtagattctgggtgatttttcatatgcttcatataaaaaatgatcgtacataaaataacttttttggaaggaacataatctgagccattcagatacaacgaaatccagctcctctctatagcatcgctgtgggtgtagctaaaatatgagattttaagtttaaaaacaacttctgcatgttatttggaaatattttttactaatttcttacgcagcccaaaacttaatgggcaaatttaaaatacgcatttagtgtcttagtattttacaaagtccttcgagcctcaccttatcttttttttttttttttgacacagagtcttgctctgttgcccgggctggagtgcagtggcatgatcttggctcactgcagcctctgcctctcgggctcagacaattctcccgtctcagcctcccaaatagctggaattacaggcatgtgccaccatgcccagctaatttttgtattttttttagtagagacagggtctcaccgtgttagccaggctggtcttgtaccccgacctcatgtgttcccccatgttggcctcccaaagtgctgggattataggcatgagccaccacacccggtcctcactgtatttttgaaaacatggttacagaattagttgcatgtggagaagctgaaatgctatatgtaaatcctctttcctgattaccagcattctcctaatgcaaagtgtgtgaagtgacagcagagaagatatcaaagggtttggtgcttgggacattctgtattgtcaatgtgagatgcccagtgagatggaagttctgcacagggtggctgggcggcaggcattcatttccgtaagcctctctctttcctcctatatggtatgtgatgagtttgggggaaagcatctgcatttaagctctgttctggtggagagagggaagaggtctcagtgtttatcgtctcccatgagttgagtgtgcaggatctgtagccaacaactcttgagttttgagagttccatgtgagcctcactacatgctaagtcagaaccacagggtgagtgaatgctctttctctgctccatctggcttctgtcttcttaacagcatatctgctgtttcacatagctgcatatcaagccagttttttgtttttgagatgggggttctcactgtgttgatcaggctggtctcgaactcctggactcaagtgatcgtcccgccttagcttcccgagtagttgggactacagatatgtgcccagctacaagctggctcttttatttttggggcagtttaaccacttggcattgtcaggtcttccctaagcttcccttggtcttttcttccattttgctgtttttttggacattaaataatttattacctctaccaggtgcttggacagaataaagtaaaagagagaatcgttatgttagaaaattaacttgtgcaaggtgacataaaattctctctgctgttgattcatccatgctggctttgccagtggtcatgagggtaaccagtgattcaactgtatgggagggaatctgccctttctgagtggatctcacaaggtgattcctgtgtgatgatgtaaagatgagaacctttctgggaatttgctttttttttttttttttttgaggcagagtctagctctatcaccctggctggagtgcagtggtgtgatcttggctcactgcagcctctgccttccgggttcacgattctcctgcctcagcctcctgagtagctgggattacaggcgtgtggcaccacgcccagctgatttttgtatttttagtacagacagggttttgccatgttggccaggctggtctcgaactcctggcctcaagtgatctgcctgcctcagctcccaaagtgcctggattacaggcatgagccaccatgcctggcctgaatttgctttttatctatgataataagctcctcacccaaacagataggaattgaactcagacaaattttaatgtgcacacatttgcaaaggtaggcttgcatttttcattcactttctcttttatatatttacatgcgcagaggacaaaatgcagaagacacacaggatgagcagcgagaaacgatgcccagcctccgtctccctcagctctgccactcctctccccaggggcaccagtcactagtaatgccctcagagctcttgggttcatccagcatgggctctgctctgcctatgcaggtaccagaccatcttcgtccagggggacgtggagtcacacgcatgcaggcaacaaggagagggccggtcaccggatgaggctgggcccctggggcaggggtttcatcagagccctaggtctgctctgtctccagagaaacctccccagaggcccaagtcctgcacccactgcagcagggcagggctgtagccaggtgagcagagggcagaatcctcccctggaatacattagaccctgtggtgacattagttcatgctcagtgctctgttcacaatctctggtcctcacaacggccctgttagcgggttaggtgtgggcatgcagtgaggtgggtcctggaacttgtacccaggcttgtctgacaccagagcccatgctctccaccacagccgtgtctccaacctctccctagtgcttggtgctactgcaaggacttctttttccttctccccttaactgtcatgataaagtgacagcatctcagacaaatttaaaaattccctgaaggaatcagctggttggcgctgaactttgcagggtgccgtgaacaccctgggctggagtctgaatgcattgctttcctcatgcaacagtattgactgagccactgtaaacacacaagagttttgctgggtgctgagtgtattgtgagttttcatcgtctgtgctaatgctcatcttactgagcataataacctggagcatgacctatattgaattcacttggtggttgctgcaggatgcttaaaggaatgaaacttgagggtaggttaagggaagcaatggtgatgagctgagctttcaccaggtggcacctggctctggatgctgatgtgtttggatcagtggtagaaaacaagcaaatagaatggcgagttagacagtttccactgcgcacagcacttgggtgttttccatgctataaatctttattttttccactttggtttgagtgggatcacttccattggagctaatccagaaattgctaattcagtgggaattgtgagtctataagttaggaataaattgagcttaacatgcaatatattggaaatgatcctagatcctggatccttcctcttcccaaacagtgagctgtgagggagtcactcctcccaccaggttagaaccatccgacgtgtgcagatgtggcatatatggtgtatgttctgagggacaaaatgacgacccctgactgcagtgtggctccagcattgcttgcttccaggctgaccagggacaggtgtcctggaagatggctcttcctgttcccagagctgtcccacccttcagtgtccacaggcattctggaagcccaggttctccttcattctgcttaatagctcggcctagaattctcattcgtattctgtgcctggagacccaatccaaactccaagcctcattccattttcctgggctctggttccctccaggattcggtccacaggtgggtgtggacaagactgctgggaccacggccttggttccctgctctgttgatgaggttcttgggctcagacaccacctgcagcccttctgcagccagcctctccgttgcctgcaaacccttgcccatccttccctcaagactccctcagagacattgtaccgttgttttctagtgatccttgaaatttgatgcagtagctcttagaaagaagagactagaaaaaaaataggaggcatggttactggggagggggggcttggttggtaaaaataagtgaattttgctggcatgggtcaaattcctcccaactgaaaagaggggagtatctattaatacaaatgtaaagaggggagaaaatgtgttctgttacatgggagaggcatgccctgtagtcaggagcctgtgtccagttatgtgagatggaagctggggggcagggtggcggggaggagggagggagggagggagggaggaaggctaaactaaggtcatgcactcaggtcctcaggtacataagagctagtatctatcgcactctatatactgacactggacgaactccttccctgcactgtcacagccctgtgaggtgttgctcttcctgtcactattgtgcaattgagatggaagcctggagaagttaaatacttgctcagggccccgcagccagtaagtggcaggacctgtgcttacctcctggcctatggactccagcgattgtgttgtgaagccaccacacccgctgcctttcctgaacacggacaggaagcgttacatacctaacgaggagaacatgggcaaaaccttgcgagtttaagttgtgagtgagctaagggtgagccgagaggatgactgtagccaagcctggcagcctggggagcctatctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtgagagacaagttgtgtgtggttttattctttccatatccatttctttttgtttggttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttgttgtcgtcgttgttgttgttttgtttttttttgagatggagtctcgctctgtcgcccaggctggagtgcagtggtgcaatctcggctcactgcaacctctgcctcccgggttcaagtgattctcctgtctcagcctctcaagtagctgggattataggcgcctgccaccatgcctgcctaagttttgtatttttagtagagacgtggtttcaccatgttagccaggctggtctcgaactcctgacctcaagtgatccgcctgccctggcctcccaaagtgtagggattataggtgtgagccaccatgcccggccctcagtcttgtttttagcagcatttgcctgtgtctgctcacggatcatagtccacagtttgtcaaagttgacagttgggctgaagctctgtttcctctttaagtggtaatgcctcacaccagctttcccacataacctgggtgacatttgtcaaagttgatcctgtggtggtgcacaccacctgcattaccacagcctccacggtgcttccgcactcggtgatgtggccatggccgtggctcgtgtggccctgaagtttccggctcttcctcagtctggatggcatgtcagacaaaagaggaagatttctacaaagtctcttaaggtattgagcacctatttctccttttaaaaacgggcaagctgagcacagttgtgcatgcccataatcccagctacttgggaggctgaggtgggaggatcgcttgagcccaggagtttgagatcagcttgggcaaaggggaatttttctttcattatcattttgatgtagaaaatcagtaacatcttctttgccaatatgaaaacatgtttttctttaagcagagtcttgctgtcagccagattggagtgccatggtgagataatagcttaccgcagtcttgaactcctgagtacaagggatcctcctgcctcatcctcctgagtaggtgggactacagacatgcaccaccaagcctggctaatttttaaaatttttgcagcgatggggtctcactaggttgccccggctggtctggaactcctgggctcacacaaccctcctgcctgagcctcctgagtagccgggatcacaggtgcacaccaccatgcctggctaatttttcattaaaaattttttttagagggtcttgctaggttgcccagactggtattgaactacttgcctcaagtgatcctctcccctcagcttctcaaagtgatgggattacagatgtgaaccaccatgcctagcctgaaaacatttccttttgattctagcatttagatcctaaacctaaaaccgttgccctagaattgcgctgcccacttttgctgctgatcttattccctgtccagacctttgaggaccagagttggttgggcctccctcccagatgatgctcagggtactggatgctggagtgcagggactttctctggtgactgtggggaagcccctgccctctcccctccctttttttttcatttgttgattggcaaagctgagatttcccagtgtatgtgaatttggtttggttcatttgtaaaccccttgacaactctgtacatcagaataatggcattcctcttgggagtattttgtaattatttgctcagtgtgtaatatcccattaaatatccaaagtcaattcagcaaatgtttattaataataagatttgccgaaagcaagagaagtcttaagtgggttatgcctacagtttctagaaagccttcagattgtggtggtaaaaaaacttggctttgtaaattttgtgtaattcgtattagaagatgctaatttattttaaaagcacagtactcttttgtggtaaatttccaagtttgcccctgtcatttgaaaagcttttggtgtgagtgttttcagatgttattgggtggtaggggcaaggactcgttatttttgttttcaaatatgtattatctctttcaaatagctattaaaatttattatgtatttgcacttataaatgttttatgtaccaatttaaaaaatggatcaatagatttctgtgtctagcagagaatcgattaatgagttttgaatagtgtgccaaggtgactcagctttatgactttccatggatgacagattctgcccctgcgacaaggtcaagcccataaaaattccaatcagataccacaaaaagcacagtttcataggtcagtttaattctatagcagtcttttttgtcagcatagctggcgattccatctgttttaatttaagattcaccccagccatgcctctgtagcaggtgacacgtgcacacacacacacacccccacacccacacactgtttccttatgtaacatacatgatgtaaatatgtaatataaatgtatagttatgtagaatataaatatatttacattgtagtagaggctgagtcggtggtataatagagcatctgcaattcaatatttagagtataaagctgtttttcctttgtgaaaccatttgttttccatacactgcttggtgttgggcggggaaataatgcagttacttatctgctacactaacgagcagatgactgtcctcctctcctgcggctcttctgcagaaatgagtcgccacagtgaattgcttgtgtttattattctggtcatgggttagcaccaggtgtcacagtgaatcaatcttggattggtaaaaggttgtcacgacggcagaaaattgcaggctagagcaaattgtcctatgcccattacagaatctcaagtaatgatggttggttatgcatggaggggctgaaatagtccatagcataaggaaaccaagcaggggtctctaaataggtcagagggttctaacagataccccacccccttctgcttttaaaagctcttgttactgaatggtcataaagagagttttgtctgccccccacgctaaccaacaagacaggcttaccaacaacgtggtcctggcaggcagccagccggccggcatttaaatgatgcttgctgctgtggcaaccccacgggcctttaatgggtgagcgtggatgcagcagctgaaggccaagtgcatcatggaaggcagcggtgcaagcacagccctggttccaatgacttaacgccgcctgggccactgcaagaccggtgtggcagacagaccccctggcgaggagctaactgtggggtgggtggtgggatattgtgaaatgtgtatttggtcttcatccctgtttcctaaaacccttagaatctctggagcaaagagtattttttgcctgctcatgatggactgatagctggcagcccccaggtagctttaggatggggctggtcacaggaaagaccaaggcaagatgggagggttgggacttttagccccaccaccaatctccagggaagggacctccagggaagggaaggggcggaaggttgagttgatcaccagtggccattggtttaatcaggcatgcctacgtcatgaagtttccataaaaacccaaaagggtgagtttggagagcttctggatagctgaacatgtggaggctcctggagggcggcgcaggggcacactggggagggcatggaagtcccacaccccttcccacatgccttgccctacaagtctcttcatctgcatcctgtgtaacatcctttataataaactggtgaatgtcagtaagtgtttcccggggttctgtgagccactctagcaaattaatcaaacctgaggaagtggtcatgggaaccctgatttgcagcccatcaatcagaagcacaggacaccttcctccttgtgctaggcctctggagtaggaggaggcagccttgtaggactcagcctcccgctgtgggatctgacattatctccaggtaggtagcttcacaattgagttgaactagagaacactcagagaactagagaacgctggtgtccgctgaagaatcagtggcttgcttggtgtgtggggaaaacctcctgtacatttggtcacagaagcattttgtgttgtgagagtagactaggagaaaaaacattttgtttttctactcaggtggcatgttccaaataaaaacactggaaagaatatgagtttaaagaaatggattgtaatgcatgatatagttgcatactatataaatacatctcgtaaatttggatttcattgccttagaatttctaagaatttggccaggcacggtggcttacgcccgtaatcccagcactttgggaggccaaggcaggcggatcatgaggtcaggagatcgagaccatcctgactaacacggtgaaactccgtctctactaaaaataaaaaattagctgggtgtggtggcgagcacctgtagtcccagctactcaggaggctgaggcaggagaatggcgtgaacctgggaggcagagcttgcagtgggccgagattgtgccactgcactccagtcttggcaacagagggagactctgtctcaaaaaaaagaatttgtaagaattcagactcagggtgcaggatgaatttactgcttaggaagatgtaatgtgctaaaaaaaaaaaaaaagtaaacaaactatctggatgattcttagcctatggagagtaaagcacaggtttttaagtttcttagatacactgtattgatgaggatacagactaagctgctgaaacaggagatcccagattatagtgacttcagctttttcagtcctcctggtggctggttcagggcttgtttggtggcttgtggggtcatcacattgtatactctcctgtcctgtgtgccagcacctggtcacatggccacccctgactgcaaggaagatgggaaaatgtcatcgttagctgggtaaccaggggcccagctaaaactcagggttctttttctaatagttgaaagggagagtgagtatcacagagccccagcagtttctctcctaagcatcttttattttccaatgaggacactgccaggccagttgtgtcttccttggctagagctttgatctgcaaacttggagctgattctgacctcagaccctggggtgacgagaggagctctatgattctagttagaccagcctaatggatgaatcctgactccctcacttgctgtttgtgtggccttcagttcggctgttgagcctctctgacattccgattcactggtaatgataactgtctcacaaagtcattgtaacaagtattttgagaacatccaggataatgccagtcatatgatgagttttcagtaaaagttcctttgttccttcctctataggatgaatcatagaaatcatctacttacctaacgcttccagtgaaacaagttaatttgctcagagcctgatttaatttgcattattgcatcaggatgacacctctttacagtaaagttatttatacttctccaaatgcaaaatttaaaattattttggctggacgtggtggctctcgcctgtaatcccagcactttgggaggccgaggaaggtggatcacttgaggtcaggagttcgagaccagcctggcaacatggtgaaaccctgtctctactaaaaatgcaaaaattagctgggcgtggtggcgcacacctgtaatcccagctactcaggaggctgaggcaggagaattgcttgaatctgggaggtggaggttgcagtgagccaagattgcaccactgcactccagcctgggcaacagagtaagactctgtctcaaaaaaaaaaattcttttggtgggttaatgttacccagaagcagatcatactgtgctcacacatcttctgtccacatcataccaatgctagaataaagggggtaaacagaaaaacaggttttcttgggaaatgacatatggaagttgctgcacaggggtctctaatggcagaggtgcctccagggggctttgatatgtcagcagtagcagcgcacactgcaatgccttccttgcttgtagtaagtggcctctgggttcttaaaacaagaccctattgtgtaagatgctggacttgggaaaacccctggcaggggctgcattgaggctggtgactcctgttggggcattgtgtgctgcatagtgtaataggcagccactctaggcccagcatggtggctcacgcctgtaatcccagcactttggaaggccgaggtgggcggatcacttgaggtcaggagttcgagaccagcccggccaacatggtgaaactccgtctccactaaaagcacaaaaattagccaggtgtggtggcgggcacctataatcccagctactagggaggctgaggcaggagaattgcttgaacctggtggggcagaggttgcagtgagccgagataacgctactgcactccagcctgggcaacagagtaaaactccgtctcaaaaaaaaaaaaaaaaaaaaaaaaaaaggcagctgctctgggcacccctggattgtggcaaacttcagaattgggtgtcagtgctaagtgaccaagacaataccaccgtggatggatcacaagggctggagttgcagagtcagagctgatggagctttcctgccagccacgcaccatctgtccagtgggaagtcctttctgtgctgggaggaaggggccagcaggaccacttgtcctgcgccagtgccagcctctctcagcctgtgtgcagcacgtacatgtccatggcagccctcggctggatctcagggctgtgggcaggggtggaggccactgctaggctgtcctgctgctccagcagccccctcaggggccgttgacttttcacaggaacccaggcctgccattgagggtggagatttcatttggaaatgctcgcctcacttcccatgcggttcctctgtctgctttatgagcgggacatacccctcatccactgcctcatccaggtttcctggtgtggcagggtccccagggacccagagggagccaggaaatgtgagtcagtggcttcccaaagtggctgcctggcctgtggtgtcatagggctgctgctgtctgccctttgtcctgtctcacgctgtccccagccctcccagcactggccgttgagaagacagagttgagttgactgtcactgttgtcttggggaagaccacccggcaaagcactggcagggctcgaagtgggaaggcaaggtcagactggattgagagttgcaactgtgattgaaggcggtctttcaaagcaggctcttggtgagggttgggtaagaatcgcgatattgcagcgcagagttggtggaaacagcaagcaagggtttcgaggacttcaaagactcctaggggcaaacttctactgcttcctactgaagagtggatgggccttcagggaagttcctggcaggaacagtcctcccatttgtctgggcggatggtccggaagagcaaagacatgctaatgagacagaggaatagcaagtccccttcaagccgacaggaaggggcctcagttctcagcgccagcctgagtgtgggggctgcttggctcggcctgtttccacgctagggacgttctacgtgttttcttcttcatggctttttgttttctaataaaagatgtttctattcataaatgttgtagatgaggataatgtctatttgttttattttggaggggcagggttggggaaggctgaggaagggggctgtctgattgctggctcatgcccaattacagtttatttcctccctgagtgccctctttgatgtgggaaggaaagggaatgaaatccttctcttttactcatgagcagtgcagacgccttctccggacagtttggcttgacctgtgcagagtgctttttccccagcgaaatggaacaggaaagctcacggcagcaagtggcagaggggtggagccacaacttggctctttttccttcttcttttccttcttcttctttttaaaaaaaatccagtccactaaagcacgaatgtttttcaaagtcgcaaatgaaatacagtaggattttaaaaaaccaaagctgtctttcaacatgttgatgttctcggactgtagcaaacatggtttggacttgtccatttagaaagcagtgtaaacaggctctgaaatgccattgtaccaagggaaatgaggacatgcggcaaagctttaagaattcagcccctagacctgcttttgactgaaatagttttgcttgaaataatttattttccttgaattttttgatttttatttcttcagttctgtctggtcaccttccctgtataggcatgaccagcacctgaggaagaatgattaacacatgtacaaataacttaaatgtactcgaaagctataaaacaatatgtgtgttactgaaaataaacagatagtgtaatacctggattataaacatcttgatcccttgaaaataaagtattgccttaattcaaataataatacctcaatgtttatatagtgcctatctgaaaagtatttaaagttactgttattttctagatttcctggcgggttgattcactggagggctagttggttagggaggtagcacctgagctgccaccctctcacagctcccagatggacatggagttgggcgctgggtgggtttgggaaagctcctgggtccggccctcccggatatgcttcctgccccagggcttcaggggatctgcgttctcaggccacatgcaaaaccagttgttaatcatccctgacacactctgagtcaccaccaccctctgggaagccacagggagaccttggctgaagccaccgcagcaccatgtttcgccatcttgcagccaagtctgtttatttgtctgcctttggcacctccaggacctctgtcttttgattgttggtctcagtttgcagacagatctaactgtggactcccgggtgcggtctgtgcctgttgggaagatgggcagctgactcacttcactgtcatcccctcacccatcttctgtggtcccaggctccacttacctcctctatatgaccctgtaggcgcagtgggtgctttaatcatggggcacagtgggtgcattaatctttcctcattttagtttgcatttttatttagcggtggagttgcctccatgaatttctgttctcatccacacctttagtttttctctttttattttccatgtcatagtaggaggaaatttggaattagcagaaaacattactgagtatttccagtggaaaactatgcattgtgtagagcatacccttccaaggtatctgattgtagcctttgatccatttcatacctccgtaagttgtaggtaattggtagcaatgcaaaataactattgcctgtagacatgcaaaaatgtctgttagcatggctaaaatgaccccctccaagccgtaggaaaagcaaagttcgtatttgtaaattcatttcaacattcctttactccatatatacttatgcttctctgacttctccttttaactggttgtaacatcttattaattccctaattaatggtgaagtcaataaaatctttgacatgttcattttgtatctgtatgagagttgattttacctttgattattatttttaacgtaatattttatggtccctattaaaaataacaaaggcaccgtgcttcctggttaaccagtgacaagaatgggccctaacaagaggaacttggatgcaaaaagcagaatgaattaatcctgagggcttaagacattggaagtttttctcttaatattgtaaaaatgtgtagactcataaacaaccaatagtcaaagaagaaattacaatggaaattggaaattaccttgagatgaatgaagacaaaagcacaacattccaaaacttcagagcagtgctcagagggaaacttatagccataaacacctacattaaaaaaagagaaagacttcaaatcaataacccaattttacaacatagggaactagaagaagaagagcaaaataaactcaaagttacaaattgtaggaaatacagagtgaagagaaatgaaatagagaatagaaaaataatagggaaaatcagtgaaaccaaaagttggttctttgaagatcaacaaaatcaacataccttaagctacattactaagaaaaaaagagaaaagaagtaaatcactaaaattaaaaacaaaatgggacattactactgaccttacagaaatgaaaaagattataagagaatactatgatcacttgtaagccaacaggttagataacctagaagaattagacaaattcctagacacacaaaactaccaaactgtctcaagaagaaacagaaagtctgaatagacttaaaacaagtaaggagaatcagtaatcaaaaacctcccaaaagaaaggctcaggaccagatcgctctactggtaaattctaccaaacatttaaagaagcataacatcagttgctcttaatctcttccaaatatagaagaggagggaatacatctaatttattttatgaggccagcattatactgatgaagcctgacaaagatattacaagaacactatagaccaatatcccttacaatatagaagcaaaaatcctgaatgaaatactggcaaactgaacccagaagtatattaaaaggattatacaccatgaccagatggggtttatcccaggagtgcaagggtggtttgacatactaaaacggatcgatgtaatacaccatattaatagaaagagggaaaaacaccacctgatcctttcaattgatgctgaaaaagtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaacaagacaaggatgcccactttcaccgtggctgttcaacataggaagtcttacccagagcaattacgcatgtaaaagaagtaaacggcatctgaatagagaagaaagaagtaaaactatctctgttgcaggtgatatggtcctagatatagaaaatttcaaagaattcacaaaaaacaactactggaactaatacattcagtgaagtcacaggatacaagttaaacatgcaaaaataagttgtgtgtttttacaccagcagtgaacaatttgaaattaccaaaatgattccatttataatagcatttagaagaataacatttaaccaaatacatttaaccaaagaggtgaaaaacatatacaatgaaaactaaagaacatttcacattgctgaaagaaatcaaagaagacataagtaaattgaaataaatccctattcatggattggaagacttcttatgggtaagatggcaatactacccaaagcgatcaacagattcaatgcaatatctatcaaaattccaaatgtgtttcttgcagaaatggaaatgctgactctcaaatacatacagaattgcaggaggccccaaatagccaaaacaatcttgataaagaacaaagttgaaggactcaacacttcctgatttcaaaacttactacaaaattatggtaatcaaaatagtgtggtactgacataaagataagccatacagaccaaggaaatagaattgagatttcagaaataaattcatacatttatggtgactgattttcaataagagtacgaagatcagtcaatagggaaaaaatagtctgttcaaccaatggtgttgggacaaccagatatccacatgtttaagtttaatccctacttacacatttgcataccctttatacaaaaatcaattcaaaatgctcaatgacctaaatataggagctaagtctgtaaaacttctaatggaaaacatagagtgaaatctccatgactttgtttttggcaatggattcttagacatgaaagcaaaagcataagtaacaaaagaaaatgcataaattggacctcatcaaaattaaaaacgtgcatcaaaggacagtattaagaaagtgaaaagacagcctacagaatgagagaaaatatttacaaatcaaatatctgttaagggcctggtatccagatataaagtacttttacaattcaacacaaaaagacaaagtactcagttaagcaatgagcaaaggatttgaatagaccttctccagagaagacatacagatggccaagaagcacataaaaagctgctcaacatcattagtcattaggtaaatgcagattaaaaccacagtaaaatatcactttataaccactaggatggctatttaaaaaaatgttggcgaggatgtgcagagattggaacactggtggggttgtaaaatggtccagtctctgtggaaaacagtgctttggtgattcctcaaaaagttaaacatagagttaccatatgacccagcaattctactcctaggtatatgccacaaagaactgaaaagaggtactcaaatacttgtacattcataatagccaaaaggtggaagcaacccaaatgtctatgatgaatggatgagcaaattgtgatataaacatacaatgaaaaattattcagctgtaaaaatgaataaactaccgacacatggtacaatgtggatgaaccttgaaaacattatactaaatgagagaaaccagacacaaaaggtcacatattgtgtgattcctttcatagggcttgtgcagagtaagtcagtacatggagattaagtagatatgtgattgccaggggtggagaaggggcaatggggaataactgcttaatgaatatggagtgatttgggggtgaagaaagtgttttggagttagataagggtggcggttgccaccattgtggatgtactaaatgccactgagttgttcactttaaaatggtgaattttatgctatgtgaatttcagcacatacaaaaattgatatggtttatatgtgagtaattagttcctagtaggaagagggtttagatcaacagtattaaatattctccccctgaaaacacatggcacatataacacctacggtcaacggcatccacacaggaaacacagtcccaggaactcccaggattatgcacaatttcgatgagtttcctgaataccacctcatcattaactctgattaattacaagttactggtggcgtatctcgcagaagcaaggtgaggtgattaggtgatggtcattctaacttttgataattttgagggacagcagtgtagggagaaaatactagtgtaaaacattatatttgtctgggtgcagtggctcaagcctgtaatctcagcaccttgggaggccgaagcaggaggatcgcttgagcacaggagttggagaccagcctggacaacacagtgagaccctatctctaccccctacccccaaataataataattagccaggcatggtggcatggaccggtagtcccagctactcaggaggctgaggtgggaggatcgcttgagcccagaaggttgaggctacagtaagccatgattgcaccactgcactccagcctaggtggcagagcaagaccctgtctcaaaaacaaaaaagctacatttatatagattagcctaaagaacgtaaaatttgtatcctaattcctctacttagatcacatctgttgatatttaaaaatataaggggaccagatgcggtggctcatgcctgtaatcccagcactttgggaagtcgaggcgggcggatcacgagctcaggagttcgagaccagcctggccaatatggtaaaaccccatctttaataaaaatacaaaaattagctgggtgtggtggcatgtgcctgtaatcccagctactcgggaggctgaggcaagagaatcacttgaacccgggaggtggaggttgcagtgagccgagattgcaccactgcactccagcctgggcgacagagcgagactctgtctcaaaaaaaaataataataaaaataaatataagaaatgtatagaattacaagattcaaatagtatagaaaggtacagactggaaagtgaaggcttctctacttagtacagttgctgttaatgcattcttgtgatttctgtttgttttcttcaaagaaccattttatggttatgtgcatatgctgacataattaaaaaaatagaggcatcattacagatttgcatatggcttttttcacttgatataccttgaagccttttccacacgtatcagcacctaaggatgtactttattcatttaagtggctgcatcatcacgataataatcagcacttattgaacatttgctgtgtgccagcactgttctaactgctgtggacacattgtcgtcattgttaatcttcaccacagccctctaagggaggtgctaccattgccccattttacggaacagagggaacagagggaacagagggagcggagggaacggaagtgcagggacacccaggaagagatttaagttctgtgtgtctgattccagagcccaggctctcaccaacacaaaattctactcctctacacagttagtttgtgggagagctgggatttattgtaatttatagtttacatagcttctatgttttgctgttttctggtccagttccctaaggtgtgtgtgccctacgtttcacatttcggtctcccaggggctctaccttactgggttttcttgattttgtcttccttaaattagaaaagaaaaggaagaaccaagaagactgaaacagttatgattgaggtttgcagaattgttcccatgaatggctactagctcttgatatattagtccagagcacagaaaatctatacttttaatagcttggactgcacacaacagtaagtctttatagacggttctgtcctgtaggggagaaaagtcctcgttgttcctctgggatgcaacatgagagagcagcacactgaggctttatgggttgccctgccacaagtgaacaggtcccagcatgaaagcagggacaagaaaattgagctcgtgacctccgtccagtgggccctttgattcattctttctttttgtctcactgtgtcatcatatctccctgaactcagctccagattgaaacgtagctgtaaccgcagctaaccaacaggcttcccttgaacaggccgaaaggtacagggtgagtctattttgtgactctgtggaggcgtgggcagcgagatggttgtctaccgggatctgtgttctggcttttgtgaagagggaagaaatgggaaacacgctgatgccagcctttctgcaactggtttgcgggagtgtaaacaactagctggtttggatctaggatcaagatgaagtgtaatagaaaactcgggctgcctttatccttaggtcagcaaaacagcaggatactgctgtctgcgtcccggttgaccctggcgttcttggccgctgccaatacagtttgccatttagatccatttagcagaaaaggacattcgtctagaaggatcccgccttgtaaaaatgcaggcttggcatgcactggggccctgggaagtcattcttaaatatatgaatccttttctgggggagaggtgccggcagttgcatgcaaaactgggcactgctctggcggattggccagtgcattcttacgtgtggtgggcactgtggaaaggcgcctttgtgccagtttggataagacaacagattcatgggtaggaaaccagtgtttgaaattaggtgctgaggttgtagagtcagatcacagcagagcagaagttgaagctatgagttcggagaaggtctgcaatatttttcctgacctctgaagttgtccaaaccactaagtgaagaaacatacttcctttggttcatctgatcaaattatcatctgcaaacttttggccttgttgcctcaatcctactgcaatcttcctgcctgcttgagagagaactgggtgtcgggggagtgggggcaatgtactgttgctccccagggtcaaaacgtgaacagaccaaagggtccagatggaaaccagaatgacttcactcctggaacgaggcatcatctttcctagcacatgtatttttctttcatgcctcttttcttttttcgttttttaattttagtctttttgagacagagtctcgcatggtcacccgggctggagtgcagcggtgtgatcatagctcactgcaaccttgaacttctggctcaaacagtcctcctgcctcagactcccgagtagctgggactatacgcatgcaccaccatgcccgtctaatttatttattttttattttttgtagtgatgaggtcttgctatgttgcccaggctggccttgaattcctgggcctaagtgatcctcctgcctcagccctgcaagttcatttttctttttaaaataaagtcagtcagttataaagctagaatgtaaaaacaaacattttctgatggattagaggatacacacagctttctgtaactgaaatgctgagtgcatgtgcaacagtgcctttaaacaatgaccttggcccgcggtgcagatttgatacactgagcataactggctgaatgagtgctcctggtgctttggctagaggcaggacttggatgttggcaaggcccttacatcgggccacagcaatctttcccagactctgcatgtccacttatttctaggtaggagacatcattcttttgatgtattgctctccaaccgcaatggtagagcagcacatgattaagtcatggttagacatataaacaatacttgtagcagaaacttgagctggtgcacgtaaaaaagtggttcatttaatgatgtaacggcaaagtgaagggacaaaatggaaaggggcgtgcccagggctcatctacaaaatctttgggacaattcctcttgggagtcaagctttagatgcctgctgtccagccatgagagaacatcagagggtcacagcataccccaaggttccgttaacagagcaaaacatcatcccttgcaacccaaaggcaggaacacagctgggccccaggaagacagggattgtactagaatcccttgcagtcctgagagtgctgtcttctggctgcttggcttagctcctctctgcaacccagcttcctctcgccttgctgactctcctgtagggagtaaaagaggctgcctccagcctctactcatacagctttgtttctgtgtgtttcccagcctctgcgtggaaggacatgctgagagccctttctccaccgtgcttgcattgactgattacatgtctgtctgtgacaccagcttggctgttttatttatttatttttttttgagatggagtcttgctctgttgcccaggctggagtgcagtggtgtgatcttggctcactacaacctgtgcctcctgggttcaagtgattctcctgtctaagcctcctgagtagctgggattacaggtgcctgccaccacgcccggctaagttttgtatttttagtagggacgaggtttagccatgttggccaggctggtctcgaacttatgacctcagatgatctgcccgcctcggcctcccaaagtgctgggattacaggcatgagccatcgtgcccggcccagctcggccctttaaatggacaaaactgtgcaacctggaggtctgagggcagctgcagctttcatcagctccagcatcccattgacgtctgtgttgggtgactcagtattgagcagatcctgactgatataacatcattcttctaaagtttctatttctgtatgttttatatattctatgatactttagtatagtagtacaggtacgcaatttataaatgaatacacacatattcgaggatgcacacaaacccttttacaactagggatgtgcaatcaaagaagtttggagacttttactttatggaatgtctacactacgtataggatgtttatccagaatatctgtgggaatatgcagtggttcatacaaggcacagatcatatcttgataaacacatactacacattttctttcttgactccaaaaaaacttaaagagatttatatccatagatcttaagatatgtacagtggaatttcatgtttcaaacatttactgatattctcacattatcatgagaaagaagactgggactgtgctgtgggattcttattaagttgtctatacttatttgcataaaatgatttttaatataaaattaaccaaagttgctcaattataagaaatgaatggctttatttgtgatactgctatgatttgaatgtttgtcccctctaaaactcacgttgaaacttaattcccagtatattgagaggtggggcctgtaggaggtaattgggtcatgagggctctactgtcatgaatgggttaatccatgacaggagtggtattaatgggattaatgggttatcacaggagtggcattaatggctttataaggggagaaagaaagacctgagctaactcatcccctttgccatgtgatgccctgctccaccttgggactctacagagtcctcaccagcaggaaggccctcaccagatgcagctcctcaaccttggactctcagtctctgtagccataagaaatagattacttttctttataaattactcagtttcaggtactataaataacagaaaatggatggagacagataccttggctctgagcttttttcttccttggcttttgaaggcctctcctggtccagtgtggattctgtaaagcttttttgaaggtcttttagcaatgaagaaagtatgtactaggagatgaaggcatgggaattggctctaaccccatttctacaagtagcgcgactgtgaattgtggtggggctcaagttcttaatgtgtaaaatgggaacgatgatacctcccagagtcatcagaagatcaaatacaaccatgaacgtgtttgtgctctacgagctgtaattcctaaaagataggtaggttaagatgaagaaaaggcattgttgagtttctcatgaacttctgatgcaaggcgtgttctagtgtatcatgcgtaaggaatcttttccaagcccgagaaaaactatccggtgccaagtgcatcaccactgggcataagtagtcccacccaagacaggaggggtgcagggctcctgccactctgcgtcatgaagaggaattgaaaacaaaactccatcctgttgaaaccttgaggtctagcactatatcttgtccttgtttgtgcatcttacgtgcttatgcaataaggtactctcagccctcagtatctgtgagttccatgtttgtggacttaacaactttggatttcaaatactgggaaaaaaattgtgtctgtactgaacaagtacagacttttttctcttttttttgagatggagtctcactctgtcacccaggctggaatgcaatggcacgatcttggctcactgcaacctctgcttcctgggttcaagagattctcctgcctcagcctcctgagtagctgggattacaggtgcccgccaccacacccggctaatttttgtatttttagtagagacggggtttcaccatgttggtcaggctgctctcgaacttctgacctcaagtgatccacctgcctaggcctcccaaagtgctgagattacaggcgtgagtcactgcacccagcccagacttttttcttgtaattattccttaaacaatatggcataacaactatttacatagcatttatgttgtataggtattataagtaatctagagatgatttaaagtgtacaggaggatgtgcatgggttatatgcaaatactataacattttatatcaggacttgaacattctcagattttggtatctgcaagaggtcctggaaccaatgcccccaggataccgagggacaactgtatgtactgttgaatctccaatgtctaacacagtgcctggtgtggcctagacatggaatatgtgtttagtgagtggaagaataaaggcattaccatacctgcttgtctctctggcacttgtcacaggattgcaagcccagatggtgtttgtgaagaggcaggagtaggtacagtatggaggtctacagcttgggtttctgaggcacagaccaggttttcccaactgttttcccagcctgttttcccaactgtaaggcgtcacactagtaagtctgtcatagaattagattgaagattaaatgaggtgatgcaaatgaaaagagtctagcatacaggaaagcttaacagaatgttaactatcatcaccatcattactaataacatgattagtggtcttaataattcatagatattcatgatgtggaacttggaatctcattagctccgttttgtcttgatgtctgtgactgccttctcttgacttttcccttagtcaccattttttactgcattttcaacccaactggccacatgtgcctgctttgtagtccaggttcccatcagtgcccttggccttaccctctgtgagcaggagcttcgtactctctagcaaggtttcagattagttttctgtgctggaggagttggaggcatttttggtaagctaaggctgtacttgaggactaatgtcacgctgtcaattttagctcattgctgtgatatccagcatagcagtaaggagctgatctgcagtcacttgccctcctctttgagcttcagctcttcttgggctggggaacagttgaggacactgtccaggaaccagagactgaatttccatggcctcatggcagcagtacatggatttaggttgttaccaggaggtttgtccacatgtgaggctgtctctgttttcattgtcagtcccagccgtcacaccccctctctcctttgaatgaatgaaagatgctagcgtgcctcatctctgacctcaggaggcctggacaatggaagaggaagtgggggcttttgctgccctctgctcagaggctgcaatgtggcgtggattcttctggcagctgtggtttaggctgccttgtgtttcctggtaaaatttcttaaactaagagtaatattttagcatttttctccaaagagcatagattgaagatgagggcttagtaatttcccttgagttggaaattcattgatgacttttatttatattttgtaatgtctgttaaatacttgcagaagtgctggatgattggagaagctttaaaccatgagaaggtcatgtgagcatggtagttgtggggatgcagtagatagggagttagggttttctcaaactctgtactccctcccttgcttccacattcctttcctcatgcagtgcgatcaagtatagaccctgatatagttaaccttcatgagtataagacaattcctaatacatcatgagtcaaaaaccattattatttaactagaacagtgtagagtcaggaaagcaggtaagttgtgggcagactgtaatatccccagcttataaataatgtggaagtgtattgactgcttgctcttctctgtacagtttgcaagtgtgcatatatctcatttgattaaatcacatctgttgtaatctagtgccctgattaagagattacagcagttaactgtattgcacaggaccttggcttggcagtcggcaaagccttgagcattaattcatatttgtgagtggtctgaggatgctgacttttcaaatttattatggttgggatttatgaactgtttcttttgtctgctctatagaagtgagcatggaatgtaagccaagctgtcattgtggagtcttagtgttgatacgatagactctggtactttaaatcaggccactgtcatctatgataatgcttggcacgtagtaggtgctcaataaaaatgcagcaaatgaatgaacagctcctaaatggcctttgtttccagttttgctttcctccagtcctcttaaaattccaccactgtgtggtctcattggctcccattgccctcagaacaaagttcaaactccctaacgaagtaactgatggtgcccttggctccagttgtataagtttaggagtctgttctgattgattggtgcctttctgcactatgggtttagctgacatgctcctaccagagtttacgtcttagcctgcagtacattcattcctctcttgtttctgggttatttctccttggtgggcatgtcagtatgagttggcgttcagtcaggaagcagagctactctgagtgttatgggaaaaggaatttattacagtaatcccacttaataccagtgtgggtggctggggaaggggatgcctgggagtcagagcccgaagatcagagaaacatctcaaaacagcagcacccggcatggtggatggttgtggctctcaaggaagctctgagaagccagaggtgcccagcagggaagccggcctgcagtggggacatggagcaggtgcctgcgggcagccactgctctgcgtagctcctgcctctacaccctacattgggaggaccgctgttgggagaagagtcagacacagaagagaggagtggggacaagtggggctctgctgggaaccttgtcatctctgtgtgctaaagaccttcagagagtaatgcccagtctttacttcctgcagattccttttttggtcaactctagtccagaactctatggagaaggggcttctgggaagtgagtggtgttcctagctttagccacgttgaacctaggatgatccaggacaccgcatgctgggtctgtgtaacagtgtctctgtgggctgtgtggacatgtgtgtgcacatgtatgcatgtgcatgtatgtgtgtgttcatgtgtgtgcttcagatcccctttggggaatgtgcaggaatgtcagaagtagggagatagagccactgggttagggcagagggcgagaggccctctttgaggccacctgtggagggctaagatgactccatcctggatgctaatccatcatgtcggcttctgattaactccagttctggcaatgcctctaagatttctatttcatcttcttccttgtgtaagagcatgtacttaccataaatcttgtccttaggtcaaaacaaccttgatgttatcgtacttaccgtaaatcttgctgtaaagcagttgttccgcacatcccttctgaagcacggacactgtccccctgtggtgcgtaagccctgggcctggggatggtagcacagggatcccccatttcgcctgtgggccacccgagacgcggctcctgttcatacgtcccattaaatgttgctctctgagaaactggatttgttgcctctttcttcgacctctcagttcccttggcttttggcagtcggtttgcaaaatgacctgctcaccacggaaccagctcattccagtcagagtgggatcagcaggatgggggagtggaaagcataacccaggcccctccatccacatgttcatggggaggtgctggcttctttgcctcctggggggaaaagccccaaatgtctgaccacgctgactcactcggacagccttccttctctgtggcctctgcttgtgttctcctcccccctcttcccttctccattcaccagtcctgcctgtctctttgctgggctagtgcatccttttggtttcagatttagtgcccctgcctccatgaagcctttcctgattgtcagatgcgggcaggtgtccctgtgcatccccatcacagcacttgtcacagtcgatgctacttcccagtttacttgtctgtgttcctcactgaaccaggagcctgtgagggtagacacatgggacttacagcaatagccatgtgcttcccttcccaatgtcacacaagtgagacatggtctggtgcatctgattctgagtctcagctgtgtgcgagtgtggcatgacctttcatccatccccctgtctatctccccatgaggacaaaagcaagggtgactacaaaaatgaccaccgctgccgaggcctttgctctgaaagtgcagcacagtggctgggaccgcaagacagtgtaactgacgacgtctgcagaattcaaccagcgtgctctgttgggtgggacaggaagtagggcagtagaagattagacagaattgataatctttgagatcaagcagtgtgcggctttgagatggagaagcagtagtagctttgtccttcccagggtttggacccagggctgccttgggaatagacgttcagacatgaggaaggtggcctgaaacatggcggctcggctatgtagagcggagggcacttagaggacatttatctatacagcgggtctttttgtttttgtttttgttttgagacaaggtcttgctctgtcactaaggcttgagtgtagtgcagcctcaacctcctgggctcaagcaatccttctgtctcagcctcccatgtaccttggacaccaggcacatgccaccatgcctggctaattttttgatttttcataaagacagtgtctcgctatgttgtccaggctgttctcaaactcctggcttcaagtaaacctcccacctcagcctcccgaagtgttgggattataagcgtgagccacagcacctgtcctatctagtagatcttaaaactatttaggtcatagattgctttgcgaatctcatgagggaccctctcaccaaaaaaaaaaattacctgctcacaaaggtttccatatgatttagggggatattggatgcctgaggtctgtgatctgtttctaagcctcatcccagaggtgtggtgatgaggaccaacaaggtatatgcttgccggaggtcaagacagagagacaggaggggtgaaaagggcaaggctatcccgagacctgtttccatacatggtcgggcctctcaacttgaatggaaagtttaattttgcctctctatggtggtagaaatagtgtcagtgacatcaagtttttataaggggaaagcaccacagaggatcttggggtgctgggggctctgacagatgatgcatgagttatcaggattgtgtccacttcagaggggacaacatggtgagaaaagggggcaccagactaaggtggtccccgtgagcacgttctcgggaagtgtgagggtgggtaaatggtccctgtttcttgccttgcgttgaaggctttgctattccacatttccatttttttgaaaaagattattttaattttatttttttaacctgggttaaagatatgcatcttccacattttctctggtgctttagaattcgtttaatgaaatgagcttctctttcttttctttttgtttttgtttttgtttttgtttttgagataaggtctcactctgtcacccaggctggagtgtaatggcacaatcacagctcactgcagcctcgacctcccagcctcaagcgatcctcctacccaagcctcccaagtagctgggactacaggtgtgcaccaccatgcccagctaattttttattttttgtagagacaaggtcttgccatgtagtgcaggctggtcttgaacttctgagctcaagcagtcctcccacgtaagcctcccaaagtgctgggattacagacctgaagccaccatgctgggccatcagctgttcttcagaacaattttttttcactctttttaaagaaattcttttttcatttagtcttccctgcatttcaaatagaatgatcttatgagaagggtcagtaggattatttaaagccgagagatgaggcagtgagctccgggaggtgttcatgcttcccttctccctctgtctgtcgggtcccaggactaaggatcctggctgtgggcaatctgcagggtggaagaacaatcctgtttcgcctaacatgtcttgtcacagttcccaaggcccccgctaaggacgcgtggaatggggaggtgagatgggaggaactgaaacagccccatcctggtgttaggttccctgttgagtcacagtgtgtggaaaggatatcaaatgaaggagagattttctactgagatgaaaaggcacttaataaaatgacataacgcttcacagggagctgttttaatggctactcaaagcaactctgaaatgtctataatgagatcctaaaagcaagttctgaaatccccaattctcttctttctgatcttggatgctgtgatatcttccctagagatttactcttagatggaatgactgcatttcatggtagctctgtagccatgctaacttcatttgctgatggcagctttatcgctattgtttaaatcactctaaataggttttgtcagttaaagcaatgtaatatctttcctttcttacagcccagagagtagactcctgtaggaatattggaatattcagaatcagtactcgcagagcagaacctcataatcctataaaactttgctctcatcaacccctcacactgctgacctaccttaaaccttaatgtcctgatttgcaaaatgaggataaccctacttcattagggttgttgaaagattaaacctgtaacaagcctggagagtcagtgcttactaaatgccctccattatgtctgtattagttgcccattgctgttgtccccaaacctaacagcttaaaacaacatgcactgattatgtcacgggttttgtgggtcaggaattgggcatggcttagtaggtcctcgggctgggggatctcttacaacactacaacaggtgttagctgggcctgcagtcatctcatgatggaaccggggcagggtctgctttcaggctcccttggtggttgtcaccaggatgcagttcctggtggcctgttgtatatgtgccctgaggcctctctcagttccctgccttgcgtcctcttcatgcatggcagcttgcaagagcaagcaggcaaaagggagagagggagtatgaaaaaagagggtcgcaagcatctttcatttgtttatttatttatttatttaagacagagtcttgctctgttgcccaggctggagtgcagtggtgtgatcttggctcactgcaacctctgccttcgggttcaaacgattctcgtgcctcagcctcccaagtagctgggattacaggtgcacaccaccatgcctggctaatttttaatatttttagtagagatggggtttcaccatgttggccagggttgtctcaaactcctgagctcaggtgatccacctgcctcggcctcccaaagtgctaggattacacgtatgagccaccatgcccggccaccagtaccttttataacctcccccttggaagtgacatctgccacttttgctgcattccatttcttaggagcaagtcattgggtccagtccatatgggagtgaatactgggaggcggggattattgggagccattttagaagctgcctactgcaattgtcatgattcttcatccttttttgctagacatgcaactcaggaacagtaaagattgtcttgtaaaaaattgcagaatgtagcaataaaaaatccaaagtttggagcgtggtgccttgcttggtaagccaggttattccatatgatctgcgaatgctccctccaggaggtgggtgcctgtatcactcatcagtgacccatcttgcccagtgaggagctcacacatgtgttgcttgtgaagaaaggtggcaaaaagacaggtgcttccttggataggaagtatgatttaagtaagaaactgtggtaattattatttttttttacagttaaggccacattctctatttctgcttagctgcacagagtttgtacatcgggacaaactgctctctggaaatgccaagaagctgtggggctattataagaaaaacggaactgaaggagttatggaacttgctcttcttccccatttaaaagtcgtcttccttctttaactgatctgaagagtaggggaggaggagagagtggtggtgcgggcttccttaagagctgggctagaggagacatggagcctctggcactttggttttttgctcctgataacgtcagtggccctggctttcctagaactcagcaacaggagtttcctttgccaccagcagggtaggggagctgccaccattgaggccagaatgctcagtggctgaaagattgctgaacttgggaatccaccagataggccagctctgcgagaatgagagaaaaataaatttaacaatagcagaaagggacagtgtttttaaatattacaaatattttcttattaggaacagtttctttagggtggatgatgtcccggcaccgagaccatctgttctttttaaaccttcatctcagagtctgaaaagatctggaaagtgtcctggccgtaacatgtgtccttggacgagttgctttaatttcttcctttaaacttacgctaaggcctaatcaaacatgatcagagagatgaggagacagggcaactcaaatgaaaacctttcaacagacaatagaagcagacccacagagaatctaaggaatgagattatcagacatggactttaaaagatgaatgtttaatatgttcaaggaaataaaaatcaagatttaaaaattcatcaaggaatcgaaaactaggaaaggaataaaacgaaacatttataactgaaaactataataattgatattaggaaatgaataaatagggttatcatatatgatacatctgtagaaagaactggaagaaaatctccaaattcagagaaactcagagagatagaaaataaagaaaaaaattatatatatatatatatatatatggtgaaaaagtttaacgtaggcataattggagttccagtaggatagaagagacttaatggagcagaaacaatatctaatattgttagatcagataatagctgatacttttccataggaagtgcttagcttggtgcctagaactttttatattgttagtaaatgtcagcttttctcatcatcaatattattattttgctcatctttgctcctgtggaagatttacactgatggcagttttatgagagtccaaatccactaggccttttgttcaccaaagctcttacagtcctggagcttctgcttctactaaaggcctggagttggggtcacactggttgaaatctgatatgaaattagagtaagttttcctatggaaacaatgttgtcagtgaatgtgggtgtccactgtagagtgctgtagctcagcagcaagcttaggaaataatcattctttatttacagcatcagttcaatggaaaaacgcatattttagtttcacatgcgtagccaacaaatgctcacttggaactcagccatcagcaatccagttgatggagtggggattgcctgtacaattagttcggtcactgtcaccctaacctcctgcctttgattcctttgtaaagtttaagtctcatttgtaagtgtcctcactgcaggaatcaggacataatctttttatcccctgtccttgcatactgctgactgcacgtacggtgaatcagtggatgaattcgtgcatgcatttgtgcgtgcctcctggagagatggtttggctggtgaacagtgcactggatatggggaatgggaaatctgagtcttgactctgcccttactagttacaggcccactgggagaatccatgttttccttatgcgggaattgaggatgaagccatctctcctccccttgacaaagggctgctgtgaggaccaagtgagataagtgtgtgaacatgggtacacgggctcccatttgcaccatcgaatcatcttgtttttgtggcttccatgcccttcctttccgcttattttttcgtattctctggtaggatgttttacatctctcctggccatttttttgtatcttaaatgtggcaccttattctctgtatgtgggcttctgattctttcatggagggaactgtggacatttccaagctatgctcattaatgtccacggggcattaatctaaatgcttgagttcacttatgccatgtattagtttaaatttacttctgtaaggaatattttccctcatgaggtagatagataaaatgaagtctagtgactcagacccagtgcagaacccacctttttctttctttctttctttcttttttttttggagacagagtctcgctccattacccaggctggagtgcaatgccgatcttggctcacggcaacctacgcctcctgggctcaagcaattctcttgcctcagcctcccatgtagctggaattacaggctctcgccaccacgcctgtctgatttttgtatttttagtagagacagggttttgccatgttggccaggctggtcttgaactcctggcctcaaatgatctgacccccttggtctcccaaagtgctgggaattacaggtgcgagccaccacacccggctgcccagagctttttattgatactgtgttttccacaaataattttgtgttatggttttctcactacagtaacaggcctggagttgcattttcttgcattgctagctcagtttttcctagaacagagtgtgaagactgagatttactctgcttgagtgagatctgctctctctaccccaaaaggaatcttatagaatgggtggtaataacaacagcacaggatggacttgagtttgataatgttttctgcttttatggcaccttatttttggtagtggttactgtgtaaaaatcagacctttttctcttcagtgcataattgtccctctggtgaaaagtgcttgaggtacagaggaattatttcataccaccaacatagtatttagggcccagagcaaacaggcccagtaagtctgtaatctgataagccctggaatgggatccaggtgcaaagtacttccgatctctttgacacaaagggaggcctagacacagactcaagtgaggaaggaactggagctctcccgggagttcactggtagtttgaggagtgatgttcgttgttttaacctccagtctttggtccagccaactgatagaatacttcactttggggacccgagactcttgttgggtatataggattggggttttctgttgattgctttgtaacaaacctagtgtagggggccgggtgtagggggtgggggagagtgggtgggaggagtatattctcttccccttaggcaaagcttcaaaaaagtgctttgtgggttaatatggaatttgtgccatatttctgtggggtttctttgaaatcgaaaagggaaggtgcagtgcttcctggattgagcttcctgagcccgtttgtcttctgctctgagttgaccctggttttggggctgtagaaaggggaggagtagccatccagtaaccctggcctggattgctaaggccagggcccgggagctgggctctcactctttccagacagggctgaggcaccctcctgctccaagatgtggaggcgccttcctgcgtgacctcatctctgcatctgcgagctccatctgcccccggagtgggtgagccaggcaagcgtggcactgccctcattactatgcactgccttcgcttgcaggcatctccacacaaggacctgcctggcaggcggggtgggctgaggcgggcgggtggggtgtgtatgctggtgtcccaggtgcctgatgggacctttacttcttttggtcacctttggagtcagaacagtccaaactgttaaccatgcagacttctgcctgtttctctctttatgttatttctttatgcccacaaggtctgctgccctgtacaggcctcctgaattccctaacttaactccttgtcaatgctgaagatgctgaagacgttttagaagcatgtggctgggcgcatggctcacaccggtaatctcagcactttgggaggctgaggtggggatcgcttgaggccaggagtttgagaccagcctgggcaatatagtgagacctcatctctaccaaaataaaaataaaaaattagcctagcatggtggtgtgcacctgtagtcttagctacttgggagggtgagacaggaggatttcttgagcctggaaggagtaggttgcagtgagccgatgttgtgccactgtaatccagcctgggtgacagagtgagatcttgtctcaaaacaaacaaacaaaaccccaaaccaaaacaaacaaaaagaagtatgtaagccttaaagtctaaacattcaactaaatggatgactgaatacaaaaaataaatgcaaaaatccttctcatacagattatctctgattccaagaccagaaggagatgctggaattatcagtgatccccaatgggatgtcatgcacagagtcagttttgtagtgtacattataggcaaatcatattctctctctttctgaacattctgagaagaatgcactcaaggtttgaaagactatcatgtatgccataatttttgtgcttagttttttttcttatttaactacattctgaggaatggaatccctgagttgatgggtcttgttagtgttatttcctgtccataagaatcatgttgatttataatgttatcagcaatgtatatcccttaccagtttactcaaacacctcaccacctgaagatttctgaaagtctgcggagcagtgcttagtgagtttgtagtaaaggagtcagtaggagtatggtggatgtcgtgaagagagaccagagaggacagccttttcttctcagtgcccactttgatcgagtcacaattattccctgcagggctgggtcgaaaagattttaaggcccttttcacgttcaataagataatgtgtcttgaattgattactgatgtctgccatgagagcaggattaagtagtcgcgatctatttgcctgggaggtatcattcttttttaaaattattatttttattattattattacactttaagttctgggacacatgtgcagaacgtgcagatttgttacataggaatacacgtgccatggtggtttgctgcacccatcaatccgtcatctacattaggtatttctcctaatgctatccctcccctagccccctgccccctgacaggccccagtgtgtgatgctcccctccatgtgtccatgtgttctcattgttcaactcccatttatgagtgagaacatacagtgtttggttttctgttcctgtgttagtttgctgagaatgatggtttccagcttcatccgtgtccctgcaaaggacatgaactcatccttttttatggcttcatagtattccatgatgtacatgtgccacattttctttatcaagtctatcattgatgggcaagtctttgctattgtgaacagtgctgcaataaacatacgtgtgcatgtgtctttatagtagaatgatttataatcctttgtgtatataaccagtcatgggattgctggatcaaatggtatttctggctctagatccttgaggaattgccacactgtcttccacaatgtttgaacttacactcccaccaacagtgtaaaagcattcctatttctccacatcctcttcagcatctgttgtttcctgactttttaatgatcaccattctaactggtgtgagatggcatttcattgtggttttgatttgcatttctctaatgaccagtgacaatgaacttttttccatatgttttttggccacaaaaatgtctttttttgagaagtgtctgttcatatcctttgcccactttttgatggggtttttttttcttgtacgtttgtttaagttctttgtagattctggatattagccctttgtcagatggatagattgcaaaatttttctcccattctgtaagttgcctgttcactctgatgatagtttcttttgctgtgcagaagctctttagtttaattagctctcatttgtcaactttggcttttgttgccatcgcttttggtattttagtcatgaagtctttgcccatgcctatgtcctgaatggtattgcctaggtttcttctagggttttggggttttaggtcttaggtttaaatctttaatccatcttgagttaacttttgtataaggtgtaaggaaggggtccagtttcagttttctggatatggctagccagttttcccaacaccatttattaaatagggaatcctttccccattgcttgtttttcaaaggtttttcaaagatcagatgtttgtagatgtatggcattatttctggggcctctgttctgttccattggtctatatatctgttttcataccagtaccatgctgttttggttactgtagacttgtagtatagtttgaagtcaggtagcgtgatgcctccagctttgttccttttgcttaggattgtcttggctatacgggctctttttttgttccatatgaaattcaaagtaattttttctaattctgtgaagaaagtcattggtagcttgatggggatagcattgaatctataaattactttgggcagtatgaccattttcacgatattgattcttcctatccatgagcatggaatgttcttccatttgtatgtgtcctctcttatttcgttgagtggtggtttgtagttctctttgaagaggtccttcacatcccttgtaagttgtatttctaggcattttattctctttgcagcaattgtgaatgggagttcattcatgatttggctctctattattggtgtataaaaatgcttgtgatttttgcacattgattttgtatcctgagactttgctgaagttgcttatcagcttaaggagatttttgagctgagacaatggggttttctaaatatgcaatcatgtcatctgcaaacagagacaatttgacttcttcttttcctatttgaataccctttttttctttctcttgcctggttgccctggctagaatttccaatactatgctgaataggagtggtgagagagggcatccttgtgccggttttcaaagggaatgcttccagcttttgcccattcagtgtgatactggctgtgggtttgtcataagtagctcttattattttgagatacattccatcaatacctagtttattgagagtttttagcatgaagtcgtgttgaattttatcaaaggccttttctgcatctattgagataatcatgtcatgtagtttttgtgattggttttgtttatgtgatggattacgattattgatttgcatatgttgaaccagccttgcgtcccggggataaagccaacttgattgtggtggataagctttttgacatgctgctggattcagtttgccagtattttattgaggatttttgcgttggtgttcatcagggatatgggcctgaaattttctttttttgttgtgtctctgccaggttttggtatcaggatgatgctggcctcataaaatgagttagggaggagtccctcttttctattgtttggaatagtttcaaaaggaatgttagcagctcctccttgtagtgggaggtatcattcttaatctggagggataggaagcttgaaggccgttgcaggagtccaggaatgaatcaagtgttagtgcttggttttcacagattggtggtgcctagcgttttgtgtggcagcagccaaaactttgtggttcctgatttcataattatagatttacatgtgattaataagtgtgacaattcaaacagcaggggttgtcatttcagaataagtggttgttctcagagaggaatctcatatgagggatccatttcccaggaagtagatggaaccaattgctgggcatgagtacgtctctgatatcgactatacaaatgattatacaatgaaacactatctggcccacaggtagggttttactgtactttatttcaggttctggagtcagaatcgggtttattctaatgtctccccggcagtcaataatttgagcccctttcattactgttaaggctgcagcggctatcttcagagcctgtcaggctatgagtaacttgagctatgcaacgtgaaaccagaaagcactagtaaagtacttgtgagttctagaaatttgactttttttttttttttttttgagaaatttaggccagtgtggtgactcaagcctataaccccagcactttgggaggctgaggccggaggatcatttgagcctgggagtttgcgttagcctgccccacatagcaagaccttgtctctgcaaaaaaacccctaacatttaaaaatagcagggtgtggcggtgcacacctgtagtctcggctactggagaggctgaagcgagaggatcacttgagctcaggagttcgaggctgcagtgagctatgattgcaccactgcattccagcctgggtgacagagcaagaccctctctcttaaaaaaataaaggaaaaatgtacacttagcagggaagttgatttaacctagtgagagccttaagaggttttgactaggactcaaaagagtttggttctgactctaccaaccagctatgtgaccttgaggaagtcacactgtttcctctttaccaaaacgaggggactggacaagacggcctgtggtattctcagaatcttacgaaatggaataatatatacatagatgggtttccgtcagtgtggccctaaagacaggcctctctgatcctgtctctctcttccaaggctccttcttcacccagtaggcttcattctcttttctgagtcctacctctgtgtcttcacatgcgacagccactattaccctggcactttccttgtgtgtgtgtcacagccctagcgagtttcctgcggggaagggcattcccagcgcggagtgactccttagcctggctcctggcctgtcctcagcaaaccgcgggtagggtgtgcccctggtggccagccgaggaacagcagtcgcccctggaggtcgggaactgcatccacttgagcggtcccaagccacgggtcagagaggattcgatggtggtgttctttgcagaaatgtttccctttctgagacaaactaaaactttgtctatcctttcgtcctgttatttctttcctatcaagtgtgtaagaatgtacatttgacagtgcattctaaaagaggtgagagttaaaatgtttcaaaataaagagacagtgactttgttgtttgaaaaatcagtgcttatatctaaatttgagcagacttgctgctgtaactcttcagacaagttggcgttgacgcttgagccctttgtagaggatgatgagtaaagctgaacattgagcattgtcaagtgacttcttcccttttccgccttcaagggcgttttggggctggccttgcaggattgatttgttggctgctttgagacttgtgtccattgttttgagcacatcccttgggagagtaaatgatagattccaaaggggtgcttttcagaccagcgcccccaccgagaagatgcaccctcagccctgtgccccaggggcacgtgagggaactgagcaagcacctgcagcctaaggaggaaggccccggggcacacagaaaccaggcgaggtttgtcactgggtgatagggtaagcctgggtatcaaggaatgaaaaaaaggagcaaatcgaggagttgtctcctgagctcagaggggccacaggtggggcagccccatcaccactgtgtgctggtcctcctgccgtgtgcctggccctgcttaagaactcctggaggccagggagggtggaatggtatctccccgccaatggggtctagcctgctgttggcatgggaaagggagggtttggggaatgcctgttgggcgagtgaagaatgagtgaatgaacgattgaatggaatagccctgagaaggagaattcctaaactgtgatggagaaaggtagaaatgagcgtggtcggtgttggggagaggtccccaccctgcctccttggcagtttgtaggaatcagctggcctcatgaaagtgtgctgcctgctgtaaggggcaatttcctaatcttcaagggcagggcagggcaggctgtcacagttcctcagtgtccagtttcttgggggctacgtgggctacagtctggcaaggatttgctcctccacagggggtcttaagaacaactgagatgaaaagagttgtggtttgggggactgcgagggaacatgagccagaatccatacttgaggtgcagctcagaaatagcagcggcatcaattggcatctcaggagctgatgttttgattctgccgtcacctctttgaactctgtgcatcgatttgcacgatgcagataaacagcagctttggtgctgtgtttgttagggctcagggtcagtgcaggctgctctccttgggaggcgagaccttctggagaggggttttctgatgagtattaaaagccaagtcccctgttgccccaggtttgctggaattgtcccccaaacacagggctgagaaggagtaaaaataattcagattgccaactggtatttcaaatcccacttcatatttcagtgtctgaagaaaaccacatttctctgaatttcaacatttcatccttgatcttttggctttcaaatttatacctttaatgtaagagaactgaatcagctattttttcattctctcgataaatcacttgttcccgttttgtgtatagttttcagaacgcctccacgatccttccagtaggaacatgttggcaacggcgatcggtgttgataaagccttgggtcctgtgtcctctgcccttcctgcctgtctcagaacagcagccattaacaattgagggcagatgcttttttctactttcttctacttttggggcaacttcctgactttattttctaactcctccatgaaattttaatttctgccatcatatttttaatatatatattttttgagacagaatctcactctgtcacccaggctgagtgcagtggcacaatcatagctcactgcacccttgaattcccgggctcaagccatcttcctgcctcagcctcccaagtagctgggactacaggcccatgtcgccacacccggctaatttttacatttttttgtagagtcaggggtcttgctatgttgcccaggctggccttgaactcctggcctcaagtgttcatcctgctttggcctcccaaagtgctaggattactggtgtgagccactacacctagccatattttaaatttctaagaggttggttgtattctcaacgatcttttaaaataacatcctgctgttttgtgtgtgtgtgtgtgtggaggggagcatataaatgtcaggtatttcttagtgagtgattatattgaaaaagttaaaaatgtaagttgaaagctctgtttgtattggggcttgtcaactgctgcacacatggcctttggttaggggatcccaaatatcgggaactctagagctttttttctcctacctaaaggggagccttcactgcttctgtgtgggcttatccagcttagggtgaacagcacctggcccctcccttacctgtgcctgatgtccccaagcccagctccgtccgatgcaggcttcctggagagtaaagctctgaccctggttatgtggcctggggctccaagggtatgttgttgtgtggcctttcaactgatctgttttcagccctccattgcttgatgtttcctgaggttctgcggcatgaattgacttgcttctttattggcttctctccctgccagcagtttggtttcagcttcttcattctcagggaccgcttgtcctcctggattttgttgatatcacttgtctggtgttgtctcttctcctatctctttgactttgtgaatttgtgtcttttatttcttaaaccactttacaagggctttggaagggagtggatataaatgcgtgcattgaatttccagtgtgtaattggaccctcgtcataatcagctttaaagaattatttaagagagaaagaactgagacaagaccattatataattaagcaaaatttggaagttattacccaaccatcagattctacagagaaaatgctagaaacatagaaactagaattaataggtcttaaagggtgatgcctagagaaacagattacgtgtcttttgaatgcaaggttttgaacagaatgaattctgtttctgcccaaacaatgtggtatgttcacgtacttcttctctagagccctcccaagatttcagaatttctgaaaatacatccatagtgaacatgttcatttttggttaaatattgtatacatgtcagacatgtttctgaaactgatttttaccatacttcttttctttctgtgaaagcaatacaattttattatagaaaatattggtgagaaatagaagaaaatatccccccactccctctcccagtctcatcaaccagaaatagccagtcgtgtcctctggtaatctgtgaggtcagttaacctcacaacctgtgagttgccgcccttcatcttcacggttgtatcctcattctttcctaggacactggggttgggaaatcaagcatcgtgtgtcgatttgtccaggatcactttgaccacaacatcagccctactattgggtaagttcctgtatgtcattctccttcgcgttgcttcctttcacggcatcagaatgaccactctgtctgtgcctgagccttcaggcagggccacagttttcatcccagccagtgagaatcaatcccagctgtagaccgacagaaattcagggacttctgagtatgtgtccaggcttactgtccctgtcggtcattttttttttcctagtcagccttcctcatgctacctcctaaggtcatttccttgatctctgagagcattattctgcaaatcttggcgttatttccagttggaagacgatatgcagagcaaacccctgatagttctgctttaagttgcctgctaataaaccctgaaaatgccatccacccgtacctcagcactgtctgcaaagtctgtggagcagattgactttccttttctggaattatctttttttttacttcttgagactgagtgttgctctgtcacgttgcccaggctggagtgcagtggggtgatcttggctcactgcaacctccacctccagggtggattctcctgcctcagcctcctgagtagctgggattacaggtgcgcaccaccatgcctggctatttttttgtatttttagtagagatggggtttcaccatgttggtcaggctggtcttgaacttctgactgaaagcagtccacctgcctcagcttcccaaagtgttgagattacaggcatgggtcactgcgcccagccccttttctggaattatctaatgccagcatttccactgtcatgtgtggggaggggtggaagtgcattgttaaattctcctgagcttgggatgcaaaattgttttcctgttcatctcccctttccagtgggctccttggccgcgtgtgctttggctctgctgttcgggaagtgcctgctttttcattcttagaacgtggcctctgcttatttttcaccctgaagatatcaagtctttgtaggcaatgtatgtctttgtctgtatgttttgggaaacctgtaggattgttgagaatgggagagtgtatcagaagtggagaaaaatcatggcagggaataaatagatgctcaagagtacttggctgataggccagtagttggaactgtgtagctgagaaaacccacattttgtagattaaaaatgacttaaagaaacatactcatgaaaatatcaagaattaggaaaggtctgagattttaccctaattgcagcctgcaacttgttaacaagttagcagttgtgacttgttagcctgactcagtttcagggatgctggcagaagacagaagacccccgagtcacagacagaggcaatagcaatagccagagtattcacaaaatagggtgacattagagtcagacacctcacatgcagggggctgtgttacgggagcggaaccccaagctgagggaacgcaagtcttctacatggggcagtgagcacatctgtcctcagctacagagagagactctcccctccaaggatgcttgctgtgcaggttgagcatccctaatccaaaaacctgaaatccagaatgctcccaaatctgaaacttttgagtgccaacatgacgctcaaaggtaatactcaaaatgctcattgggatatttcagattttggaatttcagctttgggatgctcaactgggtaagtataatgcaattattgcaaaatttaaaaaaatatatatccaccggaagcggtggttcacgcctgtaattctagctctttgggaggcctaggtgggcagatcacatgaggtcaggagttcaagaccagcctggccaacacggtgaaacccctctctactaaaaatacaaaaattaaccagatgtggtggcacgcgcctatagtcccagctactcggaaggctgaggcaagagaaggtggtggttgcagtgagctgagattgtatcactgcactccagcctgggcaacagagcgagacttcatctcaaataagtaaatagataaataaataaatccaaaattcaaaataattctggtaccaaacattttggataagggatactcaacatgtacaagcatccttgaaaacacaatccggaaaaaagtgtttacttgcaagatgtgcacgttgtgagagaccataaagaattgtctcccaacataggcgcgcttgtatgataggtatactttttatggaagaaattggtttcactctgctctgaatgtacttttttctctctctctcttatttttcactttgtgtgtgtgtgtatgtgttttaataataaaaagcagaactgataagagtgattaactgtgaagtatggttccagaagatggaggagagatttgtgccttctactttctaaacttttgtttaaaaatttttttaaaataaaatctttttgtaatgaccttttttttttttttttttgagacggcgtcttgctctgtcgcccatgctagagtgcaatggtgtgatcttggctcactgcaacctccgcctcccgggttcaagcgattctcctgcctcagcctcctgagtagctgggattacaggtgcccgccaccatgcccagctaatttttatacttttaatagagatggggtttcaccatgttggccaggatggtctcaatctcttgaccttgtgatctgcccacctcagcctcccaaagtgctgggattacaggcgtgagccactgcacccggcctgtaatgaccttttttaaagtaaaaagacagtgcatactcataccacaaattatgggcagtacataaaaatgacaagcgtaagtgttaagcataggtataggcatcgtaaatagggtagttacgtaattttggtcacaatctcttggtcaaagaaagttgctgtgccagcccagattaaagggggagacacaggctgccttgtggtggcaggagccgtgtgtgcatggagggagggtcggggatggattgctgctaccattttggaaacaaacacagttgacagtgttttgtctagtaaatgcatttcggtggtttggagttttaaaaaacttatgtattacaattgacccttgaacaactcggggattaagggtgctgagccccgagtggttgaaaaaccacctataactttttgtttttttgagacggtacttggctcaaaagtcttgctctgtcacctaggctggagtgcagtggcaaggtctcagctcactgcaacctccgcctcctgagttcaagcgattctcctgcctcagcctcccaagtagctgggattacagttgcacgccaccatgcccagctaatttttgtatttttagtaggaacggggtttcaccatgttggccaggctggtcttgaactcctgacctcaggtgatccaccccccttggcctcccaaagtgctgggattataggcgtgagccactgtgcccagccacacatataacttttgactccctcagaatttacctgctaatacctgaccattgacctgaagccttatggagaacatagtcaattcacaaatattttgtaagtgatgtgtattatatactgtattcttacaataaagtaagctagataaaagaaaatattactaagaaaatcataaggaagcgaaaatatatttactattcattaagtggaaatggaccatcataaaggtcttcatcctcattgtcttcacattgagtaggctgaggaggagcaggaagaggaggggttggttttgctgtcttgagcgtgggagaggcagaagggatcgaattagaagtgggcccatgacattcaaacccatgttcaagggtcaacggtctatggaaactctctgcactttcttctcagtttttcctgtaaactaaaagtgctctaaaaaactgttattagtttaaaaattatgtcttagtttttaaaattatgaaaaaatttatactatgtagaaatatataaaataaaaagtgaagtcagaggattttgctagctcttcaatcccgtattcttcaatttacataaccaatatttagagtccaaagtgcatgttaaacatatttcttataagtactttctgtggacatgcaggtatacaagctaaaaatgaaaacgtatcacactttacctaacaagccacaacatacattcccagtccacttaggtcctccttattctttttcactgctggttgccagcctctgggaaactgagtcaggctgccaagtgatgactgttaacttgttattaagttgcaggctgcaattagggtataatacaagtatgccccgtgcaatatttgggacatgtgtatactaaaaatttattagttctttatctgaaattcaaattgaactggcatcctgtatttgtgtttgctgaaggtcacaacccttacctcacccctcctttgggcttaagccaagctggttgggtttccgagtcttgcaaccaaagggacctcaatagaagcaggcagttgtgcaatagggcttacacaggtgactcaactttaattgtgacacagacaagattaaagtctaattgttttgattataaaagttcatgttcgactgggcgtggtggctcctgcctataatcccagcactgtgggaggctgaggcaggtggaacatttgagcccaggagtttgagactagcctgggcaacagggcgaaacttggtctctacaaaaaaatacaaaaattaactgggtgtagtggcatgtgcctggagtcctagctacttgggaggctgaggtaggaggatcacctgagacctggaggttgaggctgcagtgagccatgattgtgccactctactccagccagggcaacagagtgaaatactgttccaaaaaaaaaaaaaaaagttcatgttcactctaaaaaaaacccaaagaacacagaattcatgaaactaggaatcttagtgtacatacagtttttttttactctgtgttttctacttaatatattttgaacattttttacagtgtcacataatcttcaaaaacatgttgaaagtattttttctgattataaaagtattatatactcatcataaacaactgaaaatgaaaaaaacatgaggaaaaatattttaaaaacccataatctacctcttagaggtaattactgtaaacattttgttattttcttccagcccttttcttgtataagtgtgtgtatgcgttatttattcaacatcattttgtgaatttcatgccattaaatagtctttaaaaacaatttttaatggttgtatttttcacttcaggcatttaggttgtttaaacacttttgtacttttataaataatgttatgaggctagacacggtggctcacgcctgtaatcccagcactttgggaggccaaggcaaatggatcacctgaagtcgggagttcaagaccagcctggccaacatggtgaaaccccatctctactaaaaatgcaaaattagccaggcatggtggtgcacgcctgtaatcccagctaccttgggaggctgaggtaggagaatcgctcgaacccgggaggcaaaggttgcagtgagacgagattgtgccactgcactctagcctgggtgacagacagagtgagactcttgtctcaaaaaacaaaacaaaacagaacaaaacaaaacataaataaataatgttatgatgtacctcgttgggcatagatacccatgtatactgctgattatttctttaggttaaactcttagcaatggaataatttagtccaagaataaaaatctatttaaggctctcaatggatattaccaaattgtttttcggaaaggttatctctgtaccagctttaggtatttttttttgtacaatttttaactttataaaattgtaaaagtttgtatgattttgaattctattcttttcctctaacttcaaatgttcgcattttctcgtagcttaatgtttctttgttaaaacaattttacatgatggcagcatggtattgtgtgctgttcttttttctttttttttatttgagacagagtcttctctgttgcccatgctggagcacagtgacgcgatcttggctcactgcaacctttacctcccaggttcaagcaattctcatgcctcagcctcccaagtagctgggattacaggcactcgcctccacgcctggctgatgtatttttagtagagacagggtttcaccatgttggccaggctggtctcgagctccttacctcagctgatctgcccgccttggcctcccaaaggagtttacaggcgtgagccaccgcgcccagccctgttcgctttctacctcgtcccttgcttttcctctggagtcaatgttaggctcagcccctccacccttatgtattgtcttcttgatataatttaacttcttgatttaaaaattgatgaaaattttccctctggaattttgagaaaatgttttcaaacaccagttgcagaaaaataaagctagtgggaacactttctaagtgacacatgcagttttcctggaaggtggcataaatggaacacttttaaaacgtttgagtgctttcccaaaagctggtaggttcggtgggctgaggaactggcttatattaatatatttgttttgttcagccttcacagtgctgtaaagactttaagccaatagagaatcaggagactggcacgtaataaacttgcattcctggtttctcttgaaaaatcagtgggtttggagccctggtgcccattcccatgtggtgggagccagccggtgccactccgcatgggtggccaggcctcccggcttcatgccattcccgctaggtattgttactattatgttcatcagtataaacgttcacacctagcctgcttcactcatttatatgtcctgcctggtccctagacatttcagttcctggccctggcactgccttcttggcggtaaccctgctggccacccccaggcccagggcggttaggggacttgcctaggtgcacacagcccgtgagcagcccactcatggctcacaccagtgagtccactctcaaagcccacccttgttcttcccactggaatcacacgaccattggtacaatgccatgggctgtaaaatgccattgcttcagcattaaaagagttaactcttatggcctctctgactcacactgaaaaaccttggctctgctattcaagcagattgcattaacatcttgagtgtgtgtgtatgtgtgtgtctccctttttatttcaacttttgtaaggaaattgtgtaacttctctgccagattttggtttccacagataatgaagtcagtttatcagggccagtgcgcctcctccaccagtttggagggtaatctacacagaagaaaagatgcctgaggttcttatttgtttatttgtttgagacaggatcttgctctgtcacccaggctggagtgcagtgacgcaatcatggctcactgcagcctccacctcccaggctcaagtgatcctcccaccttagcctcctgaatagctgggaccacaggtgtgagccaccacacctggctgtttttaaatttttgtttttaattaaatctttttatttttgtggagatgaggtctcactgtgttgttgcctaggctggatgaggttcttaagatcaaaagctagcaaagacttaaaaaccaacaacaaatctcagtcaacaaaaaaaagcaatgattgtcgtggtcctcatttcaaatactgagagtctttctcctagtggcgagagatcaggaacacagagggatatgtgtgtgtgtgaggtgtgccttcctactattactaaagttgctcctcacagctcactgtgaaccaaggggaatttcgcaggtatccatttccctatatgtccctacaaacaccttctattcaatgcagagtaggtattggccccatttcacagaacaggaaaccaaagggctttacgggctggttcattgagtctggcagtgagggcctctgcttcctcttcctggttaggccactgcactcttctttcaccaggaaccaggcagtcttctgggattttggttccccccccttacctgcactgtggaggggttggactggatattttatattttttccaagattttaaaggcatgaactttgttttctaaccctgaggagaactttttaagggtagtagggttgctgtattatttatcgcagcacctagaatatactgaagaataaatgaaaatctgactaacatcaaaagtgaaaacaaaaacaaaattttgatagagttgtctaataaaatttttaaatgagtttatggaaaaaatctagaacaaagttaaagggcaaatgttaaactggaaaaatattatttaaaatgtactactacaaaagtttagtggaaaatagtcaaaaaatgaataagaaaaggatgaataccacagttgaaaggtgggccaaggtcatgaacttgagaaaaattcctttacaaagaaaaatgcaagcgaacaataaatgttaaaatgatgtttaagcttgtgataagcataatgaatataagaataagatattttctacctaacacattgaaagagatttgaaagattaataatggtgaggaaaaggccatctcatacaccattatggacatgtaggttggtaccaactaagtttggcacatgtagcaaaagtggagtgtatctatttttgttttatttgcttatttatgtatttttatacatttatatatttttagagacagagcattgctgtgtcacccaagctggagtgcagtggcacaatcatggctcactgtacccttgacctcctgggctcaagggatcctcctgcatcagcttcctgagtagctgggactacatgcaaaagccactgtgcctggctgatttttttttttcttttgtagagccaggggtcttgctatgttgccaaggctggtcttgaactcctggcctcaagtgatcctgccaccttggcctcccaaagtgctgggattacaggtgtcagccaccatgctcggctctactttttaaaaattaagtctaaggatatagttgtacagggacacaaagatgtaattataaggatattcactgaatcattgtcgtaatagtgaacaatagataaccaaaatgtccatcgttagggtattgaataattccataacatgatgtatgatcttcagtcattttagatgatattgatgtatattcatagaaatggaaagattttaggtgatttttttttttttttgagacagagtcttgctctgtcacccaggctggagtatagtggtgtgatctcagctcacagcaacctctgactcctaggctcaagtgattctcctgcctcagtccccgacgtagctgggattacaggcacacaccaccacacctggctaatttttgtatttatagtagagacgtggttttgccatgttggccaggctggtttcgaactcctgacctcaagtgatcctcccccatcaacctcccaaagtgctgggattacaggtgtgagccactgcgcccagccaattttagatgatattgatctatattcatagaaaaggaaagatttccaggatatataaagttgaggaaaagcaaaatttagatagagtatgatcaattttcagagcaaaagttatgttaaaatagagcgtcctgcaaactcggaagcagatcacaaggggtggtcacactgcagtgtgattgacataaagaccgatgttacttgggaagaagcctggaagaggaggaagaggaaagaaaaagagtcgagaacagctcttactcagggatgctggactttcagggatgtggctataaaattctttgaggatgagtgggaatgcttggaccctgcacagcatcctctatacagggacctgatgttggagagctacaggaacctggtctccatggcaggaaattctcttcctaacctgagtattatcttcttggtggagcaagggaaagaccactggacagtggagagtcaagtgaaaatagcaagaaagccaaaagagtgagaacgtatcaaaggtgtgatcagactggtgctgcagctcaaacagaaacacatgcaaagatcttatcatggtggacagctttcatctggtagggtgtcatgatatatatgtcatatttgcatatatataggttttcacttacagttcctggctcctaactcccaaacccttgttataatcttggggcactttaggcctcagaaaacagaatcactatctgaccttctcctgtcctccttttacctgcccaaggcaggactctaatctgatcgcaggtcattccagagagagtcctgccccatcttctagaggaaggatgctactcagagaggccaagaagaacctgaacacacaggccttgctgggttttgatcatgcactttttgtccaatcacatttttacaagattgttaagaatgcctgtgtaggtcgggcacagtggctcacgcctgtaatcccatcactttgggaggccgaggtgggtggatcatctgaagtcaggggtttgaggccagcctgaccaacgtggtgaaaccccttctctactaaaattacaaaaattagccaggtgtggtggtgcatccctgtaatcccagctactcaggaggctgaggcaggagaatcgcttgaacccagttgcagtgagctgagatcatgcgactgcactctagcgtgggcgacagagtcagactctgagaaagaaagagagaaagagaaagagagtaacagagaagagaaagaaaagagaatgcctatgtaatgaagcctctgtcaaaaaaaggaaaggaaagaaagaaagaaagaaggaaagaaaagaaaaggaaagaaagaaaagagaatgcctatgtaatgaagcctccataaaaacttaaaagaaaagtgttcagggcacttctggagagctgagtttcctggaaagtggcgcccagggagggcatggcagctctgtgcccctgtctgcttaccttgccctaagcgtctcttcatctgtatgctttgcagtatcctttatgagaaactggtcactataagtaagtgtttccttggtttctgtaagccgctgtagcaaattaatcaaactcaaagaggggttggtgggaaccccaacctgaagcctgtcgatcagaagttctagaggcccggacttgggactggtgtctgtggaggagcactcttgggtactgagccctcaacctgtgggatctgacagtatctccagggagagagtgtcagaattgaattggaggacacctagctggtatctgctgctggtggtgggagaaccccccacagatttggtcatagaggttctcttctgtgttgatggttgtggtgtgagaacagaggaaaaacatggttctagagagttatctcctacacatctggcttctggcaactctgcttccttctctcggagggatatctttcctgtatatgcaatcaaggaattatctgccaaagagaaaagtaatacaggagaaatattccacacagtgtcattggaaagacgtgaagccatgacgttgaagacttgcttcagggaaatccagaaaaatagaaactactttgagtctcagtggagaagtgatgaaagcagttacaagagtgcctcaaaaaaaatctcactgttagaagagaccaacatgatagaagggatgcaggcaacaagcctattaaaaatcagcttggattaagctttcagtcatatctgcctgaactacagctatttcaagctaaagggaaaatttatgaatgtcgtcaagttgaaaagtctgtcagcaatggttcctcagtttcaccaccccaaagaattccttctaagcccaaatccatatttctaacaagtatgggacttacttaatctattcttccttacacaagaacagaaagcacacattagggaaaaaccttacaaatgaaatgagtgtggcaaaacctttaatcatgactcactctatgctgtatattagataatccatcccagagagaaatgacataaatgtgatttatgtagcagggttattagtcaaaaataaaaccttgcacatcattggagagagtttatactggagagaaactctacaaatgtaatgaatgtgacaaggttttcggtcacaattcacaacttgcaagacattggagaattcacactggagaagacccttacaagtgtaatgagtgtggcaaagccttcagtgtgcagtcagcacttaccatcaggtggtccatactggagagaagccttccaaatgaaatgagtgtggcaaggtcttcatgcacaattcacttctcccacaacatccaataattcgttcttgggagaatccttacaaatgcaatgattatggcaaacccttcatcgtgagttcaagcattaattgacatcagagagtccatactaaagaaaaatcatagaaccgtaatgtatgtaggagaggctttatccacatttcacactcacaagacatcgaaataagcatttttgatgaaaccacagaaatgtaatgtgcctgctgaggctgtcgcccaaagatcgaaactgtagaccatcagaggagtcagatgaggaatgactcagtctttagttctccaagattaactttcgacatttcatactgcagaacaattacaagtcaaaatatgttaaaactcatgacatgatatctatcaaaggtaccaggatgttgggcagtggccagttaacttcaggttatgaaatattttattcaattatttgaagattcttgaaaaggctactttactatttatgactttcaacttgaactttgaaataaaagggacgaaaatccagaatatacaagcaactcaaacaactcaacagcaaagaaaacccaaataaaatgatttaaattgggcaaggaatctgagtagacatctctaaaaagaagacatacagatggccaacaagtttgtggaaaaatgctcaacatcactatcatcagggaaatgcaaattaaaaaccacaggaagatatcatctctctccagttagaatggctatcatcaaaaatacaaaaaataacaagtgctggcaagggtgaagagaaaagggaattcttgtattctgttggtaaattaagcactgtgtacattagtacagacattatggaagacagtatggaggtttctcaacaaagctaaaaatagaactgccatacaatccagcagttctactactgggtatttatgcaaaggagagtgaatcactatatcaaagggatacctgcactcacagatttattgctgcactatccacaacagccaagctatgaaatcaacccaagtgtccatcatccatcaacaaatgaatggaggctggcgtggtggctcacacctgtaatcccagcactttgggaggccaaggagggtggatcacctgaggtcaggagtttgagaccagcctggccaacatggtgaaaccccatctctactaaagtaaattacaaaaattagctgggcatggtggcacatgcctgtaatcccagctacttgggaggctggggcaggagaatcgcatgaacctgggatatagaggttgcagtgagctgagactgtgccactgcactccagcctggttggcagagtaagaccccatctcaaaaaaacaaaacaaagcaaaaatgaattaatggataaagaaaatgtggtatatatacacactggaatactattcagccataaaaaagaatgaaatcctgtcattcatggcaacatggatgaacctggaggacatttcgttaagtgaaataatccagacacagaaggataaatactacatgttctcactcatatgcaagagctgaaaaaaaagagctcatagaagtagagtagaattgtagttattagaagctgggaagggttgggggagggaaggatagggagagcttggttaacagttacaaagttatagctagacgggaggaaaatattctagtgttctgtagcactgtaggatgaataaggctaacaataatttagtgtatattttcgaaaagcttgaagagaggattttgggtgttcacaacaccaagaaatgataaatgttcaaggtgatgaatatgccaattaccctgatttgatcattacacattgcatacatgtatgtacatatcactctgtatcccataagatgcataattattgtgtaccggctaaaaataaaaggaaacaaagaactgaatgaataatcccattttaaaagtcatataaaaataattgggaaggacatataccaatttattagcagtgactatggctgggtggtgaaatatgattggtttttattttctttctggttttttgaattttttttatgaaatacatatgttgcttttaaaatgggaaaagtaataaagacattaacatttttggaatatattaggtctccccggtagtctggatatacattttaaacacttttaaagaaataaaggaatagatgtggttttgatactactggatttgtcacttagaatacttagaattttcatttattgcaattgtaggttggtaattagaactctctaactattattagcctttggtttttgtggggatagtgtgggaattgcagtagacttttctacttgggacttcggtagttggcctcttattcttagaagatttagaggctgaggaaatattactatgatgaatgctagttgaccaggctggactatatgaaagtaaggtgaagaacccctgactctttaccccgaaaaccccagggtccatctcctaataagaacataatgaggacaccatgatcatacctacaaaattaatttgaatcagtgataatatcttgcatatagtgtgaatttaaaattttaaagttgttcttaaaatatctttttgtgggggtagggggtacagggtctcgctctgtcacctagactgcagtgcactggggcaatcttggcgcttcactaccagcctcagactcctgggttcaagctgtccttctgcctcagtcttctgagctgccagaactacaggctgtgccataatgctcagctgatttaaaaaaaaaaatttttttttttgtaaagaaggagtcttgctctgttgcccaagctggtctcgaaaccctggcctcaagccatcctcctgcttcagcttcccaaagggctaggattacagaaaaaagagccaccacacctgaccaaatatattttaaagctgttttccccctaatctgggatccagccaaggttcatatattgcattttgttgttttatctctttcctctcaatctagattctagaataatctccctgtatttttctggtttgcttctcatgacattgacttatttgaagcattcaggccagcttgtcttacagaatgtttcacattctacatttgcctcattgttttcttacaattaaattcagactaaacatttgtggccagaatgctatataggtgatgtatctacttcttattccatcacttcaggaggctctcataccaggttgtcccactactggggatgcttgctattttttaatgaatagaaaactttctgtcataaaagtcaaggctattgaacattcctggtatttttatactgttcatgagcacaaagaaaatgctttttaaaaggaaatatgcaaaaaagaaaatagtaagtgtttaatgatctactgaggctttaaaatcctttctttttggacttagaagggaggaaaaaaaatccttccttttttatagagaaaacataagtatgtgttaagctgccaatcatcgtccttgcatttatgcaagcaggttgggacttagatgtagtattctattagttgctactagtgttggtttcatattagcatagtaaatatgtaagacaactttttctttatgccattgtaagaccaaaaacattacatgccaacataccagctgctattttcactcttaattattgtaataagtttttaaaatccaaggttgtattctttcctgagatctgggggtattttaataattgaagctaactggttttagaaacacagtctttttttttttttttttttttttttttgagacggagtcttgctctgtcactcaggctagagtgcagtggtgcgattttggctcactgcagcctctgcctcccgggttcaagtgattctcctgccgcagcctcccaagtagctgggactacaggcacccgccaccatgcccggctaatttttgttttatttttattttattttattatcatatacatattttttgagatgaagtctcatactgtcacctgggctggagtaccatggtgccatcttggctcactgcaacctctgcctcctggtttcaagcaattctcctgccttagcctcccaagtagctgggaccgcaggtgcctgccaccacgccgccaccaggcctggctaattttttgtatttttagtagagacagggtttcaccatattggccaggctggtcttgaactcctgaccttgtaatctgctcaccttggcctcccaaagtgccgggattacggcatgaaccaccgcgcctggccagaaacagtcttttgaatgcctcctttgttttgttttgttttgtttcaaaacccccagttgaactaacagaaaatgagaaatattttattttgggtgtcatgagtcttctagcccttttctcgtcttagtggttcccaaggaccagggctttttggggtcctgctgaggtgtagcatttaacttgtttgatttgtgaatctttgtgaagaaacaatgcagtaatgtggagatgctgactctcttttttcagggcatcttttatgaccaaaactgtgccttgtggaaatgaacttcacaagttcctcatctgggacactgctggtcaggaacgggtgagtatatgctgttttttggtgaaaacaagatccagtgaaaataagatcagtttctgaaggtttgtttgcattagacaagactcttggttgcaggtgacagaaacctagcttgaaatgatgtaagcaaaaagaaaatgtactcattagctatgtgaaaagtctaagtgggtacctagggtgaggcggggctgagttcaggtccccaaatgtgttgtgagaggagcccatctctcttatttctgtttctttccatttagtgcagttgtggttgcactctcgatttggttcatttttaggcagactcaccctccctccttacctcaagggtggtaaccatggccccaaaagcatctctacacctaccttcagcctttttagcaactactggctgagcatgcacctcttctgcaagtgggaacatacatcttagtgcctctgagttctcactggcctgccttaggccccatgcccactcctgaacttcaggtggtaccttgttcttgggggtttggtgcccctactggtgggatctggcagtacactgacccctagaggcaagggctggtgtcagccccacctgaaccatgttggttcaggaagtcaggtaggcttagcgccccaaggaaaatctgaggtctcttactggaaaagtgggtaaatggatgctgggttatcaaaacagtggatgacttctcttttactcctaattctctgtatttgctgaaaatacttatggagaagactatatattttagaaggtcatgcctttagattcaaaaaagggaaatgacgaatactagcacagtgtctattgctggatacttgcataataactagagcgtatattataaaagttgctgtgtcttgctgtgtctcccaggctggagtgcagtggcacaattatggctcactgcacccttgacctcctgggctcaagagaccctcctgcctcagcttcctgagtagctgggactacaggcacaagccactgcacctggctgattttttttttttcttttgtagagcctggggtctcgctatgttgcccaagctggtcttgaactcctggcctcaagtaatcctcccaccttggcctcccgaagtgctgggattgcaggtgtcagtcataatataaaagttgaggccggacgcggtggctcacgcctgtaatcccaacactttgggaggccgaggcgggcggatcatgaggtcaggaaattgagaccatcctggctaacacagtgaaaccctgtctctactaaaaatacaaaaaattagccaggtgtggtggtgggcatctgtagtcccagctactcgggaggctgaggcaggagaatggcgtgaacccaggaggcggaggttgcagtgagccgagatcatgccactgcactgcagcctgggcgacagagtgagactccagctcaaaaaaaaaaaaagttgaaacggatagccagatagccaagcagagataaccaataccttgtcttagccaagagctgttagcttgattgaaattatcagagttgatgactatggagtaaaattggtagaattttcccttgtctgatccaaactcaaatgtcaccttctctacctccttgtttaaaatgtcaccacctcattttcttgccctactccactcacttcctgcttcatttttctccacagttattatcatcttccaatatattatttaattcactttattttgagacagggtcttgctctgtcacccaggctggagtgcagtggtgcaatcacagctcacctcagcctcccgagtagcagggaccacaggtgctcaccaccactctggggtaatttttaaattttttttgtagagacgaggtcttgctatgttgcccaggctggtcttgaactcctgggctcaagcagtcctcctgccttggccttccaaagtgctggaattacaggtgtgagctaccatttggggccttaattcaattattgatctgtttattgtctttctaaaaggaagaatccaggattcaggataatctataattttcattatcatctcctaactaatcaagtggtaatttatataattttcattttacctaaattcccttttaaaacaaaagttcccatatttgtagattaaaacattttaaaaacactgctgaaagaaatcatagacatagacacaaacaaatggaaacacatcctatgctcatggatgggtagaatcaatattgtgaaaatgaccatactgccaaaagcaatctacaaattcaatgcaattcccatcaaaataacaccatcatttcattcaggctgggcaccgtggctcatgcctgcaatcccagcactttgggaggctgagatgagtggatcatgaggtcaggagttcgagaccagcctggccaatatggtaaaaccttgtctctactaaaaatacaaaaattagtcaggcgtggtggcacatacctgtagtcccaactacttgggaggctgaggcagaagaatcacttgaacccgggaggcggaggttgcagtgagctgagatcatgctactgcactccagcctgggtgacagagagagagtctgtctcaaaaaaacaaaaaacaaaaaaacaaaaaacaaaaaaagcaactaccatcattcttcacagaactagaaaaaaacaatcctaaaattcatatggaaccaaaaaagagcctccatagccaaagcaagactaagcaaaaagaacaaatctggaggcatcacattacccgacctcaaactatactataagggcatagtcatcaaaacagcatggtactggtataaaaataggcatgtagaccaatggaacagaataaagaacccacaaataagccaaatacttacagtcaactgatctttgacaaaacaaacaaaaacataaagtgggaaatggacatcctattcaacaaatggtgctgggataattggcaatccacatgtaggagaatgaaactggattctcatctctcaccctatacaaaaatcaatgcaagatggatcaaagacttaaatctaagacctgaagccataaaattctagaagataacattggagaagcccttcaagacattgacttaggcaaaggaatcatgaccaaaaacccaaaagcaaatgcaacaaagaaaaagataaatagacttaattaaactaaaaagcttctgcacagcaaaagaaacaatctgcagagtaaacagacaatccacagagtgggagaaaatcttcacaatccatacatctgacaaaggactaatatccagatctacatggaactcaacaaaatcagcaagaacaaaacaaacaatcccatcaaaatgtggtataaggacatgaatagacacttctcagaagaatttatacaaatggccaatgatcatgaaaaaatgctcaacatcactaattatcagggaaatgaaaatcaaaaccacaatatgatacggccttactcttgcaagaacgactataatcaaaaaatcaaaatataatagatgttggcgtggatgtggtgaaaagggaacagttttacactcttgatgggattgtaaactagtataaccactgtggaaaacagtatggagattccttaaagaactaaaagtagatctaccatttgattcagcaaccccactcctgcgtatcaacccagaggaagtcattacacagaaaagatacttgcacacgcatgtttattgcagcacaatttgcagttgtaaaaatatggaaccagcccaaatgcccatgaatcaatgagtggataaagaaaatgtggtatatatatacaccatacaatactactgaatactactcagccataaaaaggaactaaataatgacattccagcaaactggatgcaattggagaccattattctaaatgaagtaacatactaaacatcgtatgttatcattcataagtgggagctaagctatgaggacacagtggcataagaatgatacaatggacttcggtgacttgcaggaaagggtgggagtgggggtgagcaataaaaactacacactgggtacagtgtacactgcttgggtgatgggtgcaccaaaatctcagaaatgaccactagagaatttactcttgtaagcaaacaccacccattccccaaaaacctactgaaattttaaaaataataataaaataaagctaaaagaagcatgctaaaatatagctaaaatatgcacctaatcttaatctaaaattgtagatgtggaattgctagttcagagtctctgatacatactgtaaaatccacctgttatttggacccagtgtttcactgttatgtactttcacttttacccaaattaagtattatattaaaatgagaaagaaaaaataatcctttaaaaatatatatttgctttctaatgactttaaacttctttcgtattttttagctatttcatttctgatcttaataattgaatgattatagctttacccacttttttcttgagtaatttgtaagaatctcttaacattaaattatacataatgtctccatttgttatttatattttaatttctattttaggtttctaatggtcaaacttgttttttagggttaaatcaataatcctgtcttttatgaattctgctttagaatacatgctttaaaagaccttcagaatgctaaagtaaatattaattaaagttatattaaatatttaaataaaacacattttcttaaaaatacattttaaacagttttaagaaataaattaggatgaatattctggcctacaaatgctaacctcattagaaagtcttctatttttctgctaaattgagaacacagacttctgtgcacgggaagcagctgcctggggcacctctttaactccatcagctgtgcctgcctagtcctcaaatgaggtgacccattcaaggaaaaatgtctacttagagacctcacttcttgatatacgtgtgtattacttgtagttgatctgctggttttttgtttgtattgttatgtaaacttaaacagagagagtttcttgattctctttttacctctggctatgaaatagttgcttttgcagctgcctttaatgaacacaataagtcaattttgcgaatcgctggcttaatgtcagcgatgcttctgcttctcctgctggcggacgttccctgatgacttgctgtgttccatgtactgttctgagtgcctgtgtgtactgatgcattcagccctcctcgcaaaagcactttgaggttgaaactgtcgttattcccatttgcaggtgaggtcactgagacagagacattaagtaacttgcacaatgtcgcagagctaataaggtgtaaagctgaaaattgaatccagcagtctgggtcctgagctttgtagttttattttgattgaaaaatcacacaaaaaaccatacggttgaaagtaaaactatccaaactcccactacccagatatttccactatggatattagatgatcgttcttcagatatctctacgtgattgataattttatatcaatgggattgtgattctttataacctgctgttttcatttgatattacagtgtcacaaaggaaagatttctgtgtgatcaaaacagaatgtttaacacttacctctaacaggctattcaaggaatagtcttttgatgaaacttgaaatctgcgaaaatgactattgtagtttgtagtttgttccacttaccatcgcaaagaaaaataccagtgggaagttttcagatgaccatatttctaattattgtgattgcttttcctaaaatttgacttttagaggttgtagacatctgactccattgatacatccataattttaaagaaatcactagcattatacatgcaaggcatgactccacagtagggatattctttctttatacttcgaggaagacggatttagtttgggataacgatttcaaagtgaacatttttagagtctagatttgtggagagtgtgtgactgatatccatgtggctatgtggtcacctgatctccccagccctcgacggcctgatttcattatccttgggctgtccttgtctggtgtcccctggtggagtcttgcatctctccagtaatggcaatttttcaattgttttggcagcttgttgctggctttaattgtgcttgtaatgatgttgcctaatgtttgagctaaaaataaattccctgctgttgcttgtgcctattgctatttgttctgtctcattaattattggagtcccgtgaattttattacccctctttatcatcatagaaatgttattgttcttttagttttcataattttaaacaaacaatcactttgggtttatgatttgacaatataaagacagatttctttttttctttcttattttattttattttatctttttaagacaaggtcacactctgtcagccaggctggagtgcagtgatgcaatcatagctcactgcaacctcaaactcccaggcctggtcaatcctcctgctccagcctcctgagtagctgagactaccagtgtatgccaccatgcgcagctaatttaaaaaaaaaaaaaaaattgggccagacacagttgctcacgcctgtaatcccagcactttgggaggccgaggcgggcagatcacgaggtcaggagtacgagaccagcctggccaacatggtgaaaccccgtttctactaaaaatagaaaaagtagctgggcgtggtggcacttgtagtcccagttacttgggaggctgaagtgagagaatcgcttgaacccagaaggcgaatgttgcagtgagctgagattgcaccactgtaccccaatctgggtgaaagagcaagactccacctcaaaaaaaaaatttgttagagatgaggtcttgctatgttgtgcaggctgggcttgaactcctggcctcaagcaatccatttcacttggcttcccaaagtgttgggattataggcgtgagccaccaagcctggccaaagacatggatttctgtgtccttaaaggaagaaagctccgctcagtgctttgcttgtgttcatgattcaatatttatttatttgtggaatgattgcaccaagttctgcctaacatacacagcattctggttaatgtcctacttactgcccagtaataattctatcttatatttgtggtacaaatttgtactcttggaaaattattttttcttctcctgagcacaggaatctcaaaggatcctcctcctctttatataagagagtattcattctatttatttttatttatttattttagagacagggtctcactctgtcacccaggctggagtgccatggcatgatcatagctcattgtagtctcaaattcctgggctcaagcgattctcccgcctcagcctccagagtagctgggactacaggtgcgccaccgtgcccagcctattcattcttgatactgtctgaatgttgcttttgcttttttaatccaactgtgtgtcatgggcatcctatctcattcattcagtggtgatatggtaattcatagggtgcatctattaacaaaaatgttttttgaaaaatttaaccatttcccagttgaatcccatttgttggaagcttgacattagtaagatttgtgcatggtgtgttgtaccaccaaggactatgaagaggggaagagtgccattgggctccctctgttgtaccatcagtgtggcctttgggaagtttttatcctgtcctcttggaatgggttattgtgctggtttctgcttcacaccaagctgtgaacagtacagagtagcaggtcagcaggcacctttgcaaggatgtacacaggagccatgcctagagcggtccatagccgacagaaggtaatttacctgcccagctccctgcgggagcctagagtcaacacatagagtggcttttagcgagaggagctgaaaagcaacattgtcataaataaggcatgcgttcatgaagaggtgaagagctggggataatactttcatctgccagcggcccctcctgggttctcttgctctatataccatggaggaccaacttcttccaacctgaaactttcttcagccatctcccttccatttttttccaccgtgctatacttttacacagttcatgacgttccaacacaaatttcccattaaaaaacctgaagctgtagagctaatgtttgactttccatggctctgaagatatatttattccttcctcttggctcagacggcccctccccatgttggaaaatggtttctaaaaagagcccagtgaagcggcagtggtggaattctctgtactttttccttggcagggagttctttccctgacccccttcttacctgttctagacccactcaagcttctgtctctgagctttctgtcctcattctctgttggccttggaagcagatgagccaactttcatcttttctggataacccactctggagctttagcagttagaaatcacattcactgaaaattgcttttgtccacatttgtttctgtgttgactatcagtatgtggagtatgaccagcccccctttttttttatttaaaaacagctttactgagatccgattcacgtaccatacaatttatccatctaaagtacgcaccttggtgggttctgatgtgttccgaattgttcaaccatcagcacaatccattttagagcatttttatcagtccagaaagaaacgcttatgaattagcagtcactcccagttccccctctacatcccccagccctgggatactttctgtctctagatttgcctaatctggacatttcacacaaatggaatcatacaacctgtggttctttgtgactggatcctttcacttaggataagattatcaaggttcaccttgtggtgtgggtcataaaagtatttcctttttatggcagaataatattccattgtctggatagaccacattttgtttagccactcatcagttgatggatatccactttcccccaactttttggctattatgaatagctgtgaacattcatgtacaattctttgtgtagattttttttttttttttgagatggagtcttctctgtcgcctaggctggagtacagtggcatgatcttggctcactgcatcctctgcctcctgctttcaagcgattctcctgcctcaacctccccagtagctgggattacagccagctgccaccatgcccggctgattttttgtatttttagtagagacagggttttaccatgttggccagatgtctcaaactcctgacctcaggtgatccaccggcctcggcctcccaaagtgttgggattacaggtgtaagccaccgtgcccggccagatgcatgtttttaaaaatctcttaggtatgtatctagaagtgaaattgttgggtcatatggtaactctatgactagcatttagaggaactgccaaactgttttccaaagtggaaaactagcagtgtgtaaggctttagtttctccatatactcaccaacacttgtctttgcctaacctaaggtcgtaaaggtttactcctgcattttcttctgagagttttatagtcttagctctcacttttatccctgtgatgcatttggagttaatttctgtccatgttgtaaagacaggatccagcttcattccttgcaggcagctgtccagttgtcccaacacagtttattgaaaagactattctttgcccgattgtcttggcatctttactgaaaatcacctgaccataaatttgaggctctgattctggactctgagttctattcctttgatatacattttttctccttatgccaataccacattgtcttgattactgtagctttgtagtaagctttcaaattggaaaatgtgagttctccaacttcgttctttttcaagattgttttagctattctgtgtatgttgcatttccaaatgaattttaggatcagcttgtaaatatttatcaaaagaatccaactgggattttggtcaggattatgttgactttgtagatgactttggggttacctgctccttaaacctgtaaattatcaatgataagcaagttgccagctgtctttcaactctttggaatttacatgtaggttagaaatgctgacctcagagaaaaaattttgaataaagagttaggtcaggcacagtgaatcatacctttaatcccagtactttgggaggccaaggtggaaggatagcttgagcccaggagttcaagataagcctgggcaacatagtgagaccctgtctctacaaaaaataagaaactacctgggtgtggtggtgcatgcctataagagggatccacactgacatcctccaggagcccacggtttaatgcatgcagtcaggagatctggccaccccaggctgttcagccataccgcttgttcacctccttcagattaattttgcaagtgactgccagtctgcatggtttgaaagattaggtgtttggagatcatgtgcccagagggctgggatgcactggcacaaagctgtgcggaatcgctgggtctgaatgggtccttgagaaagcaaaggaactggaggcagcagatagctgaggtcaaattcaggctttacagacatccaaagaaactcttttgctgtctttcctgctttcttcagggccccaacatctatggtcaaaaaagtggttcactattcataggccattagtaaagtcagaggaaattttgacctttggaagttcttgaagaatggagcctcttacaagctcagaatgagcagctcctttctttctcctgcaggcattggaaatacagtcccagctggcaacaccagccagcagcacagcccggaatcctgctcctgacctgcaccatccccaccagcccacgatagaacgtttttgtaggcattcctcctcatgggagaggatagagtacatgcgagtttttgctctcctcccaccctttcacaagagcactgtgctttcttttcttctctttttcctttcttttttttttttttaggcagggtcttgctgtgtcacccaggctggaatgcagtggtgcaatcatagctcactgcagccttgacctcctggactcaagcaatcctcctgccttaacctcccgagtagctgggactataggcaccagccactatgcctggctaatattttttgtttgttttttgttcagagacaaggtctcactatactgtccaggctgggatgactgtgctttctaccaatgcaaactgagatcccggcaagggaaatattcccttcctccatgcccctagtaactctcttgaaagagaaaactgagtgatgattgtgtggggaggaggcaggcctggagcttgaagatagggtttatgctgttgaagtgagataaacagctgtggtgagggccatgcctgctgagctcctttaaggagaagccccaggaatccttcattaagcactttacagctgaagagtttcattgatatttgaaaattggtgctggaaactacaaaagcaaagtgtgagcagaggtattggagaggggcatgaggggaccctgacggcagctgtgcaggtggagcagggactgcctcggtccacagacgtggcccccagaactgtcgtgccatttgcgggggttgtgtcctgtaagaaaataggaatctaggtgcagaacagccctcctgggtgtcagaatgccagcgacaggagagaaggaggaaggacatgttcatatacgaagatacctttcgggagttcttagggaaacactgtaaacagctctgccctgagcccgggaggtggccatgctggcagtgagggatgtggcctgggccgtgggaacacagaggcggccagaggggaaagcctcagagctgcgtggacaggcttcttctgcttacacacgggcttctgccctgctcttgcccctcgggggttcttttgtcactggagaccctgctgttgccctttgctctccagtgcgtgtccccttcttccatatgccccctccttggtggggacaggctgctctgggaggtacagtgactgcgctagatgaacaccttcccaggtcaggcaatgacattttgctgatgtgtgttttagtctgggatgccctgagtagcttctaattatgaggcactgtctgtgcctcttgggtggaggccaagtttccattctgccaactctcagaggacgtggggccaaaacacagagccgctgagacaggagtttcagggggtctggaggtggatttgccgagaatctaagaagcacttcaactagttttgtttcctctcctcccttccactccctttcccttctgtcctcttcttttcttttatggagctaatttcctacgtctggctaaaatacagtagaaaagccctataaagcctatgagtgtcactcttgaataggaaattagcaaatagactttgtttggtaacagaagaacctgttcctgaggcgctgacagcctgtcctaacagaggcagctgggctgcagtgagcacggacctgtggtaggaagacctctgcatccagagtggcccggtggaaggtgccagactccccctcactccaaaaaaaagaggaggctttttgagggcagggaccttgttaccttcttcactttctttttttgtttccagttgttgctgtaacagattgccacacgctcagtggcttaaaacaacacagatagactcccttagagctatgaaggtcagaagtcagaaatgggtctcatgcctgtggtcccagatacttggaggctgagatgggaggatcacttgagcccaggagttcaagaccagcctgggcaatataatgagactcccatctctacaaaaagtttttaaaaaattagccaggtgtggtgacatgcagctgtagtcccagctactcaggagaccgagacaggaggaccacttgagcccaggaggttgaggctgcagtgagccgagattgcaccactgcactccagcctgggcaacagaatgagaccttgtctcaaaacaaaaacaaaaacataaaaagattaaaaaaaaaaaaagaaataagtatcactggaataagattaaaatatctgcagaccttaatccttcctggaggtacaagggcagaatcttgtttccttgcctttttcagagaccactcgcattccttggcttgtagccccttcctttgtcttcagagccagcagagtagcattttaaatctctctcccactcccctgcctctctctttcactgttgaggagccttgtgaggacactgggcccacccaaggaatgcaagataatgtcctcatatgaaggtcagctgatgagccctattccacctcccatgtaacctaacatagtcacaggtgatggggattaggacatggacctctttgggggacactattctgcccaccacactccagtttctctgctgctcagaacagtgcctgccacatactgagcgttcaaacagtgagatactgtttgttgaatgaatgaatacatttgatgtaaacctgtgtcttaattatatcaactgaagcaacgtttcatttcagagaagcaacacaggaatggaaaatgcatggaatttggagtcaagacctgtgttcaaagtcttttccaccatttaagagctgtgtgtcgactgggcgcagtggctcacgcctgtaatcccagcactttgggaggccgaggcgggcggatcacgaggtcaggagatcgggaccatcctggctaacatggcgaaaccccgtctctactaaaaaaatacaaaaaaagtagccaggtgtggtggcaggcatctgtagtcccagctactcgggaggctgaggcaggagaatggcgtgaacccgggaggcggagcttgcagtgagccgagatggcgccagtgcactccagcctgggcaacacagagagactccgtctcaaaaaaaaaaaagaagagctgtgtgtctttgggcaattcacttaaccatgctgagcctcagttttctcatctgaataacaggaacaactctgtcttctctccctggtttcacagggttattgacttttattacatgcattcagtcattaaatatttgtcgagtccttgctatggtccagatagggattcagggaagggttctcagggagggtggcagttgattaaaggtgtgacagaagtgagggaggggccttgaggatgctggtggaggagggtccaggctgctagaaggcgtcagggaaggtgcggaggctcggtgggcctgcctctgtgtttagggagcagcgagaaggccggggctggagacaagcaggggaggggcccaagaagggaccagggcgggcccaagaagggaccaggtcccacccaagatgccacagaatggagcttggcttttatactaagtttgaaggattctgaacagggaagtgaaacaattggatttatataggaagaaatcaatcactctgatgttcagttaacataagatgatgtcaagtatttgcttcaaaagactccagggggtaggaatggagcgggaggtgagacgaggtagaaaggaagccagtggtccatgtgttagtggtgatcttgaagtcaggggatgagaagatggaagtccattattctagtctctcttcttgtggatatgcttgaaaatttccacagtgaaagttaaaaataaatacattctgtggtcagtgtaaataaatatcataatccagcacttcaaaacaggatctctctggtggctgtgtggccagtttggagctcactggatatctgaaggctcttgtggaaactttggacgtccagtcaaggcaagacgaactttgctcggacaggagggaggtgcggctgcgtgagagctggggctgggtctgaaggccgtgctggctagcctgggttggcacacagcaaagtgcagagtctagggctctaggcacatgggggtaaatgacaccgtatgtttttgagtgcatctggtgtgatggggcatgttcggaggcctcctcagggctgtgcagcgaagatactgtcccacacagtgggctcttgtcttgaacatggtacgcttactgtgaccttgaggctaaggatgggagagaccaaaccagcctgggcagagcggagagagggcaagatgagactaactttctgtgatcgtcatggccatcctggctttccccgcaaatgcatatcacggtggctgtgtatgatgcgaatagacatacctaggagtggggtggggcatagttctggagttttaggaaattccacttgtttgccaacatgcaggtacatgagctgacgttcactgcccttggacgatttcatgggtgggaaaaaatgcatttctacagcatcttaaatcattgatttattttttatacattattctagggattggaatattccagttcattacattgtcttttaaaaaaacactaatccagcggggtgcagtggctcatgcctttaattccagcactttgggaggccaaggcaaaaagatcacttgagcctcggagtttcaaaccagcctgggcaacatagcgtgaacttgtctctataaaaacttaaaaaaaaacttaaccggatatggtggcacacacctgtagtcccaggtacctgggaggctgagatgagaggattacttgagcccaggaggttgaggctgcagtgagccgtggtggcaccactgtactccatcctggacgacagagcgagaccctgtcccagtcaatcaataaaagtaatccatgccttcctcccaacatcgtttttgtggaaagatgtttggatttgtgttgtgtcattttctgctaaatgaggcttgcagcacatttgtcagaaaggagtcaggtgctcatcaggtctcttctaaaacccagcttcctcctggtactgttgcttcaacccttggatccctgaatgctgagaaagctttttggctctaacaacacattcaaagaaaaatgaaagaaagggaaaaaaagaaaaagacaccccctgtcattgcagaagtaatgtattatgatataatagaaaggttttttgaataattcagaaacagcaaagcaagtggtggtttgtctgtactgccgttattcagagagaacatcttaacagttcgatgtattgtctcccagtcccgtttcattcaactctgcatacactcgggttttaggacatctgagtaggcatattaactaggcctctgcttttctgtggagagagagggtctatgtaaaagtcggaagcattcttctgaatggcacagaaagaacattcagtaatgtgtttttccattcaacttttgccagctgagaatgttgagaatttcaggaattttcttctaccccttctctctttgtttgaatcccagtggaccttgggctctttttggcatctgcccttgacgctcccttatggtggccttgcacctgacctgccacagagcagcataggcgcccaggccgagcctgagcgactcaacagggacagagcgtcctctggaaatcataatacaaagcccatcactccgagttcctggacctgatgccagagcattctggcttggataattctcatctgggaggcagagcccagctggagctgtgcttgttgggaaacttcatgtattttccaccactgctcattcccaacttgcaggattttgctgctgtagaatttacgatgccacaaacctgcatttaaggaatgttgcctgaggcagagtaggtgttctaaaggattaggagatttcctggaataagactttccactgtgctgctgaggggtgtgtgtgtgtgtgtgcgcgcgcacgcgtgggtgtgcgagcacataaggcagtacaggatgggaaaacaagtgtagtgcacactacacggaaggcgagagcctccatcctgagcctgtttttaccttggccgtgagctctggagggttgtcacagagctggaaaaacctcagctttgtgtctgaccccacccactgcaccagtttcacaaaataagaaaagtaggatagagccaagccaagcctcaggactctctttgagtccagttctcttcacttccccaaaggtgattcttgatcacgcgaggtccctagatgttaataaatactacttgaaaaaaagattttaaaaatgaatgggaattctgaactaaaaccaaaataaataggtttctttactgtagaaaattttcagagcctttaatgcactaattatgctttgtaaacctccagggaagcatgtggtgtttctcaaacttatttggccaggaaaccttttttcctggccacctccacgtggcctggtgttctgcagaagaccctcaggaaaataccacactaggctgtcttgcctcatgtgccatttaatattttacaaacacctaagtctaattgctgctggatattccatcatatggctaagccaaaatttatgtgtccattctttaattgttagacattgagattgcttacagtttttcagcatcattgataattttcaaaggaattctggttactttgtaaccatctctgattattcccttaagaggtggaattgtcaaatcaaagtatctgaacatttgcaagattcttgaaacacattgtccagctgctttccagaaaggtcatgctcgtttattttctaccagctgcgggcagggttaatgtccatctgcgaaagctgagcagccggagaagctccaagagcctgaagaaggccgttcccgtctcccctgccacagggacctccagcaattagaaaacaaataatcacacacactaaggacataaacagctatttcttttgaggagacacactgggttttcacagttccctgtgccgtttctaaataattgaatgacatctgaaaaatttctcaacattttaatttggtcttctagatgttttgctgggtagtcagggaagaagggattttgaattggcatctgttgtgctaattttcaaataacctttcaaggtaagatgtaaaaataaagctttatcagcctcttgtgactgtgaactttatttccagaagaatctttttatgtgagcattccatcagtcttatttctgaccccacaggaattgaattatgtcatgttgaggactgaggctgattgtggtgcttttgctttctatttgtaagggggaaaagcataaacattgtagactagaagtgatttatctttttgtcctccaccaagatcaccctttggtcaatgcattattgggttttggaactgagacgtgaacttctaactcattaaaaccctcaagtccccagcaataaagtcatttaagtggcttcaccaacagagatttatttcaaagcgattccatttggaggaaggaaagaatgagtaatgcattatataccaagatcgcttcaataattcatgagacctccatgccagtgaccgttttagattcagttcatggtgttttagcctaaagtgaactctctctgtcttagaagacacccgcagtttgctcctctttgagcttgagtccatgaatatctttacttttgggaaataaagtttgtattgactgctactttgtgcgtttacatgaaccactcttatatggaggctattttgaaaaaaatgggcattttgtataattggggtaaaaggatacttaatctgcggtccttaccctttgaaaagtaggaatgtttaaaaaaaattattgctttttccttcctttgggcaggaattctgattttgttttttaagtgtaaggagtagattgccaaatggtgggttaaaaatagatttatggatgcctaataattatgccaaacacagtgttgggccgtcagtgagtacggaaaggcatgcatggcaaatgtcgctgtccccaagtgcgttctggaatgggggcagtgggtggcgccggcccttcagcatcttcggccaccgcacagttcagctgtgaactccttggttcaccctgagcttcgtccaaccttctcccttttctgaaacccgcagaggctccagagtcctttctcttcaggatggagacctgcatggagggactggaggcagggagggtggcccacttcctttccacactattgtgagtgcctcaccagcattcctcagtgcagtaacagggaaacctggggactcagatttccaaataccatcatttcagtttggcaagtattgatccaatgatgagtatcgtgggaaagaaaataataagttagggttttgtcgcttgccagaaaagcttcaggatccacttctccttcctccctgctctctccccactgcccaataaaaacagctgctttgttcaaaacttaaaaaccatattatttaaaactcattgtaaaaatttatgctatacagatgcttgtaaggaaaatgtaaaaatcgctggaaatcccacctgttaagatttagaggaacctcgtgttattcctgctcacagagacatactcccacatacattttaccctacattatattatcatataatgataaattaaccacataataaatgataaattatatgctatatgtgctgttttgagactatttctcatctaacagtatgtcaaagatctcttttcctataaataaaaatcatcattttaatggctatagaatatcattacatacatatatgtattaatctgtgcacaaaataacatagactgggtggcttaaacaacacacgttgatttcttaccatttgggagctgggaagtccaagatcaaggtgctggcagattcagtgcctgtgagggccccctttctggtatgcagatactcgccttcttgctgtatctcacataggggcagggcagggagagaagggagatctggtctccttctctccttataagggactaatcccatctgtgacctcatctaaccctaattacctcctaagggccccacctcctaataccgccacgttgggagttagggtttcaatacatggattttaggggagacacaaacattcagttcataacattataccatgagtcaattcccatttactcccataaacagcgcagggatgtgtcttcctgcgtgtgatggtcactccagtatatattcctctaagtggaattgctgggtcaaatgggacacacatttcaacttttgattatattaccaacagttgctttgaaagaagatattcagcacattccatgtagagtatgtgtgcctcccttcccaaacccacaccaacactgaacagcacaaatctttttacaatttaataatttataagtgtctccttatttttattggtgttcttccgattctaattgaacatgttttaaaatatttgttggcaatgtatatgtcttctgtgatttacctttatatatatctttgtccatttttctattaagccatctttttcttattgactttcaaaacccctccaggatactattttttttttttttttttttttttttgagataaagtctcactctgtcttccaggcaggagtgcagttttgcaatcttagctcactgcaacctctgcctcccgggttctagcatttctcctgcctcagcctcccaagtagctgggattacaggcatctgccaccatgcccagctaatttttgtatttttagttgagacgggtttcaccatattggccaggctgttctcaaactcctgacctcgggtgatcctgcctgcctcagcctcccaagtgttgggattacaggcgtgagccactgcactcggcccctccaggatactttttaatttaaaaaaatatgcagattaagactggacccttctccaaaatatacataaaatgtatgcattctgagactaatgacctctcctgtctggggatgaacgatgctagtgaccagcagcacttgctttgttaacattttggaatggagctcctctgctgtcttgtcatttgtggaccttaggtaggtgtgaagccccgcgttggagaggtggcagcccctccagacccgaggcagctgctgccaaggttgcccttgctgactggtcctcattaatggctcagcaagggtcctgtgatctttgccagtgttccctttccctctccttgccatacatctttcctttactgccgcataattctaatgagattaccctgggtcagtcagttatattagagaaatgatgagcagcagggaaaagaaaattcacaagatggtaacatttaaaataaaatttgtttttggcctttacccaacagtagatttcatggtcaataaaccacaagcatacatatgtgttgatgaggaggaagatttattatttcatatgaactctggggccgggtgcggtagctcacacctgtaataccagcactttgggaggctgaggcaggtggaccacctgaggtcaggagtttgagaccagcctggccagcatggtgaaactctgtctctaataaaaatgcaaaaatgatccagatgtggtggtgcatgcctgtaatcctggctactcaggaagccaaggcatgagaatcgcttgaacctaggaggtggaggttgcagtgagccaagattatgccattgcactctagcctgggtgaaaagagtgaaactccatctcaaaaaaataaaataaaataaataaataatatgaaccatggaaaaattatatagggaaggaatttagggatcctgtaaggatgatgtaggataaaacgtttatgtttaatttgggattgaataaagtctgttcactttggcctaaaactgttcattgttcttaaacagtttcattcattggctcccatgtactatcgaggctcagctgcagctgttatcgtgtatgatattaccaagcaggtaagaatgtctccttcagaatttagatgtcatttatggtggttctctcacttagagagactggagcagagacgtcactgcttgcatcttgccagtagcgtgccactatatattgagtttatttcatgtatatgtaacaaagcatcccatatttatctgctaaattaaacaataatgaccattcattcttaaaattgactgtagaggcaaagtcatgcctgctagtactattctgcagaatgtcagcttttaaagaaaaggaaaatcatttttaatttctgcatgctttataattacagaatacttatttttgttactgtttcaatcatactacatacttaaaatgccaagcataacattcgtgtgtatgtaagtaaatctttgtgtgtgtatatataagtatatttttagttatcacgttgaaggtcttagacttccatcaacaaataaccgcagtagtttgatgacattttttcccactcctgcaaactgaattatttacttttttttctctggagtgttgactcagcacataagactgttagtttaatgacccatcactgttactttccacgagttcctgaccacttctacctaaatgtggtgtgttgcccttggcctgttttctagaggacaattgtgagtgaagggccaacaggaagacaggactctaaatatatatgtttcttccttggtgtaagcatgagcatttacttagtcctgttattcttattcatgtggagtccaggctatcattttaaattaatgttatttataggagaaaaatcactgatatgattttcttaactagatcaagttttaattttagaaaacttgatatggtctatttaagtatatttcagctaacattaacttttgtgcctagacagaggtagtatgttaatctgcatgagtctcctaaaaatatttttctccattaaattgtactgggcttgtatttctgcttagttgaaatattatattgaggggtctttctaatgatttgtgtacactgttggtttaggattcattttataccttgaagaaatgggtcaaggagctgaaagaacatggtccagaaaacattgtaatggccatcgctggaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtggagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtggagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccctgagtgtacaaaggtatcatgcctttgttatgtctgccctcagtgtagtaacttaattaatggcctttcacttttggtagtcaatgtggcattgattcaaccagagaagaaataagagaaaatgatagggaaatacagatctgatgtaccatacaatgataaatgttcaaattataactcctgtacataacacagttacatccctgactctacatatctttgggctagatggttttgttatttctgttgttactttttccattattattttcattatgactactagcacaattttactaacactttcctatggtaatgaccattagaattcttaatatttttcatagcatacctgtttgttttggttctagattttatcttaaggatatagtcaagtacataatctcactatttagttctaaaatcagaatacgacacattgtatgtgagtaccttgactttccccagtggtattgggttattgaacttcttatatcttgaaggaggttgtgaggatccagtacacatgaattagagatttgatgatagctttacctagcctggtaagctagctgttttgctaaataaatacattatttaaaaaaggaaatagcgaatttgtggtatctccattcccttggttaatttaattctcaggaattctagtcgttgattttcataaagacaactacatcatgcttctggttttgctaatcaaagtgtgattaaaccaaagaggaataaataatggatggaagtggatcttgcaaaagctcttaacatagcatttaacgaactgttctgtttctttaggatttcaaaagtttgcatcaacttgcatctggttggtttataataacagccataaacaccacttttctgggatttggacaaatcttcaaacttcccagacttagttatctcccttcgttactgtaatcctcaaacagcttactcatctagtgttcccagcagaatcaccttaacctttgtcatgggaagggtgaggtgggtgggtagagacgacctttgctgagagaaggtgctatctctaaatccccctaattatgggactaatgtgcgcctttaagtggaaccgagtcttatgtattgtgggaatgctggtggactagaatttaagcagaaaacgatttaaacttgaatggtatcacttaggattcttggttatgtggaaccaaagcacaactgaaattcaggagaaaggggaatttattggaagatactggtaatccacatggtaaaaacagaactgccctcagctctggcatttgacatgttccagagttagtctctggagagatactggcctggcattctcttcgtttccagtctaaaatgccagggaggaattccccaggttaagaacaggcgtgtgtggccaagaggggattggtagtacgagatgatatttcccaacattactattagaatgggaaggcaggtggtcttgaagagggacagttcctagaaaagtgtagcctggccagataaaacatatctgtgacatatagatgtggctaccagcacccaaagatgtgctgtgtttcggggtggaatttgccttttatgcacaggtacagcattcttcttgatgggtgttctgatttgtgctcagctgattcttatatgtgcaattttcatagtgccccagctaacataatctattcatctcacttccaaccgtgaatttactcacagcctctctatccccagtgggagaaaatgcagggccatccagctgctacctctagtggtagtgtcatggggccactgtcccatgcatccagcctccctggtagtatcttttctcctcttgtttggcctcagtgaggtcggaatgtggctcctcaagatcctgcagttgcgttttaaagtgtggcatgtatatcttttgttatacacagttattttagatggtacttgttattgaatcaagcaacaagaagctgactgcctttaaaactctgattaggtcagtgagaaagactagttggacactaattcatttttaatttttaaacatttaatatgttgtattgaggtaaattacaaaacatcacggtcacctgttttaagtgtatacagttcaacgactgttagtatatttttagagttgtacagtcatctcatatctaattttagaacatttctatcactctgtgaagaacgtcatgcccatttatactcgctctcaatttccacctccttccagccctggtaatcactaatgtacctttttttcctctaaatttgctttttctggacgttttgcatacatggaatcgtacaatatgtggtcttttgtgaccatcttctttcagttaagcaaatgtcagtgatgcattcatttttatggctgaataatatttcattgtatggatataccacatttttatttattcattcacacattaacatttgaattatttctacttttttgctattatgaaaaatgttcctatgaacaatcatgtacaaattttgtgtggatgtatgttttcatctctctaggatatgtacttaggagtggaatttctgtgtcacatgataactctttgtaataattttgggaactcacagactgttttccaaagtaactgcaagatatccacatcctcaccaacatttattgcctgtctttttgatcataggcatcctagtgggtgtgagattgtgtcactgtggttttcctaatgactaatgatgttaataaatgtcttttcatatgtttattggccatgtgtgtatcttctttggagaaatgtctcttcaaatcccttgcctaatttttagttggattgtctttttattatcgagttgtaagagttctttatgtattctgaataaaagtctcttatcaaacatgtaattcgcaaatatttcctctcatcctgtggattatcttttcacaatttttactgtgtgcaaaagtttatgtccagcttatcatgtttttcttttatctcttgttcacaagtgattggctaattgaacatcacaaatatttattaatgttttcttagtgcttacatttaggtctgtcatccattttgagttactttttgtatgtaatgtaagatacgggtccaaattcatcttttgccatgtggatatctaattacccctgcaccagttgttgaagagatggtttctttcccattgaatcttttgggggcacttttgcccaaaagcagtcaaccataaatgtggtcttatttttgtgctcttaactttattagttgatctacacgtctgtcctgacaccagtgttatactattttgattgctgtagctttgtagtaagtttgaaatttaaaactgtgagtccttcaacgttgttctctttttcaagattgtttgactattctggacccttaacattttcatatgaattttaggatctatttcttaatttctgaaaaacaaaaggcaactttgattttaacagaaattgtgttgaatctttaggcccattcaggtattattcccatcttaacaattttaagtcttccgatccatcagtgtgaaatgtcttttcattttaataggtcttctttaatttcttttagcaatgttttatagctttcagtttacaagtcttgcttttgttttatttattcttctgtatttgatttttttgatggtattgtgaatgggattgttttcttatttatggcattgcttgttgttagtgtgtagaaatgcaattgactttagtatgtttatcttgtatcctataactttcctgaactcatttattaattttagttgttttttagtaaattatctggagttttctatatacaagattatattatctgggaataaagactattttacttcttcctttccaatatgggtgccttttagttctttttcttgactaatttctctggctagaatctctaaaacagcctggaataaaagtaatgagagtgcacattcttgtttcttcctgatcttaaggataaaatgctccagtaagtatcacactaactggttttacatatatgttttttattctgttgaagaaattcccttctgctcctagtttgttgaaggctttttgtcatgactgaatgttggattttttcaaaaaactttttacatatgtaattatatgttaattgattttgggatgttaaactagtcttgcattgctgggataaatcacacttggtcatgatgcataatcctttttatacattgctgggtttagtttgctagtgttttgttaaggatttttatgtctatattcataaagggttttagtctgtagtttccatttcttagaatatctttgtctggccttggtatcagggcaataacagtcttgcagaatgagttgataagttttcccacctcctctgttttctagaagagtttgtgaaggattgatgtcatttctctttgtttttctacatcaacttgatctccatgatgtcagttctttaagtgttatctaatttgctgtgtagttcatagtattatctcataatctttttttcttaatcccatgaccaattaaataatacttctaatttgtataaggtcagtagtgatgtctcattttccattcctaattttagaaatttgaaacttctctctttttttctcattcagtctagtcgatagtttgtcagttttgttgaccttttcaaagaaccagtgtttttggtttatttcttttcattgtttttctctttcatttatttatcctctaattgttatttccttcctcctgtttactttggatttactttgttcctctttttctggttcgctaaggagaaaggttagcatatttattcgagatctctttaaatgtaggcatttatagttataaattttcctgtaagcactgctctagctgcatctcataggttttgatatgttgtttttaactaatctcaaaatattttctaattcgtgttctaacccattgtttatttaatagcatatgcaattcccaaattttgacttttgatcatttctaatttaattccattgtaatctgaaacatactttgtatgattttaattattttacatttattgaggcttgttttatggcttagtatatggtctgtcctggggaatgttctaagtgagcccgatgacactaagtttttaagacctatttttacacttgctattctcccttagagagaaagtctaaggttgagggccctctgcagacaagtgtgtctaactagagtttaattatattttgtctttatcatatttattttttaggattacattctttttatgatagttgacactagtgttgcatttatgacagtgatatcatatttcttttaaaatgttaaaaaagttgatttatgcacatgacatgattatctacacagaaaagcccaaagaatctaccaaaaaagttctaaaaatactaagtgggttcagcaaagttgtgggatacaaaagcaacgtggaaaaatcaatcagatttctatatattaatactaacaataaatatgcagaaactgaaatttaaaacacgatattctttacaattgctccaaagaaaatgaaatacttaggcatatatttaacaaaacatatataggagctgtatgctgaaaagtacaaaatgttgatgaaagaagtcatgtaagagttgaataaatggagagacatattatgtttatgaattgaaagtctcaacatagtaaagatgttcattctcttcaaattgagttataggtttaaatgaaatttttgtcaaatcttagcaaggttttttgtaaacataaataagcctattctaaaatttatatggaaaatcacagacactgaatagctaaaacgatattgacaaagaagaatataatggaaagaatcactctgttctatatgaaggcttaccatatagctacagtaatcgagacagtatggtattggcagtgagacggatgcatagatcaatggaacagaatagagaacccagaaataaatctacacaaatatgctcaattgattttttgacaaagatgcaaaggtagttcaacagaagaagcaattcaaccaatgaccttttcaacaaatagagtaatcggacatcaataggcaaaacaaaaacaaacctcaaccttatataaaattagtctaaaatgaatcacaggctttaatgtaaaatgttaacccataaaacttttagaaaaacttctaaaagaaaataaatttaaagatctggggttaggcaaagagttcttagacttatcattaaaagcacgattcatataaggaaatactgataaattagacacccttaaaatttaaaaacttaaaaatatttgctctgtgaaatattgaggtgtgaagaggatgaaagacaagctacagactaggaggaaatatttgcaaactatatatctataagggactagtatgtagactatataaagaactcacaaaatttacatgaaaaaatttgaaaatggcaaaagacataaacagacatttcacctgagagaataggaagatggtgaggaaggatataaggcgacgttcaatatcatcatcaaacctatcagaatggctaaaataaaaatcagcgacaacacctaatgctggtgaggatatggaaaaactgagtcatccatacgttgccggtgtgaatgcaaaatggcacagccactctggaaaacagtttggcagtttcttataaaactaaacgtgcagttaccatatggcctggcaatcacattcacgggcatttatcctggagaaatgaaaacttatgttcacacaaaacctgcacatgaatattcatagacacgttatttgtaatagtcctaaactgggatcagcccagatgtccttcagttacgaatggctaaacaaactgtggtgcatccataccatggactactactcagcactaaaaggaggcaaactgctgatacacacagctcgaaatgcatcttcaggggaattgtgccgagtgaatgaagccagtcccaaaggtttcacattgcatggttccatttatataacattttagaaatagaggatagattactgattgccagggcctatcataaggggaagtaggggtgggggacggggaggaaagtgggcatgggtttgaaagagcaacataagggaccctgtggtgtcggcactgcttggtatcttctctgtggtggtggacacaggaacctacacaggtggtaaaattgtatacagcttaactcacatacataagtgcatacaagtaaaactggagaaatctgaataagatagaatgcatcaatgacaatgtcctctttgtgatattataccatagtttttcaagatgtgaccatttagggaaactgggcgaagtgtatgagaaatcgcttggtactgtttcttacaactgcatgtaaacgaatctacggttatctcagtaaaaaatctgattaacaaaaagttgatttagataaaaataataaatattggaacagtcaggtgagggtatgtgtgatacatatgcattatatatattatatacacatggcaaaaattacaaagggggatgtatttgacaaaaattttgtaaacacactgggccaaatgattaaattaaccatctccagcacacctaaggtacaaaagataaacagggtaactgtattaaaaattcccatttaggaaagagggaaggggaagactgctgcctgggtctctgcccagaatgtctgtctcctgtgagacaggaatagtcggtaagtgatagggcctgggaacctagtgggcaccggcttgttgacacgtttctatggtgggggaatcggttcttggtcagcaatctggctgctccagattctgcctgctgatataacttttctggggagttagccaaacctctaaaccccagaccttattcagagcttgaccttcttttactctaatcccaaagtactttgctctcctgtaattcccagaaaactgtatttgatttttaactgagggttgtagcaggacagtatgtagatatgtgtgtgtagatatgtgtggatgtagatgtgtttgtatgtgtgtgtgtatgtgtgtgtgtagatgtatgtgtgtatgagtgtgtgtgtagatgtgtatgtagatgtgtgtgtatgtgtgtgtagatgtgtatgtgtgtgtagatgtatgtgtgtataaatgtgtgtgtagatgtgtgtataggtgtgtgtgtgtagatgtgtatgtgtgtgtgtagatgtatgtgtatatgagtgtgtgtagatgtgtgtgtatgagtgtgtgtgtagatgtgtgtgtgtaggtgtgtgtgtgttggtggaactgatctcatccaacacactttggttgtgtaagcttgtcaattcttggaaggagctctgcctggcctattttgagaatttgctggatggaaatggaattcgccctccaaccttggctcagcccacttaaggcatttgagtgcagaagtacttggcagagatgcctgttcagtgtgtttcatcttcttgcatgttccagaagatggtataaaggtccgccccactcccagagtggaaggcattcagaggcatccggtcaggtacactcaggatttttagcttggatttttttctaggttcctgatcttggtgagagattttcctatcttgaacaaccctaaacaaaatctcccctgctcaaattattgtgaaactgaagtaatgtatggtccctctgaatttgaggcatgaaagcaaagtggaatgtgagaagactgtcctggacttgcacagagtaggtgctcaggggtgtaaccccccgtccttcctgccgctcttctccctccccatgaatgttctggtcacagctcccaggggtggagagtgtgcagttcctggtggggcaggccattctgttctctccaccatctgctgatgctggagttaggcttgcacagttggggacatttaagggattgtcagagttgcaagaaaataagaacctcaaatggattgaatccacaggatctggggtaccagctgacttgcctggtcaagatggcaggagaacctagtctgtgtgcgagctggggctggcagcaagtttctgaacaagtagcacatggcatggggctaattcaaggtctgtgctattctaggacagcagattggcctagggtctaaatagaaaagaaagctttgtctcagaaagtctggagagccctacaggacgctgcatgtccttttcctgggtctggtgggaaaaacagggcagttgagtcttgcaaagaaaaaaagagaaataggttgtaaccttgcctcagtggttttaaaagtttcatgaattcaagaaaccatagtgcacttgttaaaaattccagttctaggaaccaggtccagagattttgattcaataggaagaggcaggcaagggtatgtgcattttaaaaagtgatccttttacaagtggtccaagggtcattctcggaaaagcattgctttcgtcagtaggagtttatggtagagaagaatgaggaagtcccagaatctatcctggcatctgtacaggtctctaactgcaggctgcactgtctgggcttctctcttgcccttcaggcttcctggagaatgaaaacaatgactcatcatctttcaggattcaaaagtgtcacccattatcctaagcaaattaatccaggaacagaaaatcaaatactgcatgttcttacttataaggggaagtaagcattgggcactcacggacataaagatggaaacagacactgggagcttcagaggcaggaaggagtgggggacagttgcaaaacttcctcttgtgctcagtacgtgggtgacagaatcaattgtaccccaaacctcagtgtcaccccgcatacccatgtaacaaacctgcacacgtacccctctgaatctaaaataaaagttgaaattattggctggtcagggtggctcacacctgtaatcccaacatgttgggaggctgaggtgggcagcttacctgaggttgggagttcaagaccagcctggccaacatgatgaaacccccctctactaaaaatacaaaaattagccaggtgtggtggcacacgcctgtaatcccagctacttgggaggctgacacatgagaattgcttgaacccaggaggcagaggttgcagtgagctgagatcgcaccactgcattccagcctgggtgacagagcgagacattgtctcaaaatacaaacaaacaaacaaacaaaaaagttgaaattatttaaaaaaacacacacacaaaacacaaaagtgacaccattggcccttcatctttaatctcttccaaagcatttccagggcctctctgccccctttcacaccccacattcataatcaccaggagaagagatgtgattgggttcaaattaatatgaggctaccctatttagcttggatctttttctaggttcctgatcttggtgaaagattttcctattttgaacaaccctaaacaaattcttcctctgctcaaattattgtgaaactgaagtaatgtatgatccctcttctggatggttcgactcccttatatccagcctgtgcttggttgcctttggcttgggtaaggggttaagggtacctggctttgggacctctgtgagaggacctgcaggtatttcaggaaccatttgctttagggccatgtggccaggatcctccgcgaaggagggaaggtcagaggaagaagagcatatcctatcccaccctggcccttaagcaagaatcactccctcacacttcctctgacaagcatgggcagccttgacctatagctgccataataagtcattccttgggagaaattactccaaccccatacattccgcatagcaggttctagttctacatttcttctgcttgatcttgttttcctgattttgaattcttggctctacacaaatcccctttgactcttcccaatttgaaactctttcaggctttcctggtcatttttggacattggccttcatttcatggcttctaatggaactgcttttcaagctcaggggtctcctgttggcatttccttgaaattccacctctcactggtgtatttagggccacgaatgaatcagaaggatgagggagggatcaggaagtgccgatgggagaagacccctcagacctagtttattttatcttacaagtggtagcagtgggaagttacccaacaacagtgacgatgggggctgggttgggaagtgggagaactttcttctcagaggtggtgggtaatgaccttgagatggctctgctgtcactggctgcctctgcctaagattcctcctaccctccccatgaatacaacccaggagatgctcaggggctgttctcatgcactctcgcctcttctgagggatggaatcatggtctcttaacatcttacggaagcactctggtgcctcttacagaaacattgggagggatgggtgggactgctgccagggagtccagaattccttcctggagtagaggtcatacaccaagacaaagggcatctagtgttagaagtgaaaatagggtagggtaggaggaaggaaattagtcctatcagctctcagtcatttgattagcaaatacgttttgacggtccttttgtggcagcaaagtgctgtgagaatagaaaagagactgtcttttcctttgagctattaatgtttacttctatttgggcagccaagaaagggggtggggaagtatctgatgagcaatgtaagactgtatttaatgaagttccagttggtctgatgcagtccagaaaggacagaggggttcaggaaggggagaggtcagaatcatctgttgtgactaggaaaggcatgggacgacatgcgtcccaggtgaggtatgtgccacaggcagttacggatgtgttggaggaggaaattccaggaaggggcaagatctggaacgaaggcctggaggtgggagcgagcttggcacgtgttggcagggaggggccgtcaagaatatctaccctgcgcctgccctggggaatagtgggaaagatggcgggatggtgtgggtctcagaagcatgcagagtgggtgggctcgatgtgctggccaggatggtgcccgcctcggcttccccattgccaggcagtcagaacactgttttcttctgagcctgttgtggccccaggctcctccttaatgcaatgcctcgggtagtcactaccagttaaagagatcaaacctattggccatcctccaaggaggctgtgggagccgttctagtgtcttgagtaagtgtgtgattcatgcaatttcctgtgcaatctatagctggaaaccagggtgagcctgtgcttccatagtgtacacggtcaagttagaaacaccaccagccatctcctcacttgttttacatttttggataaagttgtggtttttaacagattaaaaatatatttggagataaatactttttactaagaataataaatttacattgctttcatctcttccatgtgactctaaaactcattccagtcttgatagtgagccacagttgagtaggggagtttcttagaaattatacaaaccaaataacagaatttgaaatgctggaccttaaaaatccaatttattccaaatactaaaagcactaaagccagtgaacatcaaaaggcctgaaaaatcatggcaagtgttaaatgcacgatgcgttttccttatgtgagataatgaggaagaatagagtctgtgctgttaaaatgtgtgtgctctgagatgtgcctgtccgtgttctgcgactgatgtggtgcgggtggcccctcccatttacctgctgctgtcacaggaggagggagggagctgaagactgagctgcccagagagcccatcaaaggcatctggaatctttcttaatttaaaacattcttaaagaagaatatataaaacaagcatatcgtaaggaatactgtggtaataaaatgaacagccgtgtaagtgtgccacagagaacccttccccaatcgtatcctcttctctccacccagaagtaaccaccctgctgactttggtgataaccacttgttttcgttatgctttacacctacatttgcattttccaagcagtagatttgcccgtttttgaactttgtaagcggaatgagactgtatgtgtcacgtgatgacgtgtcgttcactcagcatgtttgtcagattcacctgatgggggttagctgtggtttctacatattcattgctgtctactgttccgttttatgagtggaacacagtttatctattcattctattggtggatatttgagttatttctggcgtggtgttactatgaacattgctgcttgaacgttcttgcacatgtgtaagcatttctctggactggggtaggtaagagttgaattgctgagtttcagggggtgcacaccctcagtcttactaggtaatgccaacgtctttcacggtggcatggaatatgccaatcgtgtgtgagacttcctgaggctctgcctccttgccaggcttcagaattgtgatccttcagggcatatagtgctatctgacagtcatttcaatgtgcattttcctaattacctataaagttgtcatctttttatatatttattggccatttaagtttcttcttctgtgaagtgcctgttcaaatctttgccatttttttctattggattgtttaccgtaatcttgtttatttttaggatttaaaaaaatatatacttgatgctattcttttgttatctctatgtgttgaaactatcatcttcgaatttaggtcttatattttcattttctttatgttgtcttttgcttttaaaaaatattattattattattattattttagagatagggtcttacgtagttgcccagctggagtgcatagctcactgcagccttgaactcctgggctcaagcaatcctcctgcctcagcctctcaagtagctaggactatagatgtgcaccaccatacccagctaatttttttaaaaaaatttatgtgtttgtagagatgggggtgttgctatattgccaaggctggtctcaaacttctggcctcaagggatcctcccaccttgacctcctaaagccctgggattataggaatgaaacaccgcacccagttctttttttcattttttaagagacagggtcttgccatgttgcccaggctggagtgcagtggctattcgcaggcctaatcccaccactgatcagcactgaagtttccaccttctctatttcctacctgggccagttcacccctccttaggcaacctgattgtccgtcaccccttggaggtcactatattgccatgcaacttagtgcagacacctgattgacatagtgcactacaacccagaactctggggctaagtgattctcctgcctcagcctcctgagtagctaggactgcgggtgcatgccaccatgccaggctgtgttgttttttcatcatcagaagtccttaatttttgtgtaacatgatttatcaatttttttctttatggtttattttggggggaagagcctaattttaagaaatcttattttaaaaatatttccatacctccaagatcaggaagttattcccctaatattaacttactcccccaatattaactatctttcataagctttacagttttggttttcctatctgtcttcaaatcacttgaaatggattttgatatgtatgctgcttaatttttcccatgtagacacccagttgtctcagcattattggatgtgaagtccactgttttcctactgacctgcagtattagctgtcatacgttgcgtgtcatgtgcacagtgtttcttgggccgtctcttctgttccatcggctgacttagccatccttaaatcaacactgcactaacttaattacgatacctttatcgtgagtcttgataaacagtctggacttatgctctgggatctttaatcaatacttgtgggccccagaaaagatttcatgagcacatagaagtgtgggtgtggacatgttatggtctggtggagactgggcttatgttgtactttgggttatgatgcagaactatgttatctatttcgttgctcaaacggttccaactttggccactggggtttctttctgttggctcccctgtccctttgacatatgcctatcattttggtttttgagcactttcttactttctggcacaagaagctgtttcagatttatcttggatatttttggctccggccctatagtcggcctgactccttttccctaattaggactccacaggaaacacagtcccttcttcaaggagctcggcctagcagtagacagcttctttgtaggcaggaccaggcttctctgcagcagaagggaacttgaaatcagggtaatgagcctcagcagggacgggccaccacgctgccctgagaggatcgtgtgtgggcacggcgctgtggcatggccctgctttgaccctctagctatgctgtagggccaggtggagcctggagtggcctgagctggggactgccgtgaactctttccactccccaaggcattgcataagtaatgtcactttctacttgcacagcaaaatcagggacacagttttctcgaacacggggtgcctcccctccctgcagcccatgctggtctaccctgggtggtgggcccttgtttgtgttagagacagaacgctctgcaggattctgagtggccagttgtggctcacagtccactggcaagtggaggcagagctgtggagcccttggtagccacggagggcctgccacccgtcatgaaatgcctactcagctgttactggccccctgtggacggcagtgctagtgatggacagaatcctgggactagtgccagtgactctgtggatacgccgagcgatctgggcgtgcactgctgtggtggcctttatggtcaggaggcgacatgcagtgagaagaagggaagaactggcccaaagggattcagcccagggtgaggtccacggaaaggccagggccaagatgcagccagcaccccaggccggtggtggcctcacatcacccatgccagaggtcagtcctcgattgctccaaaccctctgctcaagggttcagaaggaaatgagcaggtcttcccatcagggcccagatgagcttctgaaaacaagtgtgacaaaacaacctcctgaacatcctggaatgaccgatgcaaagtacaccccacacggttcacagcacgaagatcatcaggggcaaaccgtggacgatctgaatgacagcacagaccgtcagcaacctgcagagctgcctggccaagaaattacgagacggaagcaacgcttgcaggcgaaggaggagaagaaggaaaggccagagcaggcaggggcaggagtggaacgggccgcgaatgtcggagtgaagtgcagaccttcctggcccacacccctccgagcatgtgctcgagggcagtagggaccacgtggaggacaaggacttggcaatggtggggaacagggaatcaggacatggcagtccctcagcatcccggccagaagtccctctgaagagtgaatgatgatggtgacttaggtgtgtcttttgaatatcctgagggggagattggaaaagcagacttgcaatcctgggaagaaatccaaaggtgtaaagaactcacagcggaagtccaaagtcttcctgcaggcctccctgcggggcacgagggcacagctggagagggagcttccaaaactgcagctgagggttcccgctgcctacactgcaccgagaactcccgtgatggggtctcacgggagtccacggaggagaacgcctactgcctggacctcgaccagagacttcgaaaggtgcacgaaaacgtgaaccgccgtgtcagacttgcaaccactacaagaagatgacccaagacctggcccaggaatcgaaaaaagacacttccaattttcagagggagatcttcttccgtgagaaaatggcccaggaaggccggatggctgctgtatccactgagacagcgctccagccgctccgggaagaaaatgaccacagcaggcagaagccagctgattttgaggccaagttccagcttctccggggtggtgctttggctcctggggttctgcccgcagcccacaggggcccggaagtgtcagggggaccatgggacgacagggcccccagaagggaggcaggtcacaatgtgagggtttgggtccagagtacctgctggtttgattctgttttccctgtaaccaggtcctgaacgcccagagcctcagcagaacatcagccagtggtgctccctttaagttacttttgctcgatctcttgttagtttagttcattggttgatgctgaagttgcttatattgatgtttgatagatggcattaggattgtaaggtactatttttcagataaagattgtttaattctggcacatacacgatttccacatctctggaccctccataagtacgcaggataagtatttcattttcgtttagaaaaagggcctctcttacctcaacatcattgtgttcgttatggataggaagacataagccatatctgatctatgagctgttattagaaaatagtacagtaaattggctggaataaaccttggttttaaaacagtgccaaaagtgtcataaagttctttgtctctgacccagaattcttgggtcttctgtcagcatccattgactgtatcagatgattttattgacttataagtagggtaaagtcaatcccttcatgctttttatgagacagatgggatactgatagagatatgaccgtctggaatagagccaattaatgagatttaagggaagtccttgagattcagtggtagacacattgaacaaattatatagtcttttgtccaacaaatagttctccactatgcagccctttttttttcttttttgagatgtagtttcactcttgttgcccaggctagagtacaacggtgtaatcttggctccctgcaacctgcgcctcccaagttcaagcaaaactcttgcctcagcctccctagtagctgggactacaggcgcccgccaccacgcctagctaatttttgtatttttagtagagatggggttttgctatgttggccaggctggtcttgaactcctgacctcaggtgatccaccctcctcggcctcccaaagtgctgggattacaggcttgagccactgtgcccagcccagtatgcagccttttaataagggacaaacctgaacagcaggtggtaggctcaaaaacacctttcctataggcatgtggatctcctcactaattcagctgtcagtcctattgtgacaattagcaataaatttcttctggggttgaaggggaaggttctaccaacttcagacaatatttacagagacataaggaaagaagtcataaagaaatattcaaagttcaaaaaaagaatgaacataagttcttattgatgcctctaactctaatccagaaccacaagccctattctaaccttctttggcggtgggggaaggatgctaaaagccatcagctactgagtgattaaacagagtggtttaatcttctgttcctggggattttcttcgaagacagagtaatctcttttgccttcacttcacatactgcccagaagtttcagcatttcataatgtaacttatattaatattaagaactacaactatctcagtgattactttcaaatggcacaatttttacttatagttgatctgtctcctgtttacttaggaagtgggttgtaaacaagttaattattatcactgccaaccctaactgagtgcctactgtgtgcatgtgtgtagtttatgtcaatcctcccatcccatgaagttaatatcctcttcgtatcttatcaacaaggaaaccgagacacaggtgggtcaaggggtcgatcctaggtcctgtagctaagacggtgtagggtccagcttctgacctaagtggtctatcccagagcctgtgttcttgaccgtcatggtatcttgcatccactaagaagtacaaacaggacccacagtacaaacaggaactcccaaactgccccgagagaaaacggcagctggtatgatccgctcagaggatttggagccgacaactctttccagtggttctttctctggcctcttcaggactaggctgaatttctgtcagcagaaggggattaagaggcaaaggaatggccaagtcccctagagaacctgttttctgcccagtccctgttggattccaaattctgatatgttttccatgagaaacaacccatttaaatctgtggcgagaacctgacactgctcgtttgaacctgacaccaggaatttagccccaggtgaatagcagttaaggacatgtgttattaagtaggtgaggccccttgggagcagaaattctttgctggtacacggttgtcaagtgctttagctgtaagtgcttagatcattgcaatgtgttattgtctcagatatttgctgtgaagggagtagctattctttgtttttttcaaagaagtttattttcgtttttttccttctcacaggtaaaaatccaagtgtctgtaagaactagcattttaaacagagattttgctgctttaattattgttaaaatggttgcctcatctgtgtgttacatagacatcttgggtatttagagaaaatatgagctagggggagcataacaaactctgattattcatttcagtgggtgcttgccggaacggggcctgctgtgagaacgcgtcagagcacacacagccctgcagccctcctctgcttgattttgatgagatgttgtgaatgatttcccttgcttttggctgcaataccttaaacatgtgggatggttttgacagaaaataattccaccacacagttaacagccgtctcccgctcaccgctgctgtgctgctcgtggccggcttaattggtcttttatgcttgaccttggaagggggctgtggctcggggagagagtaaaaatataatgcaaaaaacatgtaaggagacgttaaatgttacattccaggagtctggcagaatataatatacttagttttttctgttacagtattttagaactataatatgcatgctagaacatgtatgaaccaccagagaatttgttttaggaagcgctaatgagtccactcttctttttatttttatttttatttaactgtaaaatggtgcctgagcagtgtatattttattgtgccctagctatagtcatcttgatacagatttccaaactactggcttcatagtgtcagattatgaattggatagagtgaaaaaatatcagacttgactttttatagtcccccctacaagaatcattctccatctttagcaggcttgagaactgctgggaagcttgctacagtgtagatttctggggcttgcccagtagacattccgattctgtaggtctggggagatttagtatatgaagaatggagtggaacacatggggagagtcagtgtgtgaggaatggggtgagacacaaggggagactcagtgtgaggaacagggtgaagcacatgggtagagtcagtgtgtgaggaacggggtgaaacatggggagattcagtgtgtgaggaacggggggaaacacacggggagagtcagtgtgtgaggcatggggtgaaacacagggagagagtcagcatgtgaggaaccgagtgaaacacatgaagagagtcagcataaggaatggggtgaaatagatgggaagagtcagtgtgtgaggaacggggtgaaacacaaaggggagagtctgtgtgtgtggaatggggtgaaacatggggagattcagtgtgtgaagaacggggtgagacacatgaagagagtcagtgtgaggaatggggtgagacacctggggagagtcagtgtgaggaatggggtgagacacacggggagattcagtatgtgaggaacgggggaaaacatgagaagtgtcagtttgaggaacggtgtgaaatacatagggagatttagtgtatataaagatatttgaaatctgtgcaaaaaagaggtaattcagtaaatagtggtggaataaataagagaaggaaaaataagagaagataaattcaaaatggaacaaggatttaaatgtaaaacaatgaaatcatgagacttacagaagacaaataatttttaaaataatcttaaaaatggaatgaattatttaatcgtgatacaaaactcagaagccatggttgaaaatgatgaataagcctgactatatggaaacttctgagtggcataaatgccataaacaggaatcaaatacaaacagcaggttgaaaaaaattcggaaaatgtattacaaggggctaggttccataatatgcaaagaacaattacaaataaataagagggaaaaaccctcaaataatccaaaaccaccctgggcagagaacatgtacacgaatgtcatggaacaagaaacactcatggcttctaaaaagttattcaccatccttgaataaaagtttctcagaattaatgtcagatttttttcattgagaaaggacttcaaagtacgatgcagttctactcttggggtgacttatgaacattaatatacttgtcaagttggctgatctggcctgtgctcccctcatgcttctatggaatgttgataattggaccgggagctctcctgggcataaaatgaaggggttgagttggataacactacaaagggcctttacttgtttcttctactcgcatcatttcctcagtctttttggcattctgtaagaaagtagtgccatgctgtcatcctcactgagacggctttgcaaagattcatttaagaaacattgatataacacttatggtgtgcccggcattattctgagcactttataatatcaacctccttttcccttacgtaaacactgaacattgctgtaaaatgtccacccagcctggtggaatgcatggacgacatagacctgagggaggtgagcactgaagggtatttactggtggagacgatcgctttctttctgtgagcagtgcacttgggctgcctgcctgtatttaccctctcatgtgaggtgctcatctgggccacctgggaacgactctgagccaaaacccatagtcaagacgcctgagtgtactcaggcagactggtgtggaggtggagctcatctctctccaaaggaaccttcccagtaaacctccgtagggaaaagcattcttctacccttagcctgtggatttgattcccttccctcacaggcagggcttcaggattccttctggtgtacctgtcttctattcccccagccatcagtgaaggaggaccacaaagaatttaaccagctctgaaattagaccgaggcagctgccatgttgccaggttacttccacaaacaacaaaacaagcacccctattgggtagcacaggcctgttggaaatgctggagcccgcaagaatgttgtttcctgatcccctcccctgctgagaagcctctgagtgccagggaccagctcagggctcacctcgctggaatacaggctggttaacatcagagcctgggactcagaggaggctccctttcatgtttttaccctcaaagcctccctcccagcccacttggaaggctgggtgagcctcttgtcccggatcttttccagttgactctcagcactcaccacacttcccactaagtccatagattcctccactacccactcctcctttctgctgaaggcaacttggggtgatttttgtcatctagtcattcagcagatgcttactgattgcctcctgagagccaggtaatgtgaggatccctggacatgaaaacaaaagccacggttctggtccgaagacatccacagcctgtttgaacagagagacagcttcacaaggagatggtatgacgataggagtatgacaggaagaggggaagagcatctagcctggtggaggggttgccagactgagctctctaggaggccgtgtgagatgttgccacctgaacagggagaagtgggtgcaagaacccaaagttccatcaccagcagctgatttaaaatggctgtggcttcgggggcaaacaggggaagagtaaggcatgaagccccgtcctgctaaggcgttggtttgattctccagcaatcagaagatgttggagaatcctattcacaggaatacttggtagattcgcagtttgaagagtccccaccatgggcacatggattgcaggaggctagaggaccaggaaaggcaattgcgggtgtccctgtgagaagcgaagagggggtgactgcagcagaggcagcggattggcagtgaggctggaaggagggtaaagcaggctttatcacagagcattgaggtttgcaagaagagtggcagatttgtaggtgagaggtggttggtcgggctttgacaagttgcatttgtgaagtccatttgccctgagcagcagctagctagctcaagggggagatgtgtccagacgtggaagagaaagggtggagtctgtggcccccgagcctgtaaccacacagcatgaacggcaggtccctaagatgctctgcaggacagtgtccaccgtgggaggcagtcacctatccttcatcctgactcagtgctttcattcccatcacctgagcctgattggtctcttttgtggtcccgcagccgttcctgcggtctccagctttcccacttctcccgccctccccatcccgcagcggctcaggagggactccagctgggttctgaattccaccctccatcctcaccactcagcctgactggagctggccaccgctgctgctttgggatgggggtgtgcttcagacagtcagagaagaaaccctgagtaatgctgacattgatgggccacgcagactatgatcagctccgggaatgtctgtgaaggagcagccaggggacagggctggcctggggggatctgcatccacacttcctgcagtcgtagtaattctcagtgatttctgcatatagattggtctagaaagtctaaaaatagtctttaccgtcaaaactaactctctgcatgtttataccttggcttgggtgaactcgtttcagtttacctgtttcaacgcctagcacaatgcccagcatatagtaaaccctatacacttgttgaaaaaaaataaacaaaagtcacgggatgccgtaccctcccataatcgtaatgacgggaggcctgtggtggcagcctttctgcatcatgggtctgtgcagtggcctctcctgaagtgcagctggagttctcaaatgttcccagttttacatgtttgcaagacattctgggaagtgaattctcaccttcgcaaaactctcctcacagattgtagtcacaccatttgttccgacagcaatttatctgacactaactggatgtcctactattcagttcaattcagacactgactacctggagttagtgtagaccctgcaagttaagagtgcaatactgcgagactgcctcccatttcagactagagctgcaagtttctggtatccccaagttatctgcatttctgcccaacagactacaaatttggggtctcctatgacctctcctcaaattcagtaattcactagaatggactcacagaactcaggaaagcactgtactgtcaaaggaaggaattatgattactgtcaaaggaaggaattacaacaaatttatttttaaatattctttagagacagtatctcactctgttacccaagcgagagtgcagtggtacaatcatagctcactgcagccccaaactcaccaggctcaagcgatcttcccatctcagtagctcctgagtagctgagtccacaagcacacaccatcacacctggctaatttttcctattttttgtagagatagggccttgctatgctgctgatgctggtcatgaactcctgatctggagcgatgctcctgccttgacctcccaaagtgctgggattacaggcgtgagccactgtgcatggcccaaatttagtttaaagatctcaattgggccaggcgcagtggctcacacctgtaatcccagcactttgggagactgaggcgggtggatcacgaggtcaggagatcaagaccatcctggctaacatggtgaaaccccgtctctactgaaaatacaaaaagttagccgagcgtggtggcaggcgcctgtagtcccagctattccggaggctgaggcaggagaatggcgtgaacccgggaggcagagcttgcagtgagccgagatggcgccactgcactccagcctgggcgatagagtgagactctgtctcaaaaaaaaaaaaaaaaaaaaatctcaattggctttattcatgattctagaactggcaacaaatcattccataaaatagaataagtgttcccatgggctgagcagaggggattggctttatagacagagaagggctgaagaaagcaggaacaaggaacagtagcctgctagtcgtttcaaagatacttttcttgggggacaggcagagggagggacggggaaacagaacgatggaatatcagatgagttaacatgtcatgtaaggattaaagccaagggaactgcattccatggctactgaagatttcagctggcctatttgggaaattggctgttacctcttgtgacttctcagaaggtcagataactacttagtttgggtttggtgaaggggaacttaagcatgggtgactacttttattttcagtctggtctcatggggcctaatgcaggagcttaggcccgaaacaaaggcctcctataatattaatttgacatacagttctgttgttatggacacaactcaggagtagctaaatggaagagatagtgagggcgaggggtgggagtgggacaaggagcttccagcctctcaggggtagcactcccagcacaccagtgtgctcagcagcccggaccctctcaagccttgtgttcaatagttcgtattgaggcttcattacttagatgactaatgaagattgattaaatctccagccccagaggctggcgttggggctgaaagattcaaccctctaaccatgtggttgattcctccagcaaccaggctcatcctgaagaggccacaggatggtctagggccacacgctatcaaactcagtcatggctgaaggggctcttcaagaataccagaagacactcctatcacccaggaaactctgagggtttggggagaactgtgccgggaaccagggcaaagaccgaatctgtatttttttattatgccacagtaatgggagcatattttggcagactcaagagtgattggtcgttctaatcttagttcacattggagggactttcactggccctccagattcttcctgtaagcacctgttctttaggaggatggagtaggctcctgccccgccccaccccaactgcagtgcatgtgacagtttgaaacactttgagccccacatgtgtctgtcaagatggaaataacagcctctggcatgtggtgctggtgggtgcttgtgccattgcagccctgtaggagtgaggtggacagagtcacgggtttgggttaagccctgtctcacctctcattaggcatgtcacttcggcaggccgatgatttaatgagactcacctctagccatggaaggagtctgagggtgtgcttttcttatcttcccatctccatatttatgttgtagactgtgaaggaattagcctcttggccatggtcatcctaaggatggagatgttgggctgtggtacatgataactgttcttttgtaagcctagtgaacctgtgccgctccttcttgtcctgcagttggactgattagaggggctgaggaagtgcttcacctgtgaatgtgatttcctctcacctgcgggcccagaggcatccttgcttgccaggtgctcctcaccccacccccagtagggtagcaggtgacatctcctcctgcaccccattgtgggcagagatgagccccaccctttatctgtgctttgataaagacttcaggaagaggctgggcgcagtggtgcaagcctgtaatcccagcactttgggaggctgaggcaggcggattacttgaggccaagagttcaagaccagactgggcaacgtggcgaaaccccgtctttaccaaaaaatacaaaaattagccaggtgtggtggtgcgcacctgtaatcccacctactcaggaggctgaggcacaagaattgcttgaacccgggaggcggaggttgcagtgagccgagatcatgccactgcactccagcctgggcgacagagcaagacactgtcaaaaaaaaaaaaaaaaaaaaaacttcaggaggaagtaaaaaacaaggtatcatgccaaactgcacagagaaaagcacttttctgtaatctttcaaatataaaattctgttgccagaaaaactccagcataatccctgtgacaggcctgggtcttgtctgttacaaacaagagagtgaatgtcggggtgtacttttccctgcagtttggaagcacaggtgcccactgacttggctccagggacatatttcttttggctgagaggctggggccatcgcctttaacatggtagaccctagtcaggcgcttttccagctaggactgaagggtcttccccgcatatggtttgagtcccataggaatttgaatgccaaagtagaatttccttggtaactttaaacctcttgaagccatttacaggctctggggcaggtggaggaaggggcggggaggtgggcgctctcccatcactctctgtccctgttttgattttgtgtcttccttctcttttccaatagcaatccttctggtcgaggattgtgatactcttgcctgcagcattagaggagcttccagattcttctcctcacctccatccattctatgcaccattttttcctagactgtggagctgaccctgtcacttcctgtccttcagtggcctctgggtatagacagacatggtgtgcctccctctctcagctccaacctctctgacattctctccattcgggcccgtgtcattcatttgcaaatccgccataacatccccagcagtgctgggtgcagaatcaacttttaataatctccgggaatgtgtgcactctcctgtctctgggcctctgctcaggctgtcccatcccagagtctgacctgcatttgcctagccttcatggccacacttaaggtgaccacctctgggcatcttcctggggtctattgaacagaacacatcacttcctgcccctctgctcctgaagcactttatgtcgcagtgttgtggattagagtgcccctggatgagccctgtttgtctgtgttctaaagcacaggtgccagaaggcagaacctgtgttttctctggcccctgggagagggactggcatgcagcagctgctggagaataggaactgcatcttttttatctttggatccaccacagcattttcacattgaaaagaggtcagtaggtttttttagggtggtatggccgtagaccccatccaagtactagccaggcctgaccctgcctagcttccaagatcagatgaaatcaggtgcgttcaggtgagttttgttttgttttgttttgttttgttttgttttgttttgttttgtttgagacggagtcttgctctgtcacccaggctggagtgcagtggtgtaatctcggctcactgcaagctctgcttcctgggttcacgccattctcctgcctcagcctcccgaggagatttttttaattgttcatttaaatagagttcatgccctaaaacctttgcgagaacatccttttacagatgaaagtccagatatgccatcctgtattgtagccatggtcggtataaccatgctcgtttccaaactgtcacagcacattgcatattttctctgatttgtgaaagataatatgtaaaaagtttcacaaaagcatgtgtgcacaaacatactaacagaggtttggtgttttttaatattgagtcatgtaatggggaaaaaagttgaaatcagctgtagctctgaaagctgaaatgtgtactgccatatttgtcatggttttccctgctgttctggaattcttctgtgggagcaggaacactattttatatatgcatatcttctcttcatgaatgccagagactgggttttaaactttaaaaagtctcactcatactaggtgtccattcttgctgagtgattgaattattattctacaagaagataaaggagctgttgccgcacaagctgtctggtcttttgggtgatttgtattttacaaacaaacattcatttcctgtctacatttgacctcttttccagggaggttcccctgaaggatgctaaggaatacgctgaatccataggtgccatcgtggttgagacaagtgcaaaaaatgctattaatatcgaagagctctttcaaggaatcagtaagtacctgaaattgggttttcagcccaacttgcatttttatgcttctgggagtcaaaggataacattttagaactctgaagtgaacttttcctctgtgtgaatttatcggatgccatggatacaaaatctacagctatgcagttgttaatacccacttctattatcctctcgattctagatttccatgattctgtactggaacctgttcactctgagttctgtaaattaaaatgaagtaatcctgttgcaaaaataaaatttattttaattgaaaattatgcattctgtagcattttatgttaggaggagagagaaaatagacaaggtatagaactcaaggtcacccattagatgggatgactctaggtaaactgagggaaccttccagtaactttttttgcctgatcatctcctacaaaaagtaatgtctccatcctgtttgacctgaaattgggaattggatacagggttggcgtgtacaggtaccccatgtgtctggtgagctaattagggagggtgacagcctccttcctggtcccagtgctgggtcccgttatgctcactgtatgccggctccccgggaataaccttatcaaccagagctggttcccagctaatggctctgccaacacatctatctgcagctgtgaggcttccagctcaacagatttaaccttcataagttctctggttgtgtcattctgttccggattctgccagagaagtccctgctgacagccatctgggaaaactgctctgagacaccctcaggaaagttcgaccggagcattatcagggacgttgggagaagtacaggtgtttgatgaaatactggccctgaagttcctggaatagccaccttaggaggagttgaaccccaaaacagtaattgtcctcaaatatcttagctccagacaactccagaagggaaactgatggtttgatctctttcctgcctgagatcgtttttggcagagctctcaaagtcagagaagccgtggcttcccagaacagttttgatttctgtttaactggtttgagtgcattactttagactccaagaacccacaggagggaatcttttgtttatgttggcttgatggagaattcattggagatggggaattctgacctgtcttacctacactatgcagagatatgcaaaagaaatgtgcaaaagaatggcttggagcctcccctccccagctgctggccctttccttcactggggtcttcactctcttcccttctttccaccttccctttctttcctcctttgatttcttactctcaacagaatggtttcaggctccttgccctgaatggctgaactctagcaggctggggctggaatttcatgtgggaaaccccatgtccccacattcctctcccttctccatcatggtcagtgggtgcagatgctctctggtgttgtgtcactctgggtgacatctaagtttgggctcgaactcattacattagcctcacatttcctcagattaaactcattctcttctggtggcgttaggctcttctgctatgctcagctatgaaacattttgtttttacaggtggttttaatgaatgaagctagatagctcctgaggacgattgccttagcaccttccatccttacagccccgcgtcttccgcagagccccctcctcctccttagctccctggccttggaagacccccagcacagatatcagtggtcagccaggggagcctggtgccttgtatgacctgaacttgagcttgagatctctgcaccagctgggaagctttctgaagtttatgaaagtcattgttaaaatttaaaaatatcaaataaggacctgaaagagaagaagcctgagtaggaagtactgtactaatatcttttttctttttttttctgagacagagtctttgttgctcaggctggagtgcagtagtgcaatcatagctcgctgcagcctccacctcctgggctcaagcaatcctccgacctcagccacctgggtagctgggactataggtgtgcaccaccacactcagctaaatttttggatttttagtagaatcaaggtctcgccatgttgcctaggctggtctcaatctcctgagctcaagcaatcttcccccatcggcctcccaaagtgccaggattacaggtgtgagccaccacacatggcttgtagtaataacttaaaagacatttatccagtataaatcccttcctgtgtgtgacagggactttgaacaggttaattcctcagatcttggtggtctactttatgaaaaaacaagtgctttgctcaaacatgggtaattatggtttcaaagtaattaattcctatataagccatcaaatacccatatcacctcatctttcatgtcacataaacaattgtttgtttctgttttattatactttggttgtaactgccttgacaaagaaagcttgtaaatacacagccatggcaaaacctcagtctgtccatctgtctggctatccatctgtctgtctatccatctttccctccatctgtctgtccatctgtccacttggctgtctatctgtccatctgcctgtctgtctctgtctgtccttctgtccatctgtgtgtatatccatctttctagctgtccatctgtctatccatctgtccgtctatctatctattcatctgtacatctgtctgtctagtcatctgtctatctagccatccgtctgtctgtccatctgtccatctgtccgcctgtctatctgcatgtgtaagcactggatcttttgcctcttttctccttcatgtgaatttcttcagaatggagttctgtagcctaattgcaggttaatttaaaacacaattccaagtacacctaaatatactgcagcagacttttcatttatttttcttttccctgttcctacttacattacatgtgctcctccctgagcttaaaatagaactacatattgctgacacctaggctccccaaagcaatgttccacagtcgactatgcctggagaaaaaatgcaataaaaagttaaggagctgtgaaaataaaagccctttaaaaaggtgtgtttaaacaaaatgaattcacattgactcggatgaagagatgaatgtttctcttttacagtcccatagtgttcataaaccagaaatgggacaactgtgttttctgaacattggcaaatacagtgtctaactggagactgcttacaaaaatatgttatctttttaaagactgaagctaccctgtaaaggatttaggtgctgctctgtttggggtggtctgtgcagtttgtcctcctcatataatatattgtcgtctgattggtattcctccaggcacccttttctaaatcacatttttagacctactttgtctgcctgcatgtggctaattctcttccatgcatttctacccagggtttgtttatttttttttccttgggttcttacacccaaggaagaaaagtaaaaacttgaggttacttttggtttgttctgccattttgacacttaaacatattttatctttaattgattctccaagcgtttaggtatgtgcctgttcttctagggagattgcaagttctttgggagcttgtcttttgtattacccatgaagctgagactaataaatggaatggtgctgaattcggggctttgaatttggatctccgtcctcatctcatgatataaagtgaaatgtaatcacttttctctgggaatttaaggttgaagaacagcaaattagacaagcctacttactcttgattcgtttattcacaaatatatactgtactcttttatgggtaggtgccatgctagaccctggggacagcacggtgacaaggcgcagtgacagtggagtcggggagacagctgtgggcacagtcagatcggtgtctggtgactcttggtaattggtgctgcgcggcgaaggagtggactgtgagaggttactatggggcgagggagtggctttagattgggtgaggaaggcctccccggggaaatgattttaagctggacctgaaaaacgagaaaaggccagtgggcaaagagctatcaggcagagcaaaccgcaggagccaagtcccaaggcaggaaatgtcgtggtgcttttaaggaagagcaaggagtgctgtgggaagttgtggttagagactcagcagggccttgccatgggagtaagggtgatactctgaaacaattggaagcccctcaagcttttaaagcaggagtgcagagtgtccaatttacatttacaaaaaaagatcacacttaaaaggaggaaagtctccgcatgtctcaatcagttggcatgcgattgtaataatccaggagagaagtggcttggacgagggtggaggaagtggagctggatttcagaaatcttccagaagaaccaataacactggaaggagatggggaatgaggaagacagcgttaccaagagtcatccccaagttctgtttgccggaatgaggaggattggcataggaacaagtgatctgggctggatttggttatgagcctagcatataggattctggattgtggtgaacccaagttttggtttgtagattattattatttttttatttttagagatgaggtctcgctgtattgtccaggctggtcttgaactcctgggctcaagtggtcctcccgccttggcttcccaaagtgctgggattacaggtatgtgccaccatggccagctggtttgtggattttaattacttaactcgaatatctctttaaaagtattttaacttttcctgagggcaaagagaggtggagctgcaggctcagcagaaaaatgtctggattggggtggaacccagcaaaatagctatgcattttgctccagttaatttaagtgttgactgtggcagagaaagcaggactttctcctgaaaattacacttggagacactagagacattagaccaggttttatatttgttgttagtttgagagcaaggtgagaaacatttgttttattaaggtgaatatatgggcatggcggtgtgcacctgtagtcccagctactctggagactgaggcaggaggatcacttgggcccaggagtttgaggctgcagtgagctatgactgtgccaccgccctgcagcctgggcaacagaacgagatcctatctctaaaataaataaataaataaataaataaggtaaatatatttagaggtacaagcatattggcttggaaaattggaatggggtgttaatatgaaagacaacaagttaagacttgtgggtagtgatcatgtcttgttctggaaacatttgttcacagagtgttgtgctctaggcacctttagttagtagcaggttaaagtaattttaaagcaaagcaaaaggtttgcagattttataatagtcagcaagctgtcaggtgaaggtaagtttagcagttaaggaacaaggaaaggacaaagacaaagtttgtccactttctcaccccaaaaaaagttaatttaccaaatgcaatccacttaagaaagtggacagactttcttacaccaagaaagttaatttagtgaatgtaaaataatgtcatttcggcatatgggcaagttgggtctcaaaaggcatgtcttttattccagcaattctaaagaagaaattcttcaggtgtgcaaacataataacaaggtttaatatgtacggagctctgattctgtgcttttgttgcaattgctgaaatatatacttagctcattaatgcacccttgatcctgtgaagtaggctctgttatcatccctgttttacagatgaggaaattgaggcctggagaggcttgtaactttccccagggcacacagctaataagtgagagacaggcaggcaggctccggggcacatgctcttagcttgtctatatcatgtcccattgcacagcgtggtttattgtaacattattcatgacagcagaaaacaggaaattactgaactgtccaaaagttaggaaatagtttttaagaaatcatggtacacccatataaacaagtgattcaaaaggatgacataaatctttgtttactgacataaaaagatcaatcattgaatgtgaaatggaagttacagagcagttcatataatatccttatttcacaatatatctcatatttcataatatttcataatctatttcaatatcatatttcatatatttcataatatatttcaatatcatatttcataatatatttcaatatcatatttcatatatttcataatatatttcaatatatataatgataaatattattccaagaatatatccttcttggaaggatacatatcaaaatgttaacagtggttgtttcatgatggtcagattccagggaacttaaaaaacactttattatgtaaaatttcaaacatatacacaagtgcactgaataatatagtgaaccattgtatactcaaaaccaagcttgtgccatctctatcccatcctgtgctcaccacctgtattattttgaagagaatctcagacatctaatttaatctataaatattttgtccataatttttttaaacaatgacaactatgttatcatattaataaccagaatgctgttatcatattaattactatcatcaaataaacagtcagtggtcaaatttccaaaaagttcatagttgtcataaatggtttctttgtttgcatgttaccatttgtttacatcagaatggaaataatctccacatgctgggattagttggtatgtcttttaggcctctcttaagcaatagctttccattccatctttctttttttccccttatgcaatttgtttatccaagaaattagatcagttttcctgcagagtttaagacaatatggattttgctgagttccttttttttttttcctgaatagtattccattgcatgcataaaccacaatttattaatctattcacctagcatttggattgttttcagttttgggtgataaccagtaaaggtgctatgagtattcatttacaagtctttgtgtgtgtaaatactatggattggaatggctgtcttatctggtaggtgtgtttttaactttctaagattagaatgccaaactgtcttccaagtggttttactacagtatgttaccaccaccaatgtgtgggagttccagttgctccaagtccttgtcaacgcttggtaccgtcggtttgtaaaatattaaccattcgaaaggaagtatagtggtatctcattgtgatttttgtttgcattttcctaatgactagtaatgttgagtgtcttttcatgagcttgttttcaatttgtataacttggtgaagagcctcttcaaattttacccattttgtaatgggtcgtttgtcttcttattgttgagttctaaaggttacttatatattttggatacatattttttatcagatatttgtttttcaattattttctcccaagctgtggcttgtcttcattttcttgacagtgttgtttggagaaaagaggtttttaattattgatgaagtgtagtttgtcagattttttcccttttgatttgtgctttttctgtcttataatttctaaatgttaaaataaaaaaaattaaagggatacatccatataatggaatattataagggataaaaagaaaatgagctatcaaaccataaaaaatgtggaagaaccttaaatgcatattgctgagtgaaaggagccaatctgaaaaggctacacactgtatgactccaactacatgacactctggagaagacaaaattgtggagtcagtgaaaagatcagtggttgctgtgggctgtcagggaagggatgaattggtgggtcacaggatttttagggcagtgaaactgttctgtctgatactataaaggaggatacatgttattacatgtttatcaaaacccataaaatatacagtgccaaaacggaaccctcctgtgaactatagactgactatccttaatagtaatgtcttcagcaaatgttggttcatcagttgttacaaatgttccactaaactaagatgttaaaaatgggagaaattgaagatgaggagaggaaggtatatgccaattctctatttttcactcaatttttttccataaaccaaaaactgctcaaaaaataaataaataaagtttatcaattaaaaaaagaaagagaaaggtgcctttgagtggtagggaagcctaatgattttttttaaggttttctttttttcttttcttttcttttctttttttttttttttaactttaaattccaggatacatatgcagaacatgcgggtttgttacacaggtatacatatgccatagtggtttgctgcacgtatcaacacgtcatctaggttttaagccctgcatgcattaggtatttgtcctaatgctctcgctcccccacccccaacccctcaacaggtcctggtgtgtgatgttcccctccctgtgtccatgtgttctcattgttcaactcccacttatgagtgagaacacgtggtgtttggttttctgttcctgtgttagtttgctgagaacgtggaggggaagcctaatgattttaaagtagcttaagtctctccttgttggacacctcagcattttggagcaattgtgacctcccctgattcccctcgtgcaggtgcatcaccacttctttacctccctagacttttaacttcaggctttttggtctctgtcttgactctcccgcctccaggcagttgtcacctcctgccaagcatcttccacagtttccctttccatctgtgcttcctgcttccccgtggcacacttaaggctcacctaacccctgacctgggctttccaggcctcctgacctaatgagcttcccacctgagaatccattccggtcctttatagcatgtagcgcgttcctctttatcctaatattcagggccttctagtaatcctaatattgtcttctttatggcagcaagaggacagtgatagggaataacttcaagtagcatgtgtgtgtcccccagttctgcattattagggcgatgttccatgatcgtgagtcattgctgtgttccagagaccccctctctacatggctagaggctaaaggtcattatcaagagtgaatactgccaagtcctagcaaacttggtcaagttactcatctagatgattcagaaaatcaaatcaagaaatggatgttacacagcaactgccagcattgctaacaccaaacaaaagataaccaagccaagtaaatactggaactggaatgaaaggagagaagaattacatacagtggaatggttagcgggagaatcagcgcttgcgcaggaaatggctggtccacggggaaagggaacagccccagctaagcttgctgttttatttttgttgtgtgtaaatgcatgacagcccagttccgagccaggataaaacttacaggctaggaatttgttttcacatactgtgttcctgtggaatcatttctaaaacctgcgtttcctctagactgtcaactttcaggaaaactgaacttaaaaaaaaaaaagtcttttaaacttctcctagacagcatcttacaaaatccaaaccctattaaaataaacactctggcctcaaatttatgctcaaggacaacttgttctggaggctgactacttagagcacattttgtaagagtggaaacctacagactaggctcagagccttttcagatgtttttgtatatatttttgtcctgctctatgcctgtgtaaataatactgattcaacagagttccaaggtgatcaccttggtacagaaagccatggccattttccaaaaccatgcctttgtgtaagtgccttgaaccttccggtaaattctgaataccttaggccctaagatcggggtttgcgttcggcgtttgctttcttgttttgcgttctggtttcctggtgcaggctcccttctccttttaaaggtgccggcctcattgttatgatctggcttttctctttctctgcgtggaagcatttccttctccctgtgtttaaggttggcatgtgtgtgacttatcccaggctgagagttttgtagatgagatgggtcccggtccactaactgaaccctgagaattgaccgtgaccatgaatcacacagcatttctccccgccatgcaaaacccatgagccgtgcccagaagccctcaactgctggggactccctccatcatcatttgttcctccccttttagtgacggctgtgtgtgttcctttcccacattcgttctataggtgaacaaaggaaggctcggaggttttaaataactggtccaagttcattgaactggaatgctgactctctcacatctcaaaactcttcctaccaaaggagaaaaatgaagtctgagaaatattttactctaataagtgaaattttgaatattctgaagataaaagaacctggcactcctaagaagccatgttcaacagctgattcaagagtgctgctaagagttcaaaacatgcaggaggggagtcttcttgagacagagccaggccttcctcaattttgcattctgtgcatcagtgctcattgttgactggggagagaaatgagaagcagcaaagaggaaggaggtggcggaaagcggggaaaggtgtggacagaccttcctggcatcctactttgctatctgtacgctcttcctttctagattttcattatacttttgtcactttaataactgtcttacatataaactttttctttaatttgtgtactttccaaagcaaaaaacttatgaaaacaagacatgagggaaataaagtcatggagggctaaaaagctaatgctgttctgctaacattaggattagcataaggacagcacaaagttttgatgttaacatagaatttgattttgatacagtgaaaaatgctaaaatgtcaactccttttactgataagtaaacagctcttggctaactagggcaacagctgtacccatgagaattatagtactgtccaaaaatatttcaggtgcaaaagcaaaagtcctgattgcagtgtgtaacacactcaggaggctcctgaaatattactaacttcaataatgatgtaactcgacactgtcacccctttctcttcaggagtaagtaactctttattggcaagatctgacttggctagatctttaaagagtactggtagtcattggagacttccttctctatttatcacttaaggttgaccaagtagaagaggcattttgtttactcccttttaattgtgataaatttaaaagaatagcatgtccagaaaaggaaaattcatacttatggtctcctttcctcctggattgggactgaagtttttggagatgtcctgcaaaagctctgtagatctctgttggctacacaaaatggcaaaagccacagctgcagaaattgttgcaaacttttcatttgcttcatcatcaaatgaagatctctactattacttttgagtttggagttaaatgctggtgaccttcatctttatgctgaagctttggtgactgtctataccatctgatctacacaatgtattattacctttgaaatcaactctttttgtcccttgtggaaatgcacctctgctggggtgttttggtgctctatattgtcattaggtaacacccacttgcattaaaagactttgtcagggcccagcgcatagtcagtattccgtgctatcagtgtgtgttcagattctcctcttactggttttcttagactgtactgttttctaagcaaatgcccatgtgtgatttttaagatgtgctggggaaaaataaatcaataccacaaccaaaaaaaaaaaagactttgtctttagaaccaatttcccttccacttctaattactggttccttagcaaatgaatacactaactagccaataatatagatagatagatagatagatagatagatagatagatagatagatgatagatagatagatagatagatagatagatagatagatagatatagatattcattttagcctaggcctggtggctcatacctgtaatctcagcactttaggagaccaaggtgagaggatcacttgaggccaggagtttgagaccagcctgggcaacatagcaagaccctatctctacaaaaaaaaaaaaaaatttatcggggcatggtggcgcacacctatagtcccagctactcagaaggttgaggtgggaggatccctttagccccggaattcgaggttgcagtaagccatgatcaagccactgcacttcagcctgggtgacagagtgagaccctgtctcaagaataaaacaaaatcctcattttagagctagtgtttcatgcctttttcaaggggcatagaaaagtagcaaagagacctaatgtggttcagtgggaagagcacaggccttgcgacccatcaggaagtcaaggtgtagattataatcaaagcaccagctgtactactgcctgttattgatgggaccttcagcaaagtgctcaagttctcgagtcacagtgaaatggtgataataacgaccattacatcaaattcacagggcgaggtgaggatggtgtttgtgaaaatctttgaaaactgggagctactaaggttatttccagattccattgccttttttcagaaaacaactttattgagataaaattcacataccatacatttcacccatttcaaatgtacaattcggtggtgttggtatattcacagatctgtgcagccatcagcacagtcaattttagaaaaatcacctcataaagaaacccataccctttagctgtcatctccctggccccttccattgcctgtttaattttgattttgtgtttatttatagagactttctgataatttttaaaattaagttaagtaaaaataagattacttgtggatgacattaaaatactgtttcctatgaaaagtgtctctgtagggctttccagttaatgatctaaatgcattggcaggatgagggatgatgagctaagtgttaataaatgacactgctaggaagattacaattcaaatctatttctattttgagaagcagaaaagatggatgagtactcactgttactgttgaagtcacggtaccatgaaagccgctcattaaaccaggatgggtctctgggaaggcagggagagggaagagcgcgctgatgagcggaggctggatgggagctgcccccaggagtggatcttcctagcccaggaattccacaccaccaggaaactgctggactgttccttacctgaacttcctaagcccatgaattgggcttcatgcagcagaactagggaggaaaggataggaagaaggaagggaggaaggaaaggaaggaaggagaaaggagcccctccaggaacacctttattttgtgcacagcccaaagcaggagtgttgaagcagggtgaaaatctgtgtgtgcagtgttggctgtaggaaagggaactcacccttggcctcctttttgttgcaggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattagggggtgattcttaaaggacattaggattggtgctcagaaatggttaatcatgctgtgtgctagccagggccagctggtaccttctttgccatgagcattcaagggacggctaacctttattgacaatctatatcgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgagttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgtggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttt

SEQ ID NO: 38201 - DNA, 154283 bp, Homo sapiens; identical to SEQ ID NO: 38200

SEQ ID NO: 38202 - DNA, 154283 bp, Homo sapiens; identical to SEQ ID NO: 38200

SEQ ID NO: 38203 - DNA, 14466 bp, Homo sapiens
atcatacacgtctaagggcagagtgaacttccatcctgaaggctccgcgcttagttttcgcagattaatagctcaccaagaatttatcatcttttctttccactaactcgaaaccaatctaaattctttccaaacatcttctcaacgtagtctcctttgatgaaatttactgtttcggattctagacttggctcttaccaacttaactttcggttaatagcttaatacctctgattcaggtttttgcatttgtcaactaccattgaatgataatttcaatgagttcgttcttatgaggatcaaatgaaataacatctgtgaaaacctcttacaaagtttaagcaaatagtgctaagcaatcaccaagcgttaactactaattttcagtgttaggtaaattttaaaagctttccggagaattggcgtcctgcacaccagtctcgttccaaaataatgcaggcgggggctggggtgggggcgctcctctcggactgaggctatgtctttcgctccttttgtcttttccaggcattagaactgtcatggcgccttcaagaagaggtaggaggccctctctgcgtccagcagaaccatctggggcacctggaccgggcggtggggtggacagagagacgagccccagctgggaccgaaaacatcgacccctccgagaggtctcggccggaccggcgcaaggggaggagagcgggtggaagcccaccccagcgaacgcccgagggccgggccccgcccacccagaacgtcacccaatggaaacctgccggcggtgcggcaccgcccatcgttggtccgggcgccgcgagggcggggcccgcagttcggttgcgctgcggagcgcagctgtgagggagtcgctgtgatccggggccccggaacccgagctggagctgaagcgcaggctgcggggcgcggagtcgggaggtgagcgcccagggaaaagagggcccgggagggaggggttcgcgagaggacggaaggatcggcctccgaggcccgggacggtgggacccgccagtcgggtgctgaaggcggccctgctcactcagtagcccaggcccgatcgggccctgcctgctggagccgaggggccgcttcggccccgcagtcgctgcttagccctccctggcgtctctggcttggcggcggcgccccgggattctgcgggcgcgggtcgggaggccctggcgttcgcttggaactccggctgcgagaggcggggcccggcgggtgggggcgggggcgggggcggcggtcgcggcccggcggcctgcggaagctcggcggcctggcctggcctgctcgcggggaggtgcgcagactgcgcgggggcgtggcctgcgcccctgactgcgctgtcggtccggcctttgatgaggtggccgccgctggctccctgggccccagcctggttcccgcgcgggccgcggctgccttccagacgcagggcatgcgacctgttggagtgtgaaattctaggggccgggttcctccccagagcggttttatttccgactggactgtgctgcgggtctcagaggccctctggtccgttcagggtgaggacagctgagaggcctgggcccgtgagctcttgcagaggagttgacacgcagaggggctgctgtccaataaacgaaagtgtcggggaaaaactttgcagggcgatctgcattactccaaagtgaacacactgcatgtctcagggtggctggaggcggcgagaatccccttatgggagtatatgagcttttccatgtgttatctctttaaaacctctcagcggctccgagacaaaactcccagtgtcgcagaggtttcttcatcaataggagtagtgctggagaatcttgggcactgccctcattttgcctgcgaaggaaaaattaggaagggataaaaagtcacaaaaattaggaaggtgggggggataagcaaattccaagggcatctatctctgatgaagggttggtgtctcctgtggtgccctactgtggattagttatttgtgtcctcggtccagaagtttctctggagcccattggctacagctttcctgtattagaattctactgttatttcctactgtagtctggctgggaattttatttagttgttcagattttagatgcattcagtgaatgcagctgctcaaggaagtaactaatagtgtcttaccattttcttagctacttttcagaagaaggaacatgatctctaacagaagttttctggtagattactaaaacaggcagatagtagctttcctggctggctgagttaaatccctctccagcgatcctcccacttcagcctcctaagtagctgggattacaggcatgagccagcgcgcctggcaaatctctctagaataagtcaggatctagaaaataacatagggaaagaatatcttgccagatttcctctgtactgcctattgctctttggtatttactagactgtcttctaataaaaatctcctgagttgagttaaacgtagtgtagattgggggcagagatgggcacaaatgggcatcagagagttctaaaaataaatgtgggcttttcaaaagattggtgtgttgactggagacttctgaacttagaggagcacatttagtttccagggtatcagtttctttttcttttctttctttttttctttttttttttttttttgagtcatagtctcactctgtcacccaggctggagtgcagtggcgccatctgggctcactgcaacctccgcctcctgagttcaagtgattctcgtgcttcagcctcttgaataagctggaattatagacgtgcgccaccacaccctgctaatttttgtatatttttgtatttttttgttgcccaggctggtctcgaactcttgagctcaagcaatctgcctgccaccatctcccaaagtgctgggattacaggcgtgggccagcttgcctggcccagggtatctctttcatactgtagagaactctcttgagctgagcacacacaggttccaactccttcacagtctttattcttagagatatgaaataacattaagtggttgtcttgtgactttttgtacaagttaatggcatttagctctcaataattctttttcttcaagtacccatgaccctgaaaatgttatgctgtataatactttttcctataaaagttgtaccttgagttatttatacttgtaagaaataacctaggctgggtgtggtggctcacgcctgtaatcccagcactttgggaggctgaggcgggcggatcatgaagtcaggagattgaaaccatcctggctaacacggtgaaaccccatctctactaaaaatacaaaaaattagctgggtgtggtggcacgtgcccgtagtcccagctactcgggaggctgaggcaggagaatcgcttgaacctgggaggcggaggttgcagtgagccgagattgcaccacggcactccagcctgggtgacagagtgagactccatcccctctgccaaaaaataaataacctatatcagatctagtcccccagagaatggaaacttcagagcctttgagcaatgtgaatgaaatgaaagctggaagcttaaagtcttagctctggcttgaatttgtggctgcttgaatgtgggcatttattttgtttgttattgtatctcaaggacttagcccagtgcttggcccacaataaatgcttaataaaacatctgttaaatgagtgaatgaaaaaaaaaatgttgttaaccaatacccatttgtcacactcacatcacaggaaaggtgaggtcatcagggatgaagtcactaacaactgccagtcatgtgccccaagggtagcctcaccatggactagtgggcttgttctgtgtagagaagggatggatagtgaatgccaaggttagttctagctggataaattagccaagggtttcagctggataagttggctgagggtgctacaggtctagccttaaggctgtctcactgaaacattttggagtctggagtcatctgttctgaatagcgcccacatagtttatatttttttattttttgagacagagtctcactctgttgcccaagctggagtgcagtggcacgatctcagctcactgcaacctctgcctcccgggttcaagtgattctcctgcctcagcctcctgagtagctgggactacaggtgcgtgccaccacacccagctaatttttttatttttagtagagacagggttttgccatgttggtcaggctggtctcgaactcctgacctcaggtaatccacctacctcggcctcccaaagtgttgggattaaaggcgtgagccactgtgcccgtccacacatagcttaattcttgagcacagtaaaaatagggtgtacttggggattcaaagggaagcctattggatgagtatttgccaagaaggaatggagcacctgattttgctggtgatttgaaccttactctaagtgggattagactgccataaatcttgtgtttgtcattcctgggagggtcatcttcaactaagatagctccccttttctagactagagttaggagaatagttaatgtttcagtatttaggactgattctgattttggatttaaaggaaacaaaggtggtgtgtgttttctatttttaatttttaaaagttttgtgtagagactggggtctttttatgttgtccaggctggtctcaaatgcctggcctgttttattttcttttgaatttgcagataagtattaggattattaaatctttttttttgtttgtttgttttttgttgagacagggtctccctctgttgcctagccaatggcatgatcatagctcactgcagcctcaaactcctgggcaatcaagtgattctcccatcagcctctcgggtagctgggactatagctgtgtaccaccttgccctgctaatttttaaatttttttgtaaagatggggtctcactttgttgcccaggctggtctcaaacacctggcctcaaatgaacctcttgcctcggcttctcaaagtgctgggattacagaggtgagccactgtgctcagctggattactaaatttttttttgagatggggtcttgctctgtcacccaggctggagtgcagtggcgtgatctcagctcactgcaacctccacctccctggttcaaaaaaattctcctgccttagtctcctgagtagctaggactacaggcacgcgtcaccacacccagctaattttgtatttttagtagagatggggtttcaccatgttgatcaggctggtcttgaactcctgacctcaggtgatctgcccacctcagcctcccaaagtgctgggattacaggcatgagccaccacgtccagcctggattactaaatctttacagatgtatcctgactttctctgccttttccctctgtatttgccccaaccagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtaaggttatggtacagttactcttgggtgagtgaattctggaaaggtgagaactggaagagcaaagtcttaaaagaggccaaccaaacttcaataggttgggggctaggaggagatgatcatatggagtgttaaaatggaggatttgtgagataagtttaattctctttcatatgaatttcttctcaggtgaatcaacggaatgtaccaggtattgacagtgcatacctggccatggatacagaggaaggtgtagaggttgtgtggaatgaggtacagttctctgaacgcaagaactacaagctgcaggaggtaggtgatgctgaaaaggtgaagcctggggaatgttggaacactgatgttagagaggaattggtgttgggaagctgcccgtgaggagagtatgttggggttagatcgtttctggggagggatagggaatggcttctcaggattattacagtgatttgtgactctgttattccactgtctcccttgctttcaggaaaaggttcgtgctgtgtttgataatctgattcaattggagcatcttaacattgttaagtttcacaaatattgggctgacattaaagagaacaaggccagggtaagaattttttccccatatttcctgaacttattgcaaagagactagctacatttattattgttccttttacactcagagattaaaacaaggtagttttgaaacagaactggaatcagctgcaatggcgataagagtagggcttcagttgtcacctatgccttttgtgtggctatagattgggcagaaaatgagtgaacttttgcttctttcttcccataactttcattgcttgttttcattgccctatttagtctaagtaagtaaagctaagaacaaaaggagagaaattttaacaaaccttcaaatttaaaatatgttaacaagggaagggatcatttctactataaggccttttagtaagtgctttgcctccccaggtcatttttatcacagaatacatgtcatctgggagtctgaagcaatttctgaagaagaccaaaaagaaccacaagacgatgaatgaaaaggtatagaaggagagcagacaaagtttgaggctggtttttgggggtggttttaaaaaggactctgttaataatgaagctgatcaggaagggacggaaggagctagtgggagagagttaagagagggaattactgctgacccttggatccaactttgttccaggcatggaagcgttggtgcacacaaatcctctctgccctaaggtaagtagtacctggttagtttcttacccatatttcctgatgtagttactccaaacagatttcagggcactactcttctgttctattctgcctctccccactttctttgaatcatatactgtcaagattagggcccctacgggtcttttaaagggtgcgtcctaatgccctaaccacgacacttatctcctacctctttctcctagtgcttatccagctatttaaatcatcaggcataatggagattcagagtgtggggattatctttatggtgaccagcaggagacctggcccttgctcctcttaacccttgggttccccctgcccttaatttcccagtggcccctctaacagcccagtgcccccacagctacctgcactcctgtgacccccccatcatccatgggaacctgacctgtgacaccatcttcatccagcacaacggactcatcaagattggctctggtgaggggagggagaggttctgggcaggggagcctcgggaatttgggaaccatgggggtaagatgaaaggaatgggggataacagagcaaaattctgaggtgtgggctggtgagaagagaaaggaccttgctaggagtaattaataggagaggccagttaattagtggagagggggtaggatatataatcttacacctttttgaagggaaaattggggttaatacagagatactgataagaggctgggaaagggcaagagataggtttgaggtttgatttgagtcctggggccagaccctgccagaggaggttccaggctgttcctgctgtgagtgctttcgtttgctgtgtattgtatgcagtgtacaacatttctgtgtgctgtgtctgtgtggtatttgtgtgtccatttgtctggggcttggctgctccatcgctcacaacttttctctgttttcctccctcccgcttacgggctgctctgttcccaacagtctttcataggatttttgctaatggtgagagctccctctgccccacttggggctctgtttgtgctccctctgctcccttggcggctgcccagtgcatgcagtcgtgggagcaaaccctcttcccctatcttccctgcctaattatgcctgcttagcttctgccctgccagccctccgcctgcttgccccttcataacctgcttgtttcctgtggattctgcctggctggccacttacctcctggattcatgttctccctcatcatcaggctagttcccagatcatactgtgctcccagattctctgtgacttgtagtcattgtttatgatctgagtgagtccaaattgggcctggtcctggttcctcgttcagctctgtggcagacagtgttgaggaataagggggtagaacaggagtctaaaatgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaagcagtaggcctaagaaaggggaggtaggtggcatccatgtgtggtctgtagttcaggacaggaaagggaatatgtttgtgcctgttgagggtcatcagaaaggagacttcaggagagaatttggcttttggggcctctctctggagtgagactattcttcattgatgatggtcagattgtgggtgtctcccctactcccagtggctcctgacactatcaacaatcatgtgaagacttgtcgagaagagcagaagaatctacacttctttgcaccagagtatggaggtgagccttcctgctttctctgccctgtcctcatccccctgcttttgcaccttataacttgaggtacagaggcaatataactgaaacttctaggccttctctaccagcatacaaaatatttttcttttcttttttttttttcctaaggcattcctgccaaccctagcccccaatcctctgattaaccaaagccttctctgttttccctagaagtcactaatgtgacaacagcagtggacatctactcctttggcatgtgtgcactggaggtgaggggactggaggggaggggggaaaggggtcagatgagaagatggaattgggaatggagggaagacaagtaaggcgctggcttggagggagtgattgtgggagcactgaagttcttaggtgtctacttttttttttattcttcctcactgaagatggcagtgctggagattcagggcaatggagagtcctcatatgtgccacaggaagccatcagcagtgccatccagcttctagaagacccattacagagggtaaggatcttcaggatcactccctcctcaactgaccttcaaatgtcttctggtttttcttcctttgtacccactgggtatatgctcctaagagctagggaacataacagaaaggacacgaaaaatctataaacattttcttaggaggtgcctaccatgtttttgcatagaaacacacaggtaagggggttaagatggatgatgctggggttaaaagttgtgtgttggaagccgggcatggtggctcacgcctgtaatcccagcactttgggaggccgaggcgggcggatcacgaggtcaggggatcgagaccatcctggctaacatggtgaaaccctgtctctactaaaaatacaaaaaaaattagccaggcttggtggcgggagcctgtagtcccagctactcaggaggctgaggcaggagaatggcatgaacccgggaggcaaagcttgcagtgagctgagatcgcgccactgcactccagcctgggcgacacaggtagactccgtctcagaaaaaaagaaaaaaaaaaaagttgtgtgttggctgggtgcagtggctcacacctgtaatcccagcactttgagaggctgaggcgggtggatcacttgaggtcaggagtttgagaccagcctggccaacatggtgaaaccctgtctctactaaaaatacaaaaattagctgggcatggtggtgtgtgcctgtagtctcacctactcgggaggctgaggcaagcttgaacccgggaggcggagattgcagtgagctgagattgggccactgcactccagctggggcaagagagcgagactgtctcaaaaaaaaaaaaaaagtatgttaatttgaatgtgtctacatggaggtaaattaatttgatggttacttcaggccattgctgtatactctcagacagccatttttatatttttaagcacatcagtcaatttaaattaaaccagttgtttgggattttatatttatacagttttagttagggacggtggcctgaaataatgagctaagatttaaaagacataaggttatgaatcagttgatagactatagtaagcagagcctgggcaggaaggtccaaacaagaacagtttgtaactcattagataagtatagtagggaacaggagagaaaagaagactagtgggaagtcaggaggatagtgtggagtaagtttctacttcaacattgaggtggagtattcaagtgaaagattaggtatgtgaccttgttagccttcaaggttaaaagcaggaaagcaggttaattgtcatgggacatgcaggaggtagaaaaggaggcggtggtggaacatggtggctcatacttttaatcccagcacttttggaggctgaggtgggaggatcacttgagctcaggagttcgagactagcctgggcaacgtggtaaaaccctatctctatgaaaaaataaaaattatctgggtatggtggcacatgcctgtggtcccagctactctggaagctgaagtgggaggattgcttgagcccaggaggttgaggcagcagtgagctgtgattgtgccactgtactccagcctggttggcacagcaagaccctgtctcagaaaaaagaaagaaagaaaataaggcagaatcgttagaggaatcctgggaaattcggtgaattcagtgattgtgggcaaaggaaattgtgatactaggcttgtgaaataaaaaaatggtgaatattgatcacattgggtaagtttgggaagagagaagctaaatttggcaagatttagaaaagaagataggcagtgagttgactaataaagcagagaggtagaaactaaggaaaaagaaagtgtggggccgggcgcggtgtctcatgcctgtaataccggcactttgggaggctgaggcgggtggatcacgaggtcaggagattgagaccatcctggctaacatggtgaaaccgtctctactgaaaatacaaaaaattagccgggcatggtggtgggcacctgtagtcccagctactcgggaggctgaggcaggagaatggcgtgaacccggtaggcagaggttgcagtgagctgagattgcgccactgcactccagcctgggcgacagagcgagactccgtctcaaaaaaaaaaaaaaaaaaaattgtgaacattaaaaaagaaagcttgtggttggagagcagaaaaataattaaaaccagaaaggcagtggatggtatctttcatataatatcttacagtttttgaagccctttcaggtgcatttttcaatatattgttttctcagcaagtgctgagcacctactatgtacaaagccttgtgctaagtagaatgagagctataaagatgaacacactgggggcttgccagatgcctgctccagttccttgtttccttttctaggagttcattcaaaagtgcctgcagtctgagcctgctcgcagaccaacagccagagaacttctgttccacccagcattgtttgaagtgccctcgctcaaactccttgcggcccactgcattgtgggacaccaacgtgagtcgtcttggccctatggggaatagtcttccaatctggagccctgtaactatcactggcatgcttgttttcctctttatttccaaagggattcttttttttttttttttttttttttttttttttttttgagacagagtctcactctctctcaggctggagtgcaatggcttgatctcagctcattgcaacctccagctcccaggctcaagcgattcttgtgccttagcctcccgaagagctgggattacaggcatgtgccaccatgcctgggtaatttttgtacttttagtagagatggggtttcgccatgttggccaggctggtcttgaactggcgtcaagtgatctgtccgcctcggcttcccaaagtgctgggattacaggcatgagccactgtgccaggcctccaaagggattctttacccctttgcctgcatgccttctttgacatttaatctgactatcccttcataatatcccactccatcatgccctccagacatgatcccagagaacgctctagaggagatcaccaaaaacatggatactagtgccgtactggctgaaatccctgcaggaccaggaagagaaccagttcagactttgtgagtaactgagagggtctgaaaggggcagattggtcacgaccactcttgaggctctgtaaactgtccattctctgggaatgcttgaatttgctattttgcttgtttctttccttccatctcctttctcttttctcgtccaggtactctcagtcaccagctctggaattagataaattccttgaagatgtcaggtgagagcagagtgagaagcaggctttcttgaggaagcaggcggggttgggtatcctaaggcgttcacagagcccatgtgacctgtcttcatctccctccaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtgggggctgtgtgggtgtggattgtctccatggttgtggtggaagggagagaggacatctcaaataaggctctatcctttagagaaaatgctccctagcagccatgccctatgggctcgaaagacgtctaggtattgggttttttatggacaggtctctagagtgaccctctcttccctccctaggtggtgctgatgcagtgcaacattgagtcggtggaggagggagtcaaacaccacgtaaggctcagggctagggttgcgcagggctagtagccagagggtagggaagaaaagtctcattttctgactgtcctattctccagctgacacttctgctgaagttggaggacaaactgaaccggcacctgagctgtgacctgatgccaagtgagtctctcctttccctcagaggatggagagtctatgagccttatcttttagggacatattcaggggtgggggaggtgacaaggcagtaacacattgactcacatagaatgactatcttagaccctaaagcagtgggtggatctgactgacagtttagccctagtggggctgtctgaagggccccaggtccctcagtcccgtactgtactcaccccctcctgtttctttgtcagatgagaatatccccgagttggcggctgagctggtgcagctgggcttcattagtgaggtgaggtttctgccttcatctgccctggctgcccccatgccttctcttctctcagcccccatcttactgagctcttctcccccaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgct

SEQ ID NO: 38204 - DNA, 24042 bp, Homo sapiens
gagccgggtggatggtactgctgcatccgggtgtctggaggctgtggccgttttgttttcttggctaaaatcgggggagtgaggcgggccggcgcggcgcgacaccgggctccggaaccactgcacgacggggctggacgtaagtgtcgggcggggagtgggggtaagagagtagcggccgcaggctggagaggcctcggagccggggccgtctgacgggctggtgcccacagcacaggctcgttgccgccaccctcccggaagccgcagacccgggctgagccgccgcggacctctcctctcctgggtccggcggcgccaggagaaggcgacggcgtccagaccccgccaagacggagaggggaccgcgccctcccccgggacaccccaggatccctggaaaatcccccgatcccccacttcacagctggacaagccgaagccccgagaaaggagcgtgacccggccagctccctcagcgaggggtgccccggctaaaggtggctcccccatcttccagcggcgtccctcgagacctaaaagtcccagagtttggagggcggggtctggcttgagcgtaccagtcgtcgtgcaaagaaaaatggattcggggtggggccattgggatgaaccgaaaataacacttattgaattgcagttcttcccggggaagaatcaaatgagtgaatttcctaaattgaacttgtcccaaaggcatcttagcattggctgtaatcatatattttaatatttaatttttaaaagagaagttaaaaatgggagacgttgctctattgtagggtgtcatatttttggacaaccataattgctggctacaaagtatcttaaggaagtcaagttcgctgtaggagtttgggtgttgttattcgcaagttatatgtatttcaggctttttcatactctgaaatagagataacatggctgtatctcaggtctctactgctcggcttacaggaatgttttatataatttgtaaagacagcttgggtcggctatatttaaatagcagttggatttttgtaatctgaattactattaaccacgattctgtgcttgcttttggctggaaacacccgttaggatcagagatagggatattaaagtggatgttctttatatagaaatgacaccaaaaggcaggcttgcagaaagaaaaataatgaatgaagtgaaaggaaatgatgtgggtagaggtaagaactgcagtgcagtgtttaatttcttgatttaggtgtgaagaaacacacgttctgtgataaaatatgtaaattagagaaatatttttcatttgaatctgtaattccactcagagccaaagtttatcacttgtctctctactaatgttagtgctcctggactgtaaatatcaaattcatttaataagtttggaatcaaaatgatacaaaagagctcctgtggattagtaatcatatacttggtattaaaagtaccacctaaactaatttaatacctacttagaaataataggatgtgacagattttcaggaggaggtcaaccagtagttaaaattttttcaatatttggagacccacctttgttaatactgcttaaatatatccaaaccatttatttctatttatttattattatttttgagacagagtcttgctctgtcgcccaggctggagtgcagtggcacgatctcggctcactgcaactttcgactcccaggttcaagcgattctcctgcctcagcctcccaagtagctgcgattacagacatgcgccaccacccccggctaatttttgtatttttagtagagatggggtttgccatgttggccaggctggtctcaaactcctgacctcaggtgacccacccacctcagcctcccaaattggtaggattacgggcatgaaccaccacgcccggcccccaaaccattttttacattaaaaaagatactaaatgaatccagatattactttccaaagttataatgtggaaattcatcaaaaactaaatcaaatattctgaagaagtatgtggaaccaaaataaagcatttgtaatttcacttttatctaattattcctgagctattaattatttttcgggcttgaagcaagtaaatggaagtacttatttaattgtttgtttgtttgtttttaagtgacctgaaaaaaatgtctggatttctagagggcttgagatgctcagaatgcattgactggggggaaaagcgcaatactattgcttccattgctgctggtgtactagtaagtgtcattgattatttgggccttattttttggtgcgtttgtgtttatgggttttgaattctgcaggatgttttaaaatatgtactatttattttatctttgaccactttgaccatgttgatattttgttgtttgtggagagttattagttccactttaagagtttatggtttaaaatttgattaacaagtggttgggttgttttaactgcatggtaaaaatggcataataaaacatttgttcattatatggattatatctccttttaatgagtatattaaggtacaaggaagtgtttaagacgcagtcaggtcaaaaccagtcaatagatgtgattgcatttctccataatccagttaactttcttctcagtctcagggaaaaaaaagtgctcgctttggcaacacatacactaagattggaataatacagagaagattagcatggccccttaaaatttttttttaaaaagcaaaaacaaaaaggaaactcattaaaatacattgtgtggaagtaatttacagaataaaattcttatttacacttcagatccctcaagggatctgctattagttttttatgatcatatggtgtcgtaggctctaaagagtaattttttatttttattttttgagatagagttttgctcttgtttttttgttgttgttgtttttgttttttttggttttttttgagacggagtctcagtctgtcgcccaggctggcgtgcagtggcgcaatctcagctcactgcaagctccgcttcccggggttcacgccattctcctgcttcagcctcccgagtagctgggactacaggcgcccgccactgcgcccggctaatttttttgtattttagtagagacggggtttcgccgtggtctcgatctcctgacctcgtgatccgcctgcctcggccttgcaaagtgctggaattacaggtgtgagccaccgcgcctggccttgctcttgttttagtagagacggggtttctccatgttggtcaagctggtcttgaactcccgacctcagatgatctgtctgcctcggcctcccaaagtgttgggattacaggcatgagccaccgcaccaagccattttttcttaagctttaagatttatttattttcgagacagggtctcactctgtctcccaggctggagtacagtggtgaaatcactgctcattgcaacctcgacctcccgggctcaggtgatcctcccacctcagcctccggagtagcctggaccacggatgaaggccaccacaccgggctaatttttgtttttttttttgtttgttttttttgtagagatgaggtctctccatgttgcccaggctggtctcctactcctgggctcaagtgattcactggccttggcctcccaaggtcctgagattacaggctattgcacctggccaaaaagctttgagtttttagtctatgaagaaaatatcttaaatacattgagctgagggtaaaaagaaaggcatatgtactcatgctagccattaaaaatgttattaatcgagtatggatctgtctgtaacctgataaaagtaatttgactagcctaaaattgttactttaaaataattgccagaagatgtcagttgccagagctaactgagtcagggtttggtgtggggataggaaaggaaagggggttacttttaaaatcttctaggctacttgtcagaatttggttaatataattttattgtaaatatctgctcagatgataaaaactgtttttgaagttttggcgttattttgttatacctttgcccttgataatatctagagccaaattcaattagataaattgtaatctggtgtttaaattaaatttaaaatcacacctgaaaccatatttagactgcactggaattcatcaaaagcagaacctcagagctgttatttcacaccaagaagatagctaaaattctgtgaacaatagttgttctccatattaatttgaatgcttttttcttgattttggggaatatttctctggaagtttatcatatatcaacaggacacttctgtcagttggaattggagtcacttttttcctttccccctccatgagataactggtttctagttcaccaaattagattacaaggctttattatgataaaaattaaataatgattgaagtaggcttagagaaaagttatgttaataaatataaattgctctcagatttaagggtacctaatcagttattaggccatgtgcaaattacatgtgggaaaaagctagaacatttttgaaatgtattaaaagggatctcctcacttaaataccttgcttttagccagtgagatacagaattgctatgatttctcattggtatcacctttgttttagttttttacaggctggtggattatcatagatgcagctgttatttatcccaccatgaaagatttcaaccactcataccatgcctgtggtgttatagcaaccatagccttcctaatgtaagtgtcatcgtaattggcattacttacatagcttgccacaaaataaaaatgtttcaaatatagttgcatagatttaaaattctaaatattatcagattaacacactggacatgatttaaaagtcacacagtagagatggacttatacagaaaagcagcagtcctctttattctttttgtgtacctctccactccctcccagcttctctcagctattcttttattttatacccccagggtttatagctttatatttaagtccgaaactgtgtattttgtctaagggataattctttcaacaatatttattaagcttttatattccagactctgctctaggtacaggacatatagtagttagtaaaacaggaaaaatccatgtctttttgtcatttaaaataagtgcaaaggagaaaaaatagagaaaggagatatgtgcaaataagtgcaaaggagaaagggatgtcaataggagggatagaaattaaaaaatttttttttttatagagagggtgtctcattatgttgctcaggttggtctcctgggctcaagtgatcctcccacctcgacctcccaaagtgccaggattacaggtgtgagccaccacacgtggccagaaattttcagcagagtcagagaaggtctcactaagaaggtgactttgagtaaagacttgaagaaagtgaaggagctgaccaggggatggggatatataagagaggttcattccaggcaggtgaaacagcaagtacaaaggctttacggcaaggagaccagtataactgcagtagcaagatcaagggaaagagaaattgatgaggtcaaagaagtggtggagagggacagatggtatagggccttgagaagcattataagaactttactttcagctggatgcagtgactcatgcctgtaattccagcactttgggataccgaggtgggtggatcacttgagctcaggaatttgagaccagcctgggcaacatggtgaaacctcatctctaccaaaatacaaaaattggtagggcatgcctgtggtcccagctgctccggaggctgaggcgggaggattgccagagcctgggaagtcaagtcgatgttacagtgagtcatgattgtgccactgcacttcagtctgggtaacagagcaagaccccatcacaaaaataagaactttactttcattgtaagtgtaatggaagccattggaaggtttcgagcagaggaatgaaatgaccttatattttaataggagcattcctgttgaaaaatttttaaaaccggtaaacaaaatttattgcagtgccaaatagtataagcaccatgactctgtgcttctcaaatttatcaatgtattttgaaaatattcttgtattcttaccagtttctcaaattcataaaatcgtttagtttgcttcatacttgggctgtgactttgttatttagtattgttttttcctatagttttttttttcttctttaattaagacgaggtctcaccttgtttgccaggctggtcttgaactcctgggctcaagcgatccacctgccttggcctctcaaagtgctaggattataggtgtgagccactgtgcccgacctttcctagagtttctgattgtttttttttgttttttgttttttgtttttttttggtggttgttggtagaaagaatgtatattttctttaggattcattttattcttcttgaatgctgcagttctaatttggacagttactatgtggaatgtagtagccttgttcagttttttgtttttcctagagtttctagctgccttttctttgttttcttgcattttctactattatcacatctttatttttttcccaaattctcaattatattctttaatgtattataacttcttttgttttagaaatcaacatcccagaagcccgtatctgtctgtttcattatgaattaatgactgtgtaagcctgctgcagcactgtcaccatgggacttccctcccctgttgatcagggttgaatccactgtttttccagttaccacatcttcttttttttttttttttttttggatacaagaagtatttactttggccgggcatggtggctcacgcctgtaatcccaacactttgggaggccaaggcgggcagaccacctgaggtgaggaatttgagaccagcctggccaacgtggtgaaaccccatctctactaaaaataatttaaaaaggctgggcgcaatggctcacgcctgtaatcccagcactttgggaggccgaggcaggcagatcacgaagtcaggagatcgagaccatcctggctaacacagtgaaaccctgtctctactaaaaatacaaaacattagccggctatagtggcacgtgactgtggtcccagctactcgggaggctgaggcaggagaatcgcttgaacccaggaggcggaggttgcagtgagcagagatcatgccactacactccagcctgggcgacagagtgagactctgtctcaaaaactaaaaaataaattagccaggcacggtgttgcgtgcctgtagtcccagctactcgggagcctgaggcacaagaatcacttgaacctgggcagcagaggttgctgtgagccgagatcacaccactgcactccagcctgggcgacagagggagactccgtctcaataaatttaaaagaaaaaagtatttattttagtttgtttatttatttatttttttttttgagatggagttttgctctgtcgcccaggctggagtgcaatggcatgatctctgctcactgcaacctccacctcccaggctcaattgattctcctgcatcagcctccccaagtagctgggattacaggcacacaccaccatgcctggctggtgtttgtattttctgtagagacgggtttcaccatgttggccaggctggtcttgaactcctgacctcaagtgatccacctgtctcggcctcccaaagtgctgggattacaggcgtgagccaccacacccggccgatatgttttcttagaattctcatctctttatctttttattttatgttccaatctgttaaacatttttgcatttcagttctcatgttttaatttctaagggcctttgtttccttaattatgaatgcttcctttagggatcaactctctctgtgggcctttcttttttttcttttcttttcttttcatgttagacgtgtaaggtgctgatgtaagaacaaggtttgagggaggcacatctcaaacatgcacatgaacacccaatcatcgtgcctaagaactacaaaagaatcaggttttccttttaaattaaaaaaaaaatgttttagaagtagggcctcgcttgtcacccaggctggagtgcaaatggtgtgatcataacacactactgtctcaaaatcctgggcttaagcagtcctctggcctcagcctccccagtagctaggactacttgcacataccaccacacccagctattttttaaacagtttttttgtaaagacaggatctcactatgttgcccaggctgttcttgaactcctggtctcaagtgattctcctgccttggcctccgagagtgctgcatgataggtgtgagtcactgtgctctctgcctttattattttaaaaatgtaatataaaatgcattctggccaggcatggtggctcacacttgtaatcccagcactttgggaggccaaagtgggcggatcacttgaggtcaggagttcaagaccagcctggccaacatggtgaaaccctgtctctacaaaaaaatacaaaaatcagccgggcatggtggtgcatgcctgtggtcccagctactgaggaggctgaggtggggaatcacttgaatctgagaggcagagattacagtgagccaagatcacggcactggattccagcccaggagacagagtgagactctgtctcaaaacaaacaaacaaacaaaaaacgcatttagtgagatacataaagtgcacaagtcatatatacatctcaacaaatttttcttatatatacacccatgtaaacagcatctagatcaagatttaaaacatcaccccagaacattctcaatcagcacttccatcacacctgtatagcccccatcctgacctctaccattgtccatcagctttctgtagacctttttttttttcttttgagataggctcttgctctgttgcccaggctggagtgcagtggcatgatctcggttcactgcaacctctgcctcctgaattcaagcaattttcctgcctcagcctcctgagtaactgggattacagacgcccaccactgtgcccagctaatttttgtatttttagtagaggaagggtttcaccatgttggccaggctggtctcgaactcctgacctctcaggtgatccacctgccttggcctcccaaagtgctgggatgacaagcgtgagccaccatgcccggccttctgtagacttttaatttaggttgtagagtcatctcatacaggcttccaggtaatccaagttgaaaattacacacatttttaaattttgctacagttacttaagtgtaaacacagtaacttgtattttcagagtaaagcaagtggctaagggcagccagtttgactgtgcctggcatggagtcagtgccagagtagttattcattcgcagaagtaaaggtctgacttcagaagccactgatagcaaagggctgtggtctttttctttgaagttcagccagtatgcagctatttctagttctttccatcttgttgcaatttattttaccgtaataatgatgctgttagaattcttttagaaagctgacacctaaatttcaacattggtttagatttaaaagttttatttttgtgattgtatttttgtcctgcttttgttctcagatctttaaaaaattattttgttccattttgaagcagtagcaagtctgactatggaggggaattatagctgtatatgagcttgaatgtactattcaaacgtgtttcctgctaaacttacattctgttgcattaacataattatagcagagctgacttcatgtctttataaatgtttatcatctatttggcttcagtttacatctttttattatagtgtcagatagtgtcaggccataattttaaacaaaaactgttagttaattataattcaaatggataggagtcaaaaagcagctattctttcattaatgactttattattttttctcttattacaaaagttctctgattttgtggctttaaaaatattaataaatgttctgtgtattactctgtattttttaattttaaaaatgtagggtaggccgggcacggtggctcacgcctgtaatcccagcactttgggaggccgaggtggaaggatctcgaggtcaggagatcgagaccatcctggccaacatgatgaagccccgtctctactaaaatacaaaaaattagctgggtgtggtgacacgcgcctgtggtcctagctactcaggaggctgaggcaggggaatcgcttgaacccgggaggtggaggttgcagtgagctgagattgtgccactgcactccagcctggcgatagagcaagactccatctcaaaaaaaaaaaaaagtaggatatgccaataagcaaaaacgaagttgcctataatctcaccaaactataacattttgacagatattctaccagtgttctcttctgttttctctttctctaacacacatctatatgttttaaaagtaatatttaactcttctccacttcctttcctcttcctggaaaaattcagtccaaaaactattaggtgaggtcaagcatgagaggcatcctctatagaaagacaagttgtggtggcccagagcaggctgctgggctcaggcagggtgggaaggggcagctcagcatgggctcagatcctgagcagggtgaggaggggatccatgcagcggagcgtgggatggaagaaggcagccctacatgggatgctggagtctgagcagggtgaagaggctgtccagatggggcaggagaagcagtgtggcagctctgtccgctaagagtgcccagaacagctacaccccaacaccaggagcacacctatagcccccagttatggagcatcatgttgacaaataccagacgtttcagtaaaaagattatttaactagtaacttttctataaattggagaacatacataaaaataatcatagcagagaacaaatagagattgttcattccaaagtgtccctaatagtgaagacaggattgtggtggctcacagagggctctgaagtttattcagatggctcagcaaggaaaacgagctgagaaccagtaacccaagaacatttatttgtgttttacttttatatatgaaacctgtttttaatgtatctattttatatacaaaataatttagtactgtacagagatcactgaaaataattgagtattttgatcattctgaaacttagatttgtatgaataaattaagacatcatattactgtgaaaaaaactaggattcctatattcacttttttttttcatagatacaaggtcttactatgttgcccaggctggtctcaaagtcccgggcttaagcaatcctcctaccttggccttccaaagtgctgagattactggcacaagctaccaggcctgacctaaacacatttattgagcacctactatgtgcgaagcccctagccttgtgctaggcattgagaatgaaaatgagaaacaagacagacaatggctcctgtcctcatgaagcttatattctagtgttagacacacacaactaaatgggtatatatatcataggtataatgttttgtaactttaacttgatgtattgtgaacgttttcccatgacatttggaatgtttcaaaggatacttctaaagaaagcaagcctatctcaatttagagtggtatgctatgaagagttagtaaaacaccttatgtttagagcctgtatcaaggatttaaaaaacaagattttaccacttgaatctctattcgataatatcttcagagcaaaaagttattgtattgtttgaaatataattatttctccaaacatttgatatcagtacaaaattactacaaaaaaatttattccaaagccaattttaagaaatatttggattatccagggcccattttctccctctgccattgccatacatgagtacatgttatgtctgatacatacaaatggaatatcagatagaaccaagcaaaattatctttttacctgttccaatcttagcaaaagaaaattttgagaattttgttcccgattttttttttaagagacggagtttcactcttgtcgcccaggctgaatcgcagtggcacgatctgagctcaccacaacctgtttcccgggttcaagcaattctcctgcctcagcctcccaagtagctaggattacaggcatgtgccaccatgcccagctaattttgtatttttagtagagacggggtttctctgtgttggtcaggctggtcttgaactcctcacctcaggtgatccgcccaccttggcctcccaaagtgctgggattataggcatgaaccaccacgcccagcctcgttcccaaattttaacaatcgagactcacctgaaagacttgttaaaactcagatttctgggccccatgcccagagtgtctgctttgctaggtttgggttagggccaagagaattttcttgtcaaataggttgccaagtaatgctgattccgctagcctggggcccatgaccactgctctagagagtatctggctgggcgcagtggctcacacctgtaatcccagcactttgggaggccgaggcgggcggatcacaaggtcaggagttcgagaccatcctggctaacacggtgaaaccccatctctactaaaaatacaaaaaaaattagccgggcataggtggtgcatgcctgtagtcccaactactcgggaggctgaggcaggagaatggcgtaaaacctgggaggcagaggttgcagtgagccgagatcgtgccactacactatagcctgggagacagagcgagactccgtctcaaaaaaaaaaaaaaaaaaggagtatctggttgaagagaccagtcatatgaactctttactcaagaactgaaggcttatgagccaggtgtagtggcactttgggaggtcaaggcaaggaggatctcttgaggccaggagtttgagaccagcctgagcaacatagcaagactttgtctctacaaaaatttttaaaaattagctgggtgtggtggtgcacacctgtaatcccagctactcaggaggctgaagtgggaggatcacttgagcctgggatttcaaggctgcagtaagccatggttgtgccactgcattctagcttgagcaacagagtgagaccctgtatctttaaaaaaaaaaaaaagactttcaggcctaaccttacatttgagaaactgtagattattgtttctggtaattggtgtcatggaccctgatttcttggttttattttattcatacaggattaatgcagtatcgaatggacaagtccgaggtgatagttacagtgaaggttgtctgggtcaaacaggtaaataggtgcaaacagcatcttattatacatgcttaaatccttaagatgagtatttcacatggaaataccacttttctatttgttttaatatatctgtgagtaacagcttattattttgaatctattgttttatgttttgggcttgaaattgggaattaatatataacattctatttgccgtgctttattgagtgtaggcagtgtttttattaaaatgtatttatgcaaattaaagaggccctatcagaattcattttaggcagtcatgactccatttatttatagcaaatcttcataaacatgttaatgtgatttgaaagttgcctgtcctcctctgttaacataattttaatgcaaccttcctaagttctagtcacagtaaatttgaatttattttgctgcctaacttccctgaaagtgaaatatggtagcttggagattcgtatgtcactgaatatgaattttttactgtatgtctgtgttactgtttgaaagtactcttggaagatctgggagcggccgggcacagtggctcacggctgtaatcccagcactttgagaggccaaggcaggcagatcacaaggtcaggagatcgagatcatcctggctaacacagtgaaaccccgtctctactaaaaatacaaaaaatcagctgggcgtggtggcgggtgcctgtagtcccagctactctggaggctgaggcaggggaatggcatgaacctgggcgggtggagcttgcagtgagccgagattgcgccactgcactccagcctaggagacagagcaagactctgcctcaaaaaaaaaaaaaaaaaaaatgtgggatcattgtctatataaaagcataaggagaatgagcctctaaatatggtgaaacagattttatgagatgttttataggaaggttgagtataggttttctcagtgtaggcagttggggaaagtaagtatatgcacttatacagactcataaataatttttaaaaatctatacagaccaaccaagaagaaaaaggccaacaggtacactgatgaagatgtttaacacatcctttactgttctcacgttagactttaatggcagttgcactttttttttttctgtttgggttttattttctttttgaaagttaattgtactgccctataagaaagaattctggtaaaatattatttctttgaaggtgctcgcatttggcttttcgttggtttcatgttggcctttggatctctgattgcatctatgtggattctttttggaggttatgttgctaaaggtaagagaaaacataggttacaatttacttcagtggaatactggaattttgcattaaagttggttattttagaataaaatttttttcctatagttgggccaactactagcgatgcatttatatccgggaccccccaccctccaccgacagtgtttggttttctttgtcttatatatttttagtattcctttcttcagtcatttttcttcttatccagagcctggaagggatgagacagctctaaacactgcttttctttggcttccaaaaatctcaaaagcagaacatatgttatctagctagttagcaagctttgtttcttttttagagacaagagtctcactatcacccaggctggagtgcaatggcatgatcatggcccactgcagcctcaacctcctgggctcaagccatcctcacacctcagcttcccaggtagctagggccacaagcacacacaaccacacccagctaatttttaaattttttatagagatggatcttgctatgttgctaaggctggccttgaactcctggcctcaagcctggcctaacaagttctgactttcagaatatctgtgcaaagctctaacatcccagaattgagatttattcagttaagcctccctggtaatatgatgtcacctcctttcagacagaaaagtaaactaacatttaatatacatctgctatataaggccactttaaggcaagctcaggaaaaggtatactgttagaccctgggagaaatttcaccttgagggaccctagaaaaacagaaaacccatttaatggtccaggtaaaattgctatgggtgtcatagtaaaaatacagtattaatgatttataaaaactggaccaggttatatatattctgctcatattttaacacttatttgaataaaatgtaacttgtagattaaaataatgtttcctaaatttttattaaaatcatttaatctcatagatgggagtaatagatatttccaaatatttgtatttttaattttattttaattattttttttattttttgagacagggtctgctctgtcacccaggctggaatgcagtggcacaatctcagcttactgcaacctccacctcccaggctcaagcaatcctcccactcagcctcctgagtagctgagatgacgggcgcatgccaccacgccctgctagttttgtattttttgtagagatggggcttcaccatgttgcccaggctggtctcaaactcctgggctcaagtgatctgcctgcctcagcttcccaaagtgctgggattacaggtgtgaaccactaggcctagccatgtgtaatttattattaaaatcatgttaccaaaattgtagaaaataaaaaagggtgggtgcagtgtaatcccagcacttcaggaggccaaggagggagtactgcatgaggccaggattttgagaccagcttggacaacatagggagacaccatctctacaaataataaatatttagccgactatggtgacgtgcatgtgtggtcccagctactcgggagactgacgtgagaggatcacctgagcccgggaggcagagattgcagtgagctgtgattgtgccactgtactccagcctgggtgacaaagtgagacgctgtctcaaaaaaagagaaaagaaaagaaaaaaagaaaaagaagtaataataatttcaccactcttcaatattttggtttatttccttttttcttatgtttttagttattatcataatttttatcccccgtttgcatttcacatgatattataagttagttgttcttttgctgctataaaatctgttttttatatgtatatttgttgcccaggctggagtgcagtgatgcgatctcagctcactgcaacctccgtctcccaggttcaagcaattcttctgcctcagcctcccaagtagctgggattacaggcgcctgccgccatgtccagctaatttttgtatttttagtagagacagggttctgccatgttggccaggctggtcttgaactcctgacttcaggtgatccacctgccttggcttcccaaagtgctgggattacaggagtgagccaccacgcccagccatctatatattttaaaatgtatatattttgagtttgagaccagtctggctaacatggcaaaaccccatctctactagaaatacaaaaattagccaggcatggtggcacacacctccaatcccagctacttgggaggctgaggcacgagatctcttgaacctgggaggtggaggttgcagtgagctgcgatcacgccactgcactgcagcctgggtaacagtgggagaccctctcaaaaatcaaaacaaaaaaaaaggaaaaaaattaccttgttatcatgggaattgcataatgcttattcattatagaaaactaagaatataaaagaactcaaaagaagaaaatgaaattactgataattctttcccagatacaactattaatacagggtccctttttataggaatgtctttatctcataattttaggctattttcctgaaagcttctggagcaaggttatgttttgagaattattagcagcagatctgtaattttataaagttggctttataacatttttagaagccattctagtggtaatggttatttaacgtgaaatagtggtgaagacctatgcaaaccatctgttatgttaatcagattaaccaaagctgttctgaaatgagaaaaatttgacagttcacctatttattgtgcctctgtcaatgagcagtcattaacaattccagtagtagaaatttatgagaatttcaacttcacttctagatacaatcagaaaaaaatgttgctccagcagtccttccaatcttagttaatggctggctactctatctttccaggtgtttaggccaaaagccctagatggtgaaggcctgtcaaagatgacatttgtcttcctcccacgccccatatccaatctatctgcagatcatgttgactgtgctgtaaaatatatcctgagtctaaccaccatttaccatctctccattgctaccaccctggttcaatccatcataatctctcacctgatttcctggaagagcctcctaactggtttctgtttcctctcttgcctcctttaatctaccctcagcacagcagccagagggatcctcttaaaatatgtcatctcagatcacttttctgctcacaacccagtggcttctcgtctcactcagagtaaaaatcagagtcctcactgtgactgccaggtctctgctgcccagttgccctctttctttaccctgtccctgctcttccctcttgtgcctacgtggctgttcctgtaattcactggcgtgctccctcagggcgtgtgcatggcttcttccccacttcctgcgtgtccttactccagtgtcaccttctcatggggtcttcctggccatctgtgtccaatgtcacactacacttctccacctttcctgcattattttatcttctttttattcagtatattctctagttccatgagggcaaaaaaaattttacctgttttgtttattgcagtatcctcagtattaaatagggccagcatacagtatgcccccagtaaatatttgttaagtgaactaagggagctatcatttactaaagccatgctagactctgttacacattatgtcttttaatactcaagccaaccctaattctaagaaaaatcaattcttctaggcaggaaaactggtatttgccaatatatctgaaactaaatgttttgagatcataaccctctaaacactgcaattatttttacagaaaaagacatagtataccctggaattgctgtatttttccagaatgccttcatcttttttgggtaagtttgttttgcattctttatgtttgtttgtttttttttaaaatagcttcttttatatcattttctatatttagttgcctaattactcatccaatgcccctcccccatgatattttcataaaacatggagagtaaggttgagaaggatattttaaatagatgagttggtttgctgccaaccttaggagcatatattaatttttaagattgctaccacgcccccttttaatgagtgagtaactatgattcatgaaaatttagttacataacactggtgatgttcattttaaacttagatctctaacagttgctttaagtgaaagcctgcctaaaaccatttatccttaaattttggtttctgatatattttataattcttctgtccttgatatcgtagagtttgtgagtgagatttgaggtgtggaggaaaagcccaaacatttttttatccttccctttcaattacaaatgaaaagatgacgaaaacctctaaaaacctcaaggcttttatcagtaatcttctctgatgttcatctttcctagaaatttagggcctgcccttttctctacccatgctgttcctccaaccagcccccacaacctacccccatcactggccgaaaaaccccacaaacaaaacagctcaacagctcttaatcctctgcatcaggagtgtgtgtgtgtgtgtgtgtgtgtgtgtgtgtgttgtgtgtgtgtgtgttgttttgagacagagtctcagtctctcacccagtgtgtgtgtgtgtgtgtgtgtgtgtgtgtgtgtgtgtgttgttttgagacagagtctcagtctctcacccaggctggagtgcagtggcacgatctcagctcactgcaacctccgcctcccgggttcaagtgattctcctgcctcagcctcccgtgtagctgggactacaggcacacgccaccacgcctggctattttttttgtatttttagtagagacggggtttcaccatgttgtccaggatggtcttgattcctgatctcgtgatctgcctgcctcagcctcccaaagtgctgggattacaggcatgagccaccacacccagcctgcatcaggagttcttttttttttttttttagagggagtctcactctgtcgcccaggctggaatgcagtggcgtgatcttggctccctgcaaactctgcctcccaggttcaagtgattctcctgcctcagcctcccgagtagctgggattacaggcacctgccagcacgcccagctaattttttgtatttttagtagagacagggtttcaccatgttagccaggatggtcttgatctcctgacctcgtgacccacccgcctcggcctcccaaagtgctgggattacgggcatgagccaccgtgcctggccaagagttcttaacctttattctttcagtagtcttctgaaggtgaggtatcaccagacatttccatatgcaggaaattggtgttttgtgtatttctggaaagagatagtctgtggctttcatcagattttcaaagaagcccctaatccaaaaaaggctaggaatctgatgtatattacaggacctttccttccccttcccttcccacccacctccaaaaaagaaacaaaaatcccatgtttactgaagccctcttgaaatagtaatagttgcccttcagaaagagccaccagttggtattcacacctattctattccatcaccaggcatttttgccattttgtaaaatcagtttggaaataaaaatgtaaacttagatgtgacaagatgcacagcctctttgggttataccttgtatcctgtaagcagattgaaccccaggtaattttgacagtgtaggagggactggtccctggctcttgcccaggaaactcttccgattagagttcatatcttgtgacgagtattctgaagttacagcatctcttttaagctatttggacagtagaggcctctaataaccaacttcagtttttctttgttacagcagtagatcctatattaactagaagagcagagatctgggattacaggcgcatgccaccatgcctgactaatttttgtattttttgtagagacggggttttgccatgttgcccaggctggtctcaaactcctgggctcaagcgatctgcccgccttggcctcccaaagtgctgggattacaggcatgagccactgtgtctggctcatagcccccatttcatttggtgcctgggactgcgcaccagctgccccatagagcatgcaggcaggcatccccatagagcatgcaggcaggcagccccatagagcatgcaggcaggcgtctgcactctggctcatctaaggcacctgtgggtaatttgccacccttggcaattggctttccaaagcctggctgtgtccattccctgcctcctcatggccaaccataatctggccatggtggattcttccttgttctgttaacacctcaggtatcattttatgcatacagttgcgctcttgcctcttttaaattgaagccttaaggacaactgtagacgttccctcaccgaaaccctagaccaggggtgtccaattttttggcttccctgggccatattggaagaattgtcttgaggcactcatagaatacaccaacaatagctgatgagctttaaaaaaaaaaaaaatcacaaaataaatctcataatgttttaagaaagtttacgaatttgtgttgggcctcattcaaagctgtcctgggccacatgtggcccatgctttgtgggttggacaagcttgccctggactgtaagctctgtgagggcaaattcctgtcatactagtctcctgggcttttccagaagccccatgcttttttatgcctctttcccctttgatgtactgtttcctgtccccgaaacacctgccttcatcatcccgctaggtcttgttcctaccaatctcccattcaaacccctgtttttccacaaaagcccatctcacatattaccacctctgtaaatccttttctaacttattcagggtgaccgaattctgtgtttctgtgcccccttaatacttgttatataagtctccttccccaaccacccccacacttaccacatcacgttagcaagaatgagagcaatttgagggcagtggctttgtatcttatttatagccctggcaccaaaacagtttgttgaatgaatttgataaaatcagacgtatagggctgggcacagtggctcacgcctgtaatcccagcactttgggaggccgaggtaggcggatcacgaggtcaggagatcgagaccatcttggctaccatggtgaaaccccatctctactaaaaatacaaaaaattagccgggtatggtggcgggtgcctgtagtcccagctactcaggaggcagaggcaggagaatggcatgaacccgggaggcagagcttgcagtgagccgagatcacgccactgcactccagcctgggcgacagagcaagactctgtctcaaaaaaaaaaaaaaaaatcagacatataatggttacatagtaaacactggtaactttttaaaagtcacatgtgtattcagtacttgaaagttaaggttgttgggaatatggtggttaatagcacagttgaacataatggaagaattcactaccttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactcttaaact

SEQ ID NO: 38205 - DNA, 10105 bp, Homo sapiens
ggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggaggtgagggcgcgagatctgaccagggaaagatttccgtagtgcctgctggctggccggccgtgggatgaaggcaaactttgggggcggggcctaattcctgggtagagttcgggatcctgggtgtggaccccgacgaggtggggatcgtcactcacctgctcccgtttccccagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgagtgagtgcacaccttgggccctgttgcaggccatggagggaatgtggctgggagagtgttgtcatcctgccactgctcttggggacagcacttccagtaggcagcgattccatgggggtagagctggcattggaagtaagaaatgttaccacagatgaataaacttcccaatcctaaaactttcagacctgaggtagcacatgcatatccctggagaggcaaatagcaaacaattaatgcttatttggaggtaaggcagtagaaaactggcaactggataaccttttaaaaggcattcattaatattttttaaatgataataaataccacgaaagccaaccataacatatctgtgggttacaactggccaacaggatgctacatcacagtgttagaggaactgcttttgtttgggagggggcaggtctagttactgtgcctactacaaaccgctatttcccagtggctgctgtggctatcctgtttagaatagaacctttctgtgcagtggttgcaaacaggtctacatgggccacacaggtaaggaatgaataaaggtatttttaaaattgacaaacacaggaatgagaaatatatctcattttcctcttaatcccactataagaaatcaatagtgcaagtatgatataacaagttttagggcaataaaaaggagcagcaggaattgtggcaggctagagagtttgtgtgacattctaacgaggacagctctgccactcagcttctatggattgttgccatgtgggaatagaggcctaatgtggtcagagtcaaatgtttctaaaaattttttgtagaaacaaggtctcactatattgcccaggctggtctcgaactcctgggttcaagcgatcctcctgcctcagcctcccaaagtgttgggattacaggcaagagccaccacacctggcctcatttttcaagagataccagaaatctggaatttaatgtgaaaattggcaaattcaaatatcagcaagtaatttaaaaattttttgagtgctgtgcgggtcaatgttgtgcataccaaatgaagcatgtttatggtttgagtagagctttccggcttcaagtttgccatttttatttgaggcttaaggattggagcagttgaaaagctctgaacatagaattatcaaaagctcctggacaacactaaggaataaggaataagcagtaactccccagcttgccaagactttctctcttgcctcaactctggctcccctaccctttcctgtctactctgctgtcactgtcttccctcagcccgtaattgcctgaaatgtggagcaaatgcttagaattctttctagtgcttattaagttttatgctttctctattactgagagcaaatctcttttgatatttctccaagaaaagaacattaatttaatttgatgtttttatgaaatcctagaacagttgtttttcccatgttcagtgagcttttttggatataagacttctcaccatgatagtagaatcaggacttacctttattcccagagtatacacagggtagtatgcattgttttgcccagcccagcacattcaaggaagatcagtgagctcatttcagctctgatacatgaggcgctttccatggtgtcaggggaagtacatagatgacccagactggtccttgtcctcaagttgcttacagcctagttagggagaaaaggtggtcaggacacgatgctgctgccacctagccatctcccaggagggacctagtaagatgcttggatggtcagaaccgtgactgcacagaggagactgtgcttaaggagggcaggaaaggcttcgtggaggggaggtaagcactggagccggatcatgaaggtaggcagaaagaagttagcaaaggcttgcaaggaaggaagaatcacctgagcagagacccatggggatgcagagatgtccagaggagagtgaggaagaaggggctgagtaggatgagacccagcaagtgggctggctgggggcagcaatgttccagctccatcaactggcccgtctaatagttaagaatacagcctcctcctatcataggtttagcagccagctgtggactttgaaagagggagcagaggtagccccaggacagtgagtggatttgtgtctctatccagtgtggataaatcttggaaggagctcagtaatgtcctctcagggatcttctgcgcctctctcaacttcatcgactccaccaacacagtcactcccactgcctccttcaaacccctgggtctggccaatggtgagataacccctacagccctttccttcttcctcttacctcctgcccaaacctttgcctccttttccctcagtttcctgcttcctcagcctgggctagatcctaagtcccctgtgtgtgcaggcccccaatactgtgccatctctgcatgccttttcccaaggagagaagggagtcctactcccagttgggactgtccagactgtggtgctagaggtggtgtggggagcaggagggtcattcccatctctggaatgtggatcccgaggggtcagagcccaaggcccaccccagacagacctctgtctccctcagacactgaccactactttctgcgctatgctgtgctgccgcgggaggtggtctgcaccgaaaacctcaccccctggaagaagctcttgccctgtagttccaaggtgaggccgcagagcctggcagccgggggcggggggtgtatagagaacctgcgccccatgccaagtgctccatacagggcttctcttatctctttccatctcctccaggcaggcctctctgtgctgctgaaggcagatcgcttgttccacaccagctaccactcccaggcagtgcatatccgccctgtttgcagagtaagtcatggggagtagaggaagctgccatccaggggctcagagaaggtacatgtaaagcatgtggtcagtgtctggctcaggctgagtgagtactgagtggtagatgtgatgacggttattcagggcattggccaagcaccaagaaaacagtggttgcctagcaagcactgaataaatatttgtcatggaaaatagtggttcagaacaatagctatgcgggtgcaattgctagctcagtcacttgccagctggcgtaaccttgggtgaatcatttcattcccctgagcttggtttcccaccctgccacatgacattgatagtagaatccactcctagggttgttgtgatagtttatcaaactgatgcacatacagctgtcagcacggggtctggcacgaggtcaagtgctcaggagtgggtggtagcaaatcgatggatgtgaagatacatagatgagggattgagtctgagtaggagtctttttgggggctgtgtggtgagagtgataccccctcactgctgccatctggcccttgtgatagaatgcacgctgtactagcatctcctgggagctgaggcagaccctgtcagttgtatttgatgccttcatcacggggcagggaaagaaaggtaagttaccttggcaactcatctgtacccacccatgccagccctgccttatctatgtggactaggcctaggcctggcccctgctcagccctgcgctctgtttctcagactggtccctcttccggatgttctcccgaaccctcacggagccctgccccctggcttcagagagccgagtctatgtggacatcaccacctacaaccaggtaacaaggtctccagccacacacacaaacacaccgctggtccccaggaccagcctaccctctctgcttgcttcttagccctgcctttgtgtccccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggtgagtgggtggttggttggactgctgggttgcaacggctacagagaaaagactcacaatcccacgtctttgccgttagatgattgggttgtatttagaccagatttccagagtcatatgctgctgactgtagctattccaagctctacgattttgggtaggttcctaaactccccaagcttcagcatccacatctgaaaaatagagtatacttagcaaattggatgagatgatgtgaaaaatggagttagttcatgcatttgcttaatcaaccaaatacttttgaattcatactaagtgccaggcatagagtgttgaataagacagaggacactgcactcaagaaatataagtctactagctagggcaggtgtcagttaattaattacagttgtgttcagttcccttaccaagggaaagagcagaatatcctgagaggacctggattgggttcgaagggggcacggtgttcgtcacgtaagcacttcaatactagcaacctattgtcatcatcgcttgttggctggggaagacagggatgattccagaacccagattgcccagtttcagtggcagggctgttccccatctactcactggcttgggactctgaacatggcctgggcaggtggggtggggagtgattcttacctttggcagctgttaactgttgatatttctttacacagaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatttctatttttattaaaatttatttttattttctattatttttctaaggagaagataatattagtgcttcctattaggtgccaggcatagcactaaagcacttgcctttctttggtgtagggggagactagtagtaaagtaaaagacctctgaggaagaggttgtaccatatcccaaacggccaaacttaaaaacctttcagtactttagttgattcctatattttcaaacatacggtgaatagtttcacttattttcagcaccattatttgtaccaccttcaaaatctctatttcagacatcctaactgcatattctataggtttttctgttattattcttttaaatcttctcctttggaaaatttcaaacccaaacccaaacagaatagtgtaataatcccctgtacacaccctgcagccttttttttttttttttaagagacagactgttgctctgtcagctatgccggagtgcagtggcatgatcatggctcattgcagtctcagactgctcggctcaagcaatcctcctacctccgcttccctaggactacaggcatgaaccgccatgcctttaattttttcacagaggcagggtcttgttatgttgcacaggctggtctcaaactcctggcctcaagcgattctcctgcctcagtctcctaaagtgctgggattataggtgtaagccgctgcctgctggcatatcttaaagcaaatcttagacattgcatcaattaacctttaaatactttaaggatttttaaaaatgtaaccgtatcattaccacttctgttttcccctgtggtcttaaaaatgtctttttataattggtttgtttaaattgggataaacaaggttctcacattgcatttgctttatactaagttcctctcttgggtgggcacagtggtgcacacctgtaatctcagcactttgggaggccaacacagaaggaccacttgagtccaggagttcgaaaccagcctggacaacattgtgaggctccccctacctatacaaaaaaaatttttttttttttttttttttttttttgagacggatcctcactctgtcacccaggctggagtgcagtggcgcgatcttagctcactgcaacctccacctcccgggttcaagcgattctcctgcctccacctcccgagtagctgggactacaggcgcgtgccaccacgcctggctaattttttctgtttttagtagagatgcggtttcactgtgttagccagggtggtctcgatcttctgaccttgtgatctgcccgccttggcctcccaaagtgctgggattaaaataaattgtttttaattagctgggggtggtgttgcacgcctgtagtcccagctactcaagaggctgaggtgggaggatcacttgaacccaggaggtcaaggctatagtgagccatgatcatactattgcacttcagcatgggcgacagtgtgagaccctgtcacgaaaaaaaaaaaagtttctttttctttaaaattactagactattcttagagcagttttaggtttacagaaaaactgagcacaaagcacagagttcccatatactccctgtctccacacccagaatgtcccttattataaatgtcttgtctttggtgtggtactcttcagtctctcttcatctgtagcagtgcccatgccttttttttttttttttaatgtcatttatttgttgaagaaactgggtcatttgttgtgtagaatgttccacattctgggtttgtccttgtgctagtgtttaacacacccctcctctcctatatttcttgtgtgttggtggttagatttagaaacctgattagattcatgtcccacatttttggcaagaaaaattcccaggtggttctgtgaacttcttcttgcgtcacatcaggcacttggtgtctggtgccccagttgtagtgatgtgaagattgattagccatctgcagcactcctaacaacctctcttgatcgcatcctgggatcactgccctggaaacatcctctcccttttcttagcccctgctttcttcccttgcctgcctggcttctatgctcccaagcccatcttctaggcacccagattgaggctccatggcaagcagcagggacaggggcagcaggtagcctgaccccaggaaagagatgtgggtgaccttgcatgtctccaggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcaggtgggctccacccccacaggccacctctcatccccctgacctaccctttctgctgcttaccccttgatagggcagccagatgggaacacgggccatctctctgcttctctgtagcccatctgtcctcagcgcccttgtgcccagcatggtagcagccaagccagtggactgggaagagagtcccctcttcaacagcctgtaagtgtgaccacactcactgataacacatcctcagctgcctgctgggccttaacacaggtgaccaggctcctgcaggggagttcagggtagatgttacatcttccaaagagatgtgtagatttaattcaatcctaataaaaatcctggcagtctgtggaatttgtgaagactttataaaatgattttaaagtgcttctagaagaatacttttacttacagcctacatttacttcttgatgctcttaaatatttaatcaagcacttatcaaatgccaagtgcttctgagagcactgagtgtgcaagattaaacaaaacagacttggccctggcctccctttgcttacagtctagaaggaagattctggtctagagagtaatggggttagaggttgggtaggaattgatttactgggttatctaggaaggcttcatttaggaggtggcatttaggctgaaaccaggctaagaaagaagcaaccaagcaaaggcggggcccctttcctccacctcaacaccaggcgtctctctttctttcctttctctctctttctttctttctctttctttctttctttctttctttctttctttctttctttctttctttctttctttctttctttctctttctttctttcttatttattttttattttactttaagttctgggatacatgtgcagaacatacaggtttgttacataggtatatatgtgccacggtggtttgccgtacccatcaacccatcatctaggttttaagccccgcatgcattaggtatttgtcctaatgctctccctccccttgccccccgcccgccgctcccctttatcaggtttagagattgagctatgccttctgttgaaaggttttgagcctaagagaacattggaaacactgtgttgcattgcccaatactgccggaatgaggatggggtgagatggggaggagcagccagtcctgtctcaccgctcttcccctgaccccaggttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgg

SEQ ID NO: 38206 - DNA, 74025 bp, Homo sapiens
cacccgaaggcgtccgggaatcttcactttttccgttgctagcagtggaagggtcacagaccaaacactaaggcctgagcggtgacaaccgaggcgagatgatggtcaacagggaatgcctcgtgggagaaaaaagacaattttgtgagtataagccccctaaaaacctgtttttcgttcgcttccttctctgggcagttttgacccgacgacttttataaagaaggtaacgtgagtgtggcgctgggtgcggttggctgttcgggaacattccctcggggcggaacgtgggatgggggctccccccaggtaccctttccccacagccgcttccccgctccgcgtcgctgctcaggcgccagctcccgcgtcggaaggggcgatggggtggcccgggggaaggggcaacgcccagcggcgagaactgggcgcacgctggcgttcctgctcccgccgaggggcggccaccggccggggcgcgcgcaccgtggggccgggagtccgcgcggccccggcagcccctgcctcgcttctccgcgctcgcggcgccgcctcctcccttcgcgccgccggcgctgctcgggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagaggtgagtgggcggcgcgcggccccaggctgcccgaaccgcggtccatcgcttcctccctcctttgcccagggcccgtaccccgcgcgccgagacctcgcgtcggtccccggagcctccccgcggcttgcgccggggctgcaaccttcgctggctgcgctcggggctggctccgcaccttcctgcaccgagtagcccgcggctgcctgggcccctcggctcgctccccaagaccgggcgcgcggcccccttgccctgcgatgaggggcctcgcgaggattccctgccctgcagtctcaggcgatgcggggcctgtctttttgttctgagctttgtcacgcgcgtcggcatccaaagtcaaaagcgtgcaccccctaagtcgcactagttccagttctgcagcgtgatttgcaccaggcgcgggaggctggccgagccgcgagtctctcggctcccgccgcctcttcctcccctccagccccaggcgcgctccggccgccctggggtccacgttgccgctgggcctcgtggctggtgaccccggagcttgggctccgggtcctcccgccgcgcgtccagagcgcggctgcatcccgttctcgtggatgctcggggttttctcgcatacctgtgtttccacctttgccaacgtggaggatccacacaactttgccctgctgtaaaaatcatatcccatttaatatttttaatgatttgcttttaagaaacaaaatgtgaagaataacaattttgatgaaattttttagcaaaatttaagaattattatatttgaaataccatgatgatgctggacaatttcagatgtcccatagccagatttgcaaaactaaacttgtgtgactttcacgattttgaggttttctttgtctgatttggggtccctaggccctacattatgcacattattgaggaacatttctagggctggattagtgagatacacaataacctgatgaagtatttagcagcgcttgagtggctttgtttagctcatggccatcaggttggctcaaatctcagttttagtatttctgaattttggagggcatgggacaatctcttgtcagtttttgtgggtctccaaaggcatcctagcttcttccagttgtgttataaaagatgaagctaagctcattactttctttcttaatagaaactagtaacttgctaagacttactgtttttaggccagacactcaattcttaaggtgtcagtgaacaaaaattgaattgttaggatggttaaagaaaagaggttagcttttaagatacattttgttctcctatggagaggttatccaattttcacatttttttttaaagttggttttacaggaaaacgaaagaaatgagaggaaagtagtgctgagggtggggccaggaaattgtggtgacttggatattaagggccagggataccatctgctttctaatggctggtttaggtccagttattgatgggaaatgaaaagattttgcatttacattccacccgctgttgttgttgttgttgagggctgggcagaaacaacagttaggacagctgaccatagcaggcccagggctacccgggtttatatatatatggccaccttccccaggaaggagggaactgctacccttatcctgtgaaagtgcgagctggctttctgcattggaagtacagagggcagaacctggggaaaatgcgtctgcgtggatcagtaggaagggtggagcatcactttaggcaggtgtgctgagaagaagacaggtgtcagttgatgggcactattggtgggagggagcttgaaggcagcgtggtccctgaggtccagccgcctttctcaaaggacctggggtggccattgggggcgggggagcggtgttctgtgcctttggcttaaattctgcagcattattgttattacttgttttttcttgaaataaaaaaaaaataagttgccctatgaaaaaagatacatttctttttcagtgacgtaatgtgagaaataacatttgtaattgggattttttaaaagcacttctgtttttgtaaaacaaaacaattttttaaacatttgtaaaaaagtagaaggaacagaaggaatggtgctactatgcttttgctctcaccttagaaaagggcgaatgatatttcacttgctccccaaaaactgttcttaaagatcatggtggttttctggacttctcacgttattgatgaagttacattaaaagagagacttgtctccaaatttatgaagtgtttcttaaatttccagagagtctttcctttctttcacacagatatttctcacactttcaggaaaaaaaaaaaaaaaagtccatgccttctcagatttttacattttggtcttattttcctttaaaacccttaagcactttattagtaggacttcccttgctaagattttgaagattagtgcctgacagaaaaaagtacatatataaatactatataatatgattatagttgtttatattgtaatttgctatcgtttcccaacttttttgatgtttcttagtaataaaaaaacttttttaacactcttctgtatgtgcatttgttgcttatttataaactacatgtatttgctgttatggttatattgtgtctcaaggcccaatatacacatagggctggatttgttaacaacattagaggtagaaaccctgttttaaatactctttctcttaattttaagtattttgggcctgtgtcttgtcagatctgattacatcagcatagtttctacttcatgaggtatctcatgcaaggctgactcagtatagagctttgccagccacggtattttgctgtcctgtgtttgcatttattagtggaataaacagacctctgacttggtaggtctggggtcggccacaaaatttgcatttctgacaaattccaaggtaatgctgatgctgctaatatggggaccacactttaaggaccattgaactacagcaggagttggcaacctgtttctgaaaaggaccagatactattttagatgttgcagaccctgtggtccctgtcacaactactcagctctgctgttatagcccagtagccacagataatatgtaaatgaatgggcatggttctgttccagtaaaactttatttatggatacagaagttttagtttcatgtaattttcatgtgtcatgagatatccttttatttccaaaccaaaaaaaaaaaaaaaacctatcgagcagttatcatgtggtgtgtactttattgccgctgtaatttttaatcctcacaacaaaaggttttacatatttaaagtctcatatcactgcatcctagaacatggggtcagtagtaagcctacttcaatggacttttacaaggattgaataagatacagagagggggattatacaactcaccaaaattcatgcaaatagtaagaaagctaggattaaaattccttttggcctgacccacatcagtactcttttcctaagccacactgcctcaacagtaccgctaaggaagcactcaaaataacaggtagctaaactgacatctaatatcacttcatggcatccaaattctccaaggagcactgaaccaggagtcacctgccaggtcagtctccatccctctatcagtaggtctgtgtgcgagttggggaacactgcaagtttcagctggttctcggttcttcttggttttcagccctgctgggctcttttgggtctttcccacgcgcgcataatcttccaggcagccaggaatatgtggagaatttatctcagccctttgaagcactctgtcatgaaatattattcttttaactttcttcaaccattgaaaatgtaaaaactggccaggcacgttggctcatgcctgtaatcccagcactttgggaggctgaggtgggcggatcacttcaagtcaggagttcgagaccaacctggccaacatggtgaaaccccatctctattttaaaaaaaaaaaaaaagggaaaatacaaaaattagctgggcgtggtggcatgtgcctgtaattccagctacctgggaggctgagacattcgaatcacttgaacccaggaggcagaggttacagacagctgagattgcgccactgcactccagcctgggtgacaaagcaagacttcgtctcaaaaaaaaagaaaaaaaatgtaaaaactattcttaatttgtgggcagtgtacaaaaatagatggctggcaggattgggcccttgggcggcagtttgtgactcaaggaaaaattgagctcctactgagatgtattcttttttcttttcttttctttttcttttttttttttttagacggggtttttgcccaggctggagagcaatggcactatctcggctcaccgaaaactccgcttcccaggttctagtgattctcctgcgtcagcctcccaactatctgggattacaggcatgcaccaccacgcccggctaattttgtatttttagtaaagacagggtttctccatgttggtcaggctggtcttgaactcccgatctcaggtgatccgcctgccttggcctcccaaagtgctgggattacaggcattagccaccgtgcctggcccaagatgtattcttttttaaatatttttttgtagagacagggtctccctgcataacattgcccaatctggtctcgaattcctgggctcaagtgatcctcctgcctcagcctaccaaagtgctgggattatagacgtgagccatcgtgctggccccaggatatattcttgacggtggttcaacctttcttcagaaaatttcaaaacaggaagaatttggttccctagttcattttcactcatccacctcgctttttggtgtttctactacctaccactatacattcattttaaaagttttaatctttagacactgtcagcttctagcattggggaaaagatggtgttcattttggggaagtgagaggaagagagtctgtgtatttcctagtaagtttttaaagcaatttaagcagaacacagtgaccttggtcatttaatcccaatgggttagaggcagagttgacaaactgtctaaatggtcagatggtaaatgtttaatcctcacaataccctatgggcagagttggtctgtgagtctctgtctctgtctcaacttttcagttctactttgtagccagaaagcagccataggcagtatttatggcagtgtatagtaaaactttaaaaaaaaaaaaaccaggcccggatatggcctgtgggccatagtttgctcacccctggcttagagacattcttgggacagggtggaatatttccaggccatcagaaaacttggtgactgattctttcccggactccaggctgcgccggggtgtgctcaggtctgtttgctcattgcagtgacttctgaacttcctgctgagccgctggggccattcctctgagaaggagttagaggtgtggctccaccactgtttggagaagcccagtttctgcactggttgatgttggtcaaacatgctaatctgacgcgattgctcctatatatttgcttttctgatttaaagccctatatgaaaataaggaaatgttaaacataatatttgactaggagggtcaaggggctcgtgtatttggcatgttgtccattttcatatgccttttctttcttttaaaaaaagtaattagaaggctttgttaaattacaaacattttgtcttaaaagcaaataataattttaaccaataggttgaatttttaaattaagccagtaggtaagaatatgcagttttttccttttctgatttatcaagtgatttttttttttttttgacagaaatcttgctctgtcgcccaggctggcatgcagtgacgcaatctcaactcactgcaacctccatctcctgggttcaagcaattctcatgccttagcctcccaagtagctggaattacaggtgtgtgccaccacacccagataattttggggtttttttgttgttgtttctttttttttttttttttttgaggcagaatctcgctctgtcactcaggctagagtgagtggcgcaatcttggctcacagcaacctctgcctcccaagttcaagcgattctcctgcctcagcctcccaagtagctgggattacaggcacacaccaccatgcccagctaattgtatttttagtagagacagggttttgatatgttggccaggctggcctcaaattcctgacctcaggtgatcgtctgccttggcctcccaaagtgctgggattatacacatgagccactgtgtacacccagcctatcaagtgatttttaatgtgaaaacacaccacttgttttaattttgggaaagcctggagcctcacagagtttagctgatttaagttaatcattttcagtatgttggaagcttataaccaagtatgagacaaacatattctgaagcttaaatgaaaatgaatattaaattaatacctctgtttgatgcagtatatcactcacccacttccatctcatccgcaatccaaataaattctaaggtgggagaagggagagtgtctgatgtatttgaccaccataaactctgcctgtgagttcctgccaccagccttcatcagtcttgatcatttctcgccagtgtgtgtcccttatccttcagcagcaagggtttctacagtcctggaagcctgtgaggaggcaccttgcaggcctgaagcctcattgtgttacttcctttccttgtgtcactatttacctgggcagccctgctcccattgggagcccagggctctcctaagagtgctgtctagacagctgctcaccttcctggccagccaagcactgggtgacagtgaggggcttccaggattgtatgacttccaggactgtttgaggcttggcttcctcaaacctttttcataatatgatcctggtctgggatgtccacggcctcagtggcaactgtaggtcagccccaggtaatggcaggtactgctattttagttggtggcagagtcaggagaaggaaagaggaggactggttgctataaagtagaatggttatggaaggaaaacatgcatcactgtttcctcataaaatggaaaaaagattgaatctagaaatgatttgttgttcatctttccatccctaatagttgtcaacatttgttgagcaattactatgtgccaaatgtagctctaagcgcttctcactcaactcactgaatcctcttaaaaaccttgtgagcaggacagtgatgcacagacaggtcctgtgtcccctgagtggtagagcaagggtcagacatggttgtggggttccagtcttggagttcctgagtggtggagccagtgtcagacatggctgtgaggctccagtctgtggggttcctgagtggtggagccaggattcagatatggcaatgggattccagtctgtgctcttaataccaccctgagctgcctgatgtgaatacagcacctgactcatggtagctgctcaataaattttttattggctgtttaaagaaaagagaatattaaatggttatctgtacacttcccttgaagtgagaatggagtttattttctgctttcaaatttataatataccccacccactgacttacctctactagaataacaaaaggccttgcaagggtcacatctaaaagtattttgtcaagccatgtgcggcagcatgtgcctactcggagactgaggtgtgaggattgcttaggtccaggagttcaaggctgcagtgagccatgattgtaccactgcactccagcctgggcgacaagattccatctctttaagaaaaagtatattgttagaaaatttagtatataacaaagatagttgttcaaagcagtaggtaaaaatagattattcagtagagggccctggcagaactggcttgtcactacaggaaaaaaaaaagctgcattctttgtatttccttacttctgcattctttgtatttccttactccttacatcaaaaaggagttttaaatggatgaacaatttaaatgtaaatatgaaactgtacattggaaaaaaatgtgggtaagttgtttataaacttagaataggaaatgcccttctaaatataacaacaatcgagaagtaataaaggattgacaagattaggttatttaaaacaacaacagagtggctggtaagatggccaaatagcaacagctctggtccgcagctcccagcgagatcaacacagaagacaggtgatttctgcatttccaactgaggtacctggctcatctcactgggactggttagacggtggatgcagcccacagagggtgagcagaagcagggtggggcatcgcctcatctaggaagtgcaaggggttggggaactcctcccctagccaagggaaactatgagggactgtgccatgagggacagtgcactctggcccagatactacgcttttcccatgctcttcgcaacccacagaccaggagataccctcaggtgcctacaccaccagggccctgggtttcaagcacaaaactgggcggccatttgggcagacactgagctagctgcaggagttttttttttttttttttttttttttttggtaccccagtggcacttggaacgccagcgagacagaactgttcactcccctggaaaggaggctgaagccagggagccaagtggtctaactcattggattccaccccaatggagcccagcaagctaagaaacactggcttgaaattcttgctgccagcacagcagtctgaagttgccccgggatgctcgagcttggtagaggggaggggcatccgccattgctgaggctggagtaggtggttttcctctcacagtgtaaagaaagctgccagttcgaactgggtagagcccactgcagctcggcaaagccactgtggccagactgcctctctagattcctcctctctgagcagggcatctctgaaagaaaggcagcagccccagtcttacagataaaactcccagctccctgggacagagcacctgggggaaggggtagctgtgggcacagcttcagcagacttaaatgttcctgcctgccagctctgaagagagcagcagatctcccagcataacactcaaagtctgctaggggacagactgcctcttcaagtgggtccctgacccctgtgcctcctgactggaagacacctcctagcaggggttgacagctcacctcatacaggagagctccggctggcatctagtgggtgcccctctgcgacaaagcttccagaggaaggaacaggcagcaatctttgcttttctgatgcctccactggtgatacccaggcagtgtctggagtggacctccagcaaactccagcagacctgcagcagaggggcctgacagtgagaagggaaactaacagaaaggaatagcatcaacaaaaaggacatccacacagaaaccccatctgaagttcaccaatatcaaagaccaaaggtagatacatccacaaagatgaggaaaaacctgcacaaaaaggctgaaaattccaaaaaccagaatgcctcttctcctccaaaggatcacacctcctcgccagcaagggaacaaaactggacagagaatgagtttgatgaactgacagaagtaggcttcagaaggtgggtaataaactcctccgagctaaaggagcatgttctaacccaatgcaaggaagctaagaaccttgaaaaaagtttagaggaattgctaactagaataaccagtttagagaagaacataaatgacctgatggagctgaaaaacacagcacgagaacttcgtgaagcatatgcaagtatcaatagccaaatcggtcaagcggaagaaaggatatcagaggtcgaagatcaacttaatgaaataaagcgtgaagacaagattagagaaaaaaagaatgaaaaggaatgaacaaagcctccaacaaatatggaactatgtgaaaagaccaaacctatgtttgattggtgtacctgaaagtgagggggggaatggaaccaagttggaaacactcttcaggatattatccaggagaacttccccaacctagcaagacaggccaacattcaaattcaggaaatacagagaacaccacagatactcctcgagaagagcaacctgaagacacataattgtcagattcaccaaggttgaaatgaaggaaaaaatgttaagggcagccagagaaaaaagtcaggttacccacaaagggaagcccatcagactaacagcagatctctctgcagaacccctacaagccagaagagaatgggggctaatattcaacattcttaaaagaactttcaacccggaatttcatatctagccaaactaagcttcataagtgaaggataagtaaaatcctttacagacaagcaaatgctgagagattttgtcaccaccaggactgccttacaagagctcctaaaggaagcactaaatatggaaaggaaaaaccagtaccagccactgcaaaagcgtaccaaattgtaaagaccatcgacactatgaagaaactgcatcaactaatggacaaaataaccagttaacatcataatgacaggatcaaattcacacataacaatattaaccttaaatgtaaatgggctaaatgccccaattaaaagacacagactggcaaattggatagactcaagacccataggtatgctgtattcaggagacccatctcacacgcagagacacacataggctcaaaataaagggatggaagaatattaccaagcaacggaaagcaaaaaaacaaaacaaaaaaaaaaaaaaaacaaaaccaggagttgcaatcctctgaaaaaacagactttaaaccaacaaagatttaaaaagggcattacataatggtaaaggaatcaatgcaacaagaagacctatctatcctaaatatatatatatatatatatatatatatatatatatacacccttcaaaaaaacaacgaatccaggagctggttttttgaaaagattaacaaaatagatagactgctagccagactaataaagaagaaaagagagaagactgaaatagacacaataaaaaatggtaaaggggagatcaccactgatcccacagaaatacaaactaaaatcagaggatactataaacacctctacgcaaataaactagaaaatctagaagaaatggataaattcctggacacataaaccctcccaagattaaaccaggaagaagtcaaatccctgaatagaccaataacaagttctgaaattgaggcagtaatgaatagcctaccaaccaaaaaaagcccaggaccagacggaatcacagccaaattctaccagaggtacaaagaggagctggtaccattccttctgaaactattccaaacaatagaaaaagagggactcttccctaactcattttatgaggtcagcatcatcctgataccaaaacctggcctaaacacaacaaaaaaagaaaatttcagaccaatatccctgatgaacatcgatggggaaatcctcaataaaatactggcaaaccaaatccagcagcacatcaaaaagcttatccactacaatcaagtcagcttcatccctgggatgcaaggctggttcaacatatgaattagtagacgtaatccatcacataaacagaaccaatggcaaaaaccacatggttctctcaatagatgcagaaaaggccttcgatcaaattccacacctcttcatgctaaaaactctcaataaactaggtattgatggaatgtatctcaaaataataagagctatttacaacaaacccacagccagtatcatactgaatgggcaaaagctggaggcattccctttgaaaactgccacaagacaaggatgtcctctctcatcactcctattcagcatggtatttgaagttctggccagggcaatcaagcaagagaaagaaatgtattcaaataggaagagaggaagtcatatgatccctgtttgcagacaacatgattgtatatttagaaaaccccatcgtctcagcctaaaatctccttaagctgataagcaacttcagcaaagtctcaggatacaaaatcaatgtgcaaaaatcacaagcattcctatacactaatagacaaacagccaaatcatgaatgagctcccattcacaattgctacaaggagaataaaatacctaagagtacaacttacaagggatgtgaaggacctcttcaaggagaactacaaaccactgttcaaggaagtaagagaggacacgaacaaatggagaaacattccatgctcatggatcggaagaatcaatatcgtgaaaatggccatactgcccaaagtaatttatagattcaatgctatcgccatcaagctacccttgactttcttcacagaattggaaaaaactactttaaagttcatatggaaccaaaaaagagctcatatagccaagacaatcctaagcaaaaagacaaagctggaggcatcatgctgcctgacttcaaactgtaccacaaggctacagtaaccaaaacagcatggtactggtaccaaaaaagatacatagaccaatggaacagaacagagggctcagaaagaatgccacacatctacaaccatctgatctttgacaaaactgacaaaaacaagcaatggagaaaggattccctgtttaataaatggcactgggaaaactggcaagccatatgcagaaaactgaaactggacctcttccttacaccttgtacaaaaactaactcaagatggattaaagacttaaacgtaagacctaaaaccataaacaccctagaagaaaacctaggcagtacgtgggcatgggcaaagacttcatgactaaaacaccaaaagaaatggcaacaaaagccaaaatagacaaatgggatctagttaagctaacgagcttctgcacagctaaagaggctatcatcagagtgaacaggcagcctacagaataggagaaaacttttgtaatctgtccatctgacaaagggctaatatccagactctacaaagaacttaaagttacaagaaaaaaaaacccatcaaaaactgggcgaaggatatgaacagagacttctcaaaagaagacatttatgcagccaacaaacatatgaacaaaagatcatcatcattggtcattagagaaatgcaaatcaaaaccataatgagataccatctcacgccagttagaatggtgatcattaaaaagtcaggaaaccacagatgctggagagaatggagaaataggaacgcttttactctgttggtcggagtgtaagttagttcaaccattgtggaaaacagtgtggtgattcctcaaggatctagaactagaaataccatttgacccagcaatcccattactgggtatatacccaaaggattataaatcattctataaagacacatgcacacgtatgtttattgcggcactgttcacgatagcaaagacttggaaccaacccaaatgcccatcagtgatagactagataaagaaaatatggcacgtatacaccatggaatactatgcagccataaatgagttcatgtcctttgccagggacacggatgaagctggaaaccatcattctcagcaaactaacacaggaacagaaaaccaaacaccacatgttctcattcataagtgggagctgaacaatgagaaaacatggacacagggagggaaacatcacacaccagggcctgtggtggggtggggaactaggggaggggtaagcattaggagaagtaactaaatgtaggtgaggggttgatgggtgcagcaaaccatcatggcacaggtatacctatgtaacaaacctgcacgttttgcacatgtatcccagagcttaaagtataatttaaaaaaaaagtagaaccttcaaaaaaaaaaaaaaaaacaaaaactttgggcaaaatttctgtaaagtaaaagaatagatgaaaaattgaaaaaaaattattcaaatgaaggaccaaagattggtttacctttaatagacaaagagctttagcaaatcaataagatgaacaccccagtttaaaactgggcaaaaaatatgaaaaggcatttcaccaaaatgaacatgcagatggccaataaatgaaaagacactcatttgtactcacaattaatgtgcttgaaaatatcactaatgagattgtcaggcattaaaaagtttgttttctatgttaccatgtcggaaaacaggcattctcctgctgcagaagattgtgattaaaacctctatatgaaaagaaggaaaattttttttgtaggcctaactgtctttttgtttgtttctctgggacagagtctcactctgttgcccccaggctggagtgcagtggcgcgatctcgactcactgcaacctctgcctcccgggttcaagtgattcttctgcctcagcctcccgagtagctaggactacaggtgagcaccacccccggctacttcttgtatttttagtagagatggggtttcaccatattggtgaggatggtcttgaactcctgacctcgtgatccgcttgcctcagcctcctaaagtgctggaattacaggcatgagcctccgtgcccagcgaaaggaaggaattttttaaaatattaatatttaactagaaggttcaaggggctcatgcatttgacaggttggacctgttttggatatggttaagatctatcaaataattttttatatagtttagacttaaggaagggttggaaaatagtacatatagttcctatataccctttaccctgtttccccttaaccatagaatttatcaaaattaagagattaaccttggtaatatctttttaaccgtgctggccaagtgttttatagaatgtctgacgcgttgacttcctctgaattttctcctgataagattgaggttatgtatccctggcaggaggctgtagaggtgccgtgccctcctagtgcaccatatcagggggtatgtgatgtcgatgtgcctcattatcagggataccaagcttgaacatgtggctaaggtggcatctgccagaattcttcatgtaatagaactgtttttccctttgtaatttgccaactattttggaagagagaagctctatcaatattaaaaacatacatttttgacccagaaatagatccacagagatgtgatttatttcatctcctgcaaaatggggatgataatgcccccaaagctgatacgagcccctgtattgagcagtgcctcacaacagtaagcttgctgttggttcatctcaagctccttgaggccagctaggtttggaactcaggacttttttcagaattcagataacattgggcatttattatatattatgtgacagccccaggaggatctaggacagcaccgcatgctcaaacactcatctttctgcagtgaaatgtatgagcattcacatgaaaggaggaagataaagactatcagtagcttcagataagttctgatcagaccttgatctcagttcaggttttgttgctggaaaagtttttaaaactttctctgagtttttagagaccgttttggatttcaaagttgtgaataagggactgtacacataggtaagagttcgtaaacacagagatggatgtacagttccacatctgcagattaaactagctgttcaaaatgtacttaagcctggctgggcatggtggctcatgcccataatcccagcactttgggaggccgaggcaggcagatcacttgaggccgagaattcgagaccagcctggccaacatagtgaaacactgtctctactaaaagtacaaaaaaaactagctgggtgtggtggtggccacctctaatcccagctactcaggaggctgagatgggagaatcctttgaacctgggagtcggaggttgcagtgagccaagttcgtgccactgcactctagcctgggtgacagagcaagactcccatctcagaaaaacaaacaaaaattagttaggcctactgtggttgcatctgtactgaacatgtatagacttttttgtgattagttcctaaacatatggcttaacagctaattacatagcatttatattgtactaagtattataagtaatctagacatggtttaaagcctagaggaggatgtgcctgggttggattcacatagtatgccattttatataagagacttgaacatccttggcttttggtgtcctcagggggtcctggaaccaatccccagtgaatactgagggacagctgtgtaaggttgtttatggtagcattgttggaaataagcctggaaaaccttgactgtttctctgtaggagatcagttaagcagatcttggcacacagtggtgccctattcagccctttgaaaagaatggagcaaaccataatgtgctactaaaaaaggggaggcaagatgtgttactaagaaatacacagcatttacagaagagtgtgaatggtgtgatcttgtttggattaaaataaatatattgatgcttatatatgcatctagaaacatctagaatagcggctatacatatgaatcacctggggaggttaaaaaatacaaatatccgggccttgccctaaaccccattgaattagaaatgcagggctgggggccaggtgtgatggctcacgcctgtactcccagcactttaggaggctgaggcgggaggatcactgagcccaggagtttgagaccagcttgagcaacatagtgagaccccatctctacaaaaatagaaaaaattagctgggcgtggtggcacacacctgtagtcccagctacttgggaagctgaagtgggaggatcacttgagcccaggaagttggggaagctgaggtgggaggatcacttgagcccaggagttgaggctgggatcacaccactaggcagctatttcagcctgggtgacagagtgagtgtgtcagcctgagcaacagagtgagaccctgtctcaagaaaaaaaaaaaaggaaagaaaagaaatgcagtggtggagcccaggtattgatattttaaaaagtgtcaggctgggcacggtggctcatgcctgtaatcccagcactttgggaggccgaggcgggcggatcacaaggtcaggagatcaagaccatcctggctaatgggggaacttcgtctctactaaaactacaaaaaattagccaggtgtggtggcaggtgcctgtagtcccagctactcgggaggctgaggcaggagaatggcatgaacctgggaggcggagcttgcagtgaacctagatcacgccactgcactccagcctgggcaacagagagagactccatctcaaaaaaaaaaaaaaaaaaaaagtgtcccaggtgatgctgatgccccttgagtgttgaggaccactggaacagaaggacccagatgttagaaaatgttatccctttcctttggagtaggatgagggggatgtaatttatccttttttcttttttttttttaatcagagtctcgctctgtcgcccaggctggagtgcagtggtgtcatcttggctcactgcaagctccgcctcatgggttcaagcttttctcctgtctcagcctcttgagtagctgggactacaggcatgtgccaccatgcctggctgcttttgtatttttagtagagatggagtttcaccacgttggccaggctggtctcaaattcctgacttcaggccatctacctgccttggcctcccaaagtgctgggattacaggcatgagccactgcacccgaccaatttatactctactgtgtgtagtttcctattttttccttagcaaaagccatttggaaaagtccctgccaccccctcttgtatttgtacttttatattttaaaaacaaggttagctgggcacggtggctcatgcctatattcccagcactttgggagaacgaggcagacggatcacctgaggttgggagttccagaccagcctgaccaacatggagaaaccccgtctctactaaaaatacaaaattagctggccgtggtggtgcatgcctgtaatcccagctactcgggaagctgaggcaggagaatcgctttaacccgggaggcagaggttgtagtgagctgagatcacaccattgcactccagcctggaaaacaagagcgaaactccgtctcaaaaaaaaaaaaaaaaaaatcattgaggctgggtgcactggctcatacctgtaatcccagtactttgaggggcccagatgggaggatcacttgaggtcaggaatttgaggccaacctaggcaatagtgagaccctgtctgtacaaaaattgttttaaaaaattagctgggcatggtggcccatgtctgtagtcccagctacttgagaggttgagggcaggaggattatttgagcccaagagtttgaggcttcagtgagccacaattgcgtgactgactccaccctgggcgacagagaccctgtctctaaaataaataaacaaaaattttaaaaagtttaagagtcaaaaaagagactcttgtgatcaagagtctcttgagtatattcagtgcttgctgatatcagctgataattgaaagaaaaacgtggtttcccctttcatcctgagaggccagaagctggtaagacatgagcacaggtcagaatttccacccgtgggaattctgggggtgctttattttagatgattcggctagattgcttctttatcccctggcaggcccccatactagtagctagctgttaagaaaaaagaagccttttggtgacccacctgaaaagaccatagggtgaggatcagttctcccatgttctcactggtgagaattgggttttgcaggtgaatccttggtggtatcctcttccttacccgtcccttgtcttttttgcccaccatcccctttcctcctctgttgctagacacccctggtgtaaaaggctctctgtgctcaaaggctgtttgttgcagtgcagccacgctcactctgataaggttctgttttatctggcttgggaaaagccatttggaaaagtctactttccttgttcctagagaccagtgcttgcatccaggcagacctggctttgaattgaagcccattaacaaaatttatggcatctttcttctaagctgtatttttgtgcactctgtagctctcacacagaggcactgtttttcctaacatgaggtgtacaatgcagcagttgcacagatacggtccctaaagtgagaaatgaatgttcgaaagaaggtgctctcgtttggcatggagtgaatgccttgtttccacctcaaatcctaagatggaacacatttttcctggtgacttcaggcagatggcacacctcccacttccgttgtgtgtcatgaaggaggagacacttctatagccagggctgtgcctgaataatgatgtacatgggggggagttcacattcacctccagaatgggtttcctgctttgcttgagaaatgctttaattgggtgtcattagtaatcctgtcaagggtaaaaaaaacctcccttgttaggaatcaaagcaaaaagctctctctgaggagtaatgaggaatatactctttctaatatgatgcggaagcacttaatatttgttattggtgtttacagaaatgattacttctcaaacattgctgcttacagaaatgattaattctcaaactatgccgggaaggtgagtatggtaatgattttacaagggaggaatctgaagtgtaagaggaatcatgtcttgccccaggtctcgagctaatctgtggcaggtttcggggcggtgcctgctcctccgagcctgtcctgggaactggccacactgccctgggttcacagcaccatgggctctgtgcgtgccgttcacatactcttctcccttgacagctttgcacgtcaaggagaagctaccagcccacgcttcttggcaagactcctttcctcttggttgtaaggatgatacggtctgcttcggagatgataaaactagtattgatgtttatttatttgcttttacttggcagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccaggtgttttgttttctttattgttatgtttattttatgtttatgttttgtttattttgttatgatggggtcccaggggtttgttgtttattgccagccagggcgttttgtgcagggcacacgcttgtaaggtgagtttagggctctgcacacccccacagccctgggccagaccccaagcagctttgggtgggagaggtcccctctgtggttgtgtaggattgcggttgtggtatccctccctgcctttcctgtgagttaacagcattcatttgagctactggggtggttctgggaagacagcttgcttacatacactggccatagtccgttgtttgcggtcctccggcgcccaagatatcgaagagtagtattggaagtgtgcttggatgatgggtgtaagaaatatgtttttaaaggtaccaatctttatcttcattacttaatgataataataattttaacttcctcatttaccggtgcagtcatgggtcaggtgcagtgctgagcagtgacaaagatgctcctcttgattgaacttgagtcgggcccttctgagccgtcttcttgactaggccttgatcttggcacctcccaactctcactgcctgtctttggcctgcccagcccagtcctagcaaaggatcccgctaagccatccttctacccctgatccttgaccaagttcctcatccctacccttgctgtctaagtccttggcctgtgtttagcaagaatcttgttaggccagtttagcaagaatccccctactctgggggcgatttccatccactgactccccgcactgtgctcgttggctataaatccctagctgtctttgatgtgttcggcattgagcacaatttccctctcctattgcaatcgttttgaatagtctttcttaccattttaatgaatgtcagaataatttctctttcacagtactttatacaaattatctccttttgtgcacaaaccctacaaggctgggacttgactttcctcatttcacagggggtcagactgaggcaccaagaggttgaggtggagcagggattccaacctgcatgggcttagccgtggcaccccagcacgtctgtgctctgtcctgttctcacacttaccctcctgggcttgtactccctgtgtctcagcttccacgggagttcctgttctctgggcagatgaggtctgcttgtctggagttggagaactgaatctgttttcagaaattgtatctgctaaagagttgttaagtgctttgttagcagcgaagaagaactaaatatttgagcatcatcttatgccaggtaaagcatgaggcattctgtgcacttagcacatttaagcctcacaaaaacccagtgggaagtgtggtgtgagtgcacagagccttccttcacttacactgacagagaccattttttccagaagaaaccgctccagcttctgtccagttgacttaaaacacagccttgggcacttgtgtgtataagactggtgctggccctgggccccaaggtggtctttgtggagggcgctcaggtggtccaggctcctcaggtaacttggcatcagccctaatgccacggtctccttgtagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcaaggcctgctttgtttcctctcagttcttttctaagggatggtgtctacattgtctgtttcttcttggcgggaggatgagcaagcggctgggtttagatttatgtaattatgtggaaagagcctattgatcaagctttgggcattctctccctttcccctccaagtccctggctgggcttgcggtgaagccttttgcagtggtaataaacaggagaaatgcagaagaacaatttcagattcatcctcctattggcttttttttttctcctattgggttttttcttcccactttccacaaacatgtattaaatacctactctgtgccaggcctatgccaggtgcttatatctcagagaaaaataatatttgtgccctccaagtatctaatggaggagaggagaggcagactctactaaatactaacagagaaagtaggggactgcacccttgcttttaagctaggaaaaaaaccaacaaatcctgcgtagatttaaaggggccttcctgctaattaaaatatctaagctttatgtgtctttttttttttttttgagatggagtttggctctgtcgcccaggctggagtgcaatggtgcaatcttggctcactctgcctcccgggttcaagcgattctcctgcctcagcctcctgagtagctgcgattacaggtgcctgccaccacgcccagctaatttttatatttttagtagagatggggttttcaccattttggccaggatggtttcgatctcttgacctcgtgatccacctgcctcagcctcccagagtgctaggattacaggcatgagccaccgtgcccggcctggttttcttatgtaggaatatatgactatactttctttattaaattgtgtaactgtgtgagttactaatatctcctgtcccagagtgcatcaaactttggcctctattattaactagaaaaatttggctttttttttttttttttttttttttttttttttgagatggggtttccctcttgttgtccaggctggagtgcaatggcgccctcttggctcactgcaacctctgcttcccgggttcaagcaattctcctgcctcagcctcccaagtagctgggactacaggcatgtgccaccacgcccagctaattttttgtattttttagtagtgatgggatttcgccatgttggtcaggttggtctcgaactcctgacctcaggtgatgtacccgtcttggcctcccaaagtgctgagattacaggcatgagccaccgcacctggcctgaaaaatttggcttttataatgcgtgtacctctctctctggagtggctaatttattggaagaatgttgtagctcaacttccattatcttgaattgtctcagaaaatgaattatttccaggaagggactcagacttttctcgcataactgatttaaaattcaagaagtactttttttgttgtttaatttgcagagtactttcctatatttgcaagctcatatttcttctctgggaattgtgcataatgttgttgtaataaagtgcttctttatgtttcttcccttttcttactggtgagatatgctttttgtgctcctgaaatcccctttaacctcatctctcaaaaagaaaaagaaaaaaaagagcatcaagtagttatttgaaaagagaatctgtttccacagtttttctcttttagaatatgcgatataaatgtcttttcattttggtgagcaagggtgggttctcacatcaaaccttagctgcaggaggattttagctgtggtttggtggtaggaggcatggaacttgtgagtcaggcagacccgggtttaaagttccctcagctgtgtgattttaggcaagtcacttaaattctctggatctgttttctcaactgtcaagtggaaatgagaaaggaatctcacagggtgcctgtgaggattgaatgagataatatttataaagcgtttaacccagtgctcaacctagaatgaaagctcagcagctggtggttggtattattacacctaattgtaccaacggcagtcgaggccatgatcacagcagcagtggtgggcgcagtcgtaagccaccgcagcagcggtgataatgttatctctttctgtatggactttgtcttagtctgtttaaggctgctataacaaaatatcataaactgagcagcgtataaacaacaagtatttattctcacaggtctggaggctgggaagtcagagatcaagacggggcagattcatctggtgagggcccacttccaggttcatggatgccttcttcttgcggtgtccttgcctggtggaaggggcaaggcagctctctggggcctcttttatggcactaatcccatgtatgagggcttgactctcccagaggtctcggctcctaacattatcgcctccatttggtatttggtgatttggtttcaatgtgtggattttgaaggacacccacactcagaccgtagcagattttttttttcctcccaaattgaaaccatgaaaccaaattgtgctagctttaaaaagagttaggaagacactgagggaggtggaaccaagagcaagcagtgtggtggggctatggaaggagaacgatgacaggcaccacaccagccacaggagtgaacgtttcctgagcctgtgcttggccagacgtgaggctgagcatttcacagggactgtttcattaattcctcccagcagtctgacgagattggggctcatattattagtgaatggaagctcagagagttagcagctgtcaccaggatgacacctagaccctagagagcccccaggccagcctccacccctgcacactggccgccgccttccttcagtgcagacacaacttcttggctgcccgcacctgaagggcgccaaggtggaggggaagggggatagaggaaaccagatgggcttgagttggtcagtgctgaagctggtgatgggtacatgggagttcagcatgctagcttgtttacctttgtctgcattaaagacttcacagtagaaactttaaaaacatcttctttagatctccttgcttccaaagactgctgtgttctaactagctctattttggctacatggatgggcttatccttcacctaaatacttttttatacattgtctgtcttttttttttttttttttttaaatcttagaaggttagcatttgtggttagaactggaacaagtctccttaaaaaaattttaaagaaccatggtgattctcagccatgggaggagctggggtgtggggacctgtggctgggggtggtttgcaaatgacacctgacctagagatttccctgcctgtctctgccagcgttcctcacctcaagcagtcactgtcactctgggtaggtgttatatccctcaagttgggggctggacaaaagcttggaaaccaaacctgtcatcagggaaaatgtgaacaaacacctgttcataatgaaattactgctttgggtaggccctgtctgatagaattttctatgatggcagaaatgtttatagtacagtagccaccagccacatgagtctaatgaatacctgaaatgtggctagtgggactgaagaactgaattttatttaattttatcgaacttaaatgtaaatagccaaataatggtcacattggacagcacgggtttgtgtggttggcagaatgctggggaaaaccttgtttgggcctctgagtcatagggagccatgttcctcagtggagcggagggcagagtctgagtctcctgtggttccttggtgcctttcccccttctctgtaaggttcgggagcagtgtgggcaattgggcaatggaagatgaaatcaccttcaacctggggagttgtgcacccccctgaaagtaagtctctgcagcttgctggtgttctgatgcagaatgatctgttcagcttatcaaatcagcttttgtttacaccccagcttggggttttgatcttatttgttatggaagttgtttcagagcaatccgtcctcacctggctgctcgtgataaccacctgcgagcttatgaacaaaatacagattaaaaatatacactagatcagactctctggatgtttgggctcagaatatagaatttttaaaaatatctcacatatatataaacatacacatattcatacatgtacttttttttttttctaaacttccagaccactgtgatgcagctagctgatctagaaaccggtgattgagatcaagtgttttgcagaattacacttttaaaaataaaaatgcattgtcaaggttatctttttttcagtttcctttttacccttcttcagtgaagtgatttaaaaattaaagggcattgtaattaagatgtatgcagtcatgcgccacatgtgatgttttggtcaattatggacccatcaaattctaatcttttctatgttcagatacacaaatacttactacttttactgtatcttttctgtgtttagatacacaaatacttaccactgtgttacaaggcctgcagtattcagtacagtcccatgctgtacaggtttgtagcctgggagcattaggctgtagcatacagcctaggtgtacagtaggctataatatccaggtttgtataagtgcattctatgatggttacacaaagacaaaatctcataatgatgcatttctcagagcctatccccatcattaagcaatgcatgactgtaattcatctaaatgtaatttgatagagctgttacaaagtaattgagttaatgcttgtttttctgagggatttctttcatctttacccacatttactggaatccttgaacatttttcaaagctgtgccagattggaaacttactcatcactgcttttttcccagaatagccatctcacccaggatttgtgtatacgtggatctcgaggtcctcagcactgagacaggcttgctcagacaccccttagaatgtcacccagggtgggtgggcaagtgtaagacattgcatgagcttctcaacagctgtgtgatggtgacataatgagacatagaatggttttcttatgaaatagctggacatgcagagaggtcagatgaataataagctcacacctgcgtgcccctcacccagatattatttaaagcaaaaaacatcataaatacagtcaaggttctctatgttccccttctccgtctcttctctcctttccctcctgcctgtacaaccactgttgtgaatgttaatgattgtctttgtagcttatatttctgaactattactatacacgttcaaaaacaacatgtatattttttctctggttttaatgtatatgtttggtcactatcattttataacttgctttttgtagtcaccattgtttttgaggtctttattgatttgatagatttagttcattctttctcactgctgtaccctctttctttgtataaatataccccagtttatttacccactccttattgtaagcctttgtttctagttttttactccttgagagaaggtacagtgagtatactcatacagtgctgctcaggcacctgggggttttccaagcttgcagtgtttgccaactacagtttgggaccttttagtgagctatgcttaataatttagtggataatgacccacgtcttaaaaaactaaaaatattagagtgttattgtatatgttaactgttgcgttatgaaactattattgcttttttttttttctttttgagacagagtctcactctgttgcccaggctggagtgcagtggcacgatctcggctcactgcaacctccacctccacctcacagcgtttctcacagcctcccgagtagctgggattacagacctgcaccaccacacccggctaatttttgtatttttagtagagacggggtttctccgtgttggccaggctggtctcgaactcctgacttcaagtgatccacctgccttgacctcccaaagtgctgggattacaggcatgagctaccatgcctgaccaccattgttgcattttatattaaaaaaaataggtgctttgggaggctaaggcgggaggattgcttgaggccaggagttcaagaccagcctgggcaacatactgagaccctgtctctacagaaaattaaaaagtaactgggaatggttgttgcatgcctgtagtcctagctactcaggaagctgaggtgggtggatcaccttgagcccaggagtttgaggttcaatgaactataattgcaccactgtgctccagcctaggtgacagagcgagaccctgtttctaaatatacgtgtgtgtgtgtgtgtgtgtgtgtgtgtacatgtatatatgtgtgtaaatgtttgtactgaatcacaagataaaatttatcattgtgggtcatggtcaaaagagtctggaaagatatagagatacacctggacgttaagtagctggatggttgtacatcctctcatttttattagctgttgccacagaacgttcctgctgttatatttcactttgtacaacttcctggcctgcagatcagatcctttggccctacatttctgtgtgtaatatttcactcttttcttatttcttgcaatctaagttttgcgcctgatcaattagcttatctcatgggtttgagactgttacttagtaaaagttcgagttcgtggtaaatgaatgaatgggaatctcagtccatgtaccagtacttactggatgtctaggatgtgcctggggccctgtgtccttagcagcttgaatgctgttttggaggaagatgagattccctcacatatctagagaataatcaggttttttttgttttttttttttgaggtggagtctcgctctgtcgcccaggctggagtgcagtggcatgatctcagctcactgcaacctccgcctcctgggttcaagcagttatttgcctcagcctcccaagtagctaggattacagtcacgtgccaccacacccggctaatttttgtgtttctagtagagacagggtttcaccatcctggccaggctggtcttgaactcctgagctcgtgatccgcccaccttggcctcccaaagtactgggattagaggcatgacccactgtgctgggtgaaaataatcaatgtttaacagcaggtggagttacatgaaaggagagatgggtattggctaaagcagttgcagttttgttttgtttttttctctaaaaagattggctttaggtcggacacggtggctcacgcctgtaatcccagcactttgggaggctgaggcaggcagatcatgaggtcaggagatccagaccagcctcgccaacatggtgaaaccctgtctctaccaaaaatacaaaaaattatccgggtgtggtggcaggcacctgaaatcccagctactctgcaggctgaggcaggagaatcgcttgaacccgggaggcggaggttgcagtgagccaggactgcactactgcactccagcctgggtgacaaagtgagacttcatctcaaaaaaagaaaaaaagattggctttgagccttggagactaaaatgggatttagagaagggtagaaggacagcatttcagtgcagtcagaggattagaaaaggaatgtggaggtgtgacaggtcccacctaagttgggaagagtgttgcgagataaagatgtaaaatggcaggtgtcattgctggcctcagctaaccctctgcccatgtggaaggctaggtggccatgtgtgttccattttaacgaccccacacccatagcccactggatgagaggaggaacctcacacaggaggaatccgtccactggctagagtattaatgggttaattagattatgtctcgttaatctgaaccaaatcctgcagactgtgctcattcgagagtaaatacttcagatgagtgagactcagttcttggggattgagctgccatttccgtttcctttcttttttgcctccctgtctgttgcagtagtaggtgtggtgaagatggtttgactgcatcagtgcagttgtgcaagttcatgagaatttatgtaacttagtagaagcaccacacttccttttctgtgtataagaaaggatattaagccgccttttgcaatgattgtgtatgttaagtaactttccaaaaaagttggcttttccttaattaaaataatgttataagcaaatttgaaaacaaaaaagaaaaattcacctgtagttctcactcagaaattagctattgagaactctccactccctttctttaaaaaaaaaaatagagattacatgtaagcttttattagttactacttaataatatacttataatactttataaatgtaggtatgccatgaaaattgtagaatataagtggggttctttaaatgataaaacgtttagccatttctggcttttgcatattgttaaaaaaaaaaacccagacattgttggcttattgtaccttactatcttagttgaggcaaccactttgtaagtagacactgagaggtataattgcagacaagaggactctgcatacctgtttgcagaagggagcttctgtagacttccctgatacccagttgggactggtaactatgttttgaacacaaagcatacgtttggttctggtgaatttagacacacgtgttgtttttgttatctgttactgcatatcaggttatccccaaacatagttaaacccataacaaacatgtattttgctcctgcatctgcagtttgggaaagctcagtgggaacgggttgtctctactctgcactgcatgtctggggtgccttgaaggctgaggttagaatgatcagagagtcccttactcaggggcctggcagtaagtgcagctgtcacctgagacctgggcaggggcaggggccaggaccaagacacctacactcccttttccacgtggcagtgtggcttcttttcagcaagggctgggttttgagagttagcatcctcgctcacagcagacctgaccagcgggaggaagctgtgtcatcttttgtatttgggtcctagggctgcgtacaaattaatacagactagatagcttaaaacaacaaaaatgtatacttttacagttttgagggctagaagcctgaaattcaggtgccagcagggctgtgggaggacactacctcgcctctctggcttctagtgtttgctgacacctttgacgttcctcagcttgtaagtgcagttttgtgcaatttccacctcacatggcctgcttgcctctcagtctttcttttcgcctcttctcctcctcttataagaacaccagtcatattggatagggcccacctagcgacctcattttaatttaagtacatctgcgtagaccttgtttctttttttttaaatttatttatttatttatttatttttgagacggagtctcactctgtcgccccaggctggagtccagtgatgtgatcttggttcgctgcaacctccaccttccaggttcaagtcattctcctgcctcagcctcctaagtagttgggactacaggcacccaccaccatgcccagctaatgttttttgtatttttagtagagatggggtttcaccacattggctaggctggtcttgaactcctgacctcaggtgatccgcccgcctcggcctcccaaagtgctgggattacaggcatgagccactgcgcccggccaaccctgtttctaaatgaggtcattcatgggctccttcacaggttcaacatggacatgaattttaggtgtacactgttcaaccgacggccccttttgttgaccttgccttggaaatgagtgtggtcacttctacattcattagaagcaagtcactaaggctgccccgaatttcaggggaattggactccccctttgggagttagtgtcaattaatttgtggtaatgtttttaaactaccacattcgtgtgcatagaaataatcttcacgcaaccaccagtgaaatactgttttcttttttacagattcatatatgtgtacatataaaacaggtttttaaggggcctaactagaaacagatacttgggttttagtttttggtagaagccaatggagattcacttgtaaaggtgtgcattctctcctaaggagggcacagagtggtttaattcattcttttatgttgttaacacaggctgattaataatttgggtctgggccaggcatggtggctgatacctgtaatcccagcactttgggaggccaaggccggtggatcacttgaggtcaggagttcagtcagcatggcgaaatgccgtctctactaaaaatacaaaaattagctgggtgtggtggtgcatgcctgtaatcccagctacttgggaggctaaggcaggagaatgacttgaacctgggaggcagaggttgcagtgagctgagaccatgccaagcactctagcctgggtgacagcgagactccatctaaataataataataatagtaataataataatttgggtctgaagacttccaaagatcctgggtcccctcttggctaactgctgttcagtggccagtagtggccacaaaggcttgggggtggcatcacctgccctctgaaatgcttggggaagagtctgggagaccctgaattacttactagcacttcgtgaagggaaaggcacatcttcctgctattgtgttcatttttgcttgccaaaagttcagtcacaaatagcttcattttcagcatttgcacttgtaacattctcgctcggctggtttctcgcagctgcacatccactttgacatttatactttttacttatttgttaaaatatgtgcattaatattgcagaggtgcaaaggtaatgttttagcaacagttcctttgtcatgaaaatagagttcttgtatctttcctgaaggggagcaactgagttaaaacaaaaagattgctgagtggaagaacagaggtgttggtgacttgcttatcgttttgtgtccagaagaagaaaagcttaaagaggcagtgggaaagtgcagggggcgctcagcctcactgttgtcatgcttgcctgtgtgacctgtacccatgtccaggtggtttcagggagctgcccggtttctcctcttgcacagtaacttggggtacgaggaggctctgaggtgtttacagtgcttttctcttgtaaagagctggttcatggagtgcgttcttgagtgtcttctgagcctgggatggggtcacttccctcaaatacaacagcatttgtttatgagtgacttttgctgaaagattttgcctcttcaaaataaaataattaacaagtctggtcattggtcctacttgagagtttcagagtgcttttgtaacatgaacatatttatttattttctggagacagagtctcactgtgtcacccaggctggagtacagtggcgtaatcttggctcactgcaacctccgcctcccgggttcatatgattctcctgcctcagcctcccgagtagctgggattacaggcaggtgccaccacgcctggcttatttttgtatttttagtagagatggggtttcaccatgttggccaggctggtcttgaacttctgacctcgtgatctaccctcctcagcctcccaaagtgctggggttacaggtgtgtgccaccgcacccagcccgacatgaacatatttaatttctaacttcatttctttaggagacagtcattcttgtcgcttgagacagaggggaagagagtgagagccagagaggtcatggaaggctcccggcacctgagagtggccggcgtggggctgccgggggctgccaggtctgctcgtcacactggccccaccagactgcattctcctgtggccagatgcaattctcagagggttctggtgtcttctctctgggccagctttgcttgtgcacctgcgaatgtaatgattgtcttctgggggaaccaaagcgatcttgtgcagataaaagtggtgtctttgatttttatcacctttaatcgctgtgattgatgaatccagagttctagagcagcttttctgtttttattctcaccgattttccgggtccagttctgtcagtccgttcagtatttgttctgttctgccctggcctgtgcccagtggtggggaggctgtgttcattgcacatttaccattgagtgctggacaaagatgaggaagtgagtgtagtggggtcagtgtagacagagaaaccacccagatattttaagcaggaaggatttgatacagggaaatagatactgtaagctgtgggaagggcctgcattgaggtggggtggctctcaggcactatctcaggacctgcccctgtgcccagcgtagagcgtgagaccagcggggttctgctgcagtgcaggcccagagtcaggggcaccccactttctctgttctgcacctcccacaccctcactctgttccacattctagcctccagtaagtgcatctgattggaggcagaatcccactggaaatgattctggaaggtgcattttagcttccgagcctttgtggttcaggaaagcacagcaaaaggcgtgtggaaccgacgtggaggagccgatctgctgcatcccccaccaggcaggcggctcaagggccatgggagtcagcagcgctgtcccccacagtgtctaacctggaagggtgcctagggaactgcgagtggctgggcccgagcagagtgtgatgttggggtgcaggagtttggacttgagtttgaaggagtttggacttgagttcaagaccggggaagccgtcatagggtttaagctgtgatggagcagtgtggtcagatgtgggatttaaaaggcaggccctggccatgtggggagagggctgggtggggagcagggcagagaggaggcagcacagtgaggcagctcttgaaatacttggagtaaaaagtgatgttgcactgaatttgggcaggagtaggatgagctctgcaaagtgagcagatttgggaggcagccaagaggagggatcaacaggccccgtgacagatgggataggtgcgggaaagtgtgaattgagcagaatggaagcaggtcagtaaaatccattgaaaatttgctgccctgaaaataaaagtgtttgtctcagaagacttctagtctttttagattggaaattctccagtttgtcaattggattcaaccttcaaatacaggtttataattaaactcaagtaatttgcttcccacacttaaaaatacatttgtaggagaagcagcaaacatgccattcaggtagatgtccttcactgcagactgtgcctcagtgggtgtcctagtgctgggtcctcacctcccacctccagggaggggcctgagcctgtcatgggatgtcctggacctcaggagaagactcagatgcctatttgattcaggacgtggtttgatttttaaacatgccatggacaagttccacatggaaagcattgtcgtgcaatgtgaggttgcccacgatggttagcggctgaccagacgaggcatggatttcatgtgcattgatctctgttcctaatgggacagaaccaaatcctgcaggtgtcctcgctcttggccttggcttcatacgcactagaaagagcgttggcgtgtttgattgccatagaaggcgtaacggaggctttgggttttgctgttgtggttggcttttgtcttgttctctcttcacacagaaaattgcttgagtgacttggaattgactccgtttaccttctgtaattcttaacccaacccaagacaggcgtttgatgggaaatacgtaaagaaaataggaggtagctgttttttcacttaccgtctctggcagggatctgcagtcattcatgtttaagaacaaacagtaagtagggtctgttaggtgccttgactgtgacgctgtaacctgtacacttggttcagttttagtttctctttcatccccaaaggtctgtgtacgcctttttacctgtctgcagaaagtcagaatgtacaaaagtgtctcctcttccgcaggtgggagcagggaagctgctaggattcccgtttgaaaatggaaacccccagtgccctcaggtggctcagccctggggtgcccattgagattgggagtctgcagccccaggcctccagcccttgcacagggcatttcctggctggttaaagaacagccagggaacgaatatccagattgctggtgctgtgttgtaatccggcattcttcttcctctaaaaacggagctggagcttttcaagcccccgctcctgggtcaagccctgttggcagtgtgtggggtgctcctctggttcggcagctcctcccctgccatctccttaagtgttcaggagtgagagcagcgggaagagctgaggggcagcttgggtggtgctgcagaggggacagaccagtgtgagctgcttcaggggcagccaggttccctggcagctgggtgatgaggagaccttcagaaagatccagggtcagggactaagaagacaggcgctcgtccactgctagagaagcctcaaagtgcattctggggttcccactgtccttcaggtttggatcctcctggaagttttatttgacccaagtcacgtgtaggttagaggcacaggggcaggctgctaccaaaggagacagtgtagcaggttctcagaggcaagggcagccccccccgtttgcttctcctcctttttccttcctcctgcctcccctccctccatccttcctcttcctttctgtccctccacccctctcccttcctttgtccttttcctccctccatcctcctcttgccctcctcccctccagaccctgtctctctcctcttccttccatccctttcctccatcctactctgtcctcttttcttccctcctcctctccctccattctccctcctcctcttcctccctcctcccccgtcctcccttccctctgtcctcctttctctccctctcctcaccatcctttgctctctccttcctccccttcccctcctccccatcctctctcctccctccccaaagcacctgcagtgtgccctgtgcaggagatgctgggggagggtgtgagccagtcttgggttcaggccccctcgccatcaaccctgtgcttatgtctgtgatggccaccacacctcatggaccttgttctgccaagctgggcacccgggtgaccccagggcgggtcctgggagcatcctgcactctcccagcgaggtgctttcccacacccgccaagctgcaaggtggatggggtgggaggatgttaccttccctgtgacaacacagggatgtgttggcaggagctattctgggcgtgtagcaactgtgtctgtgtgtcctacgtgttttcctggatagatggtgttttctgaagctttgtagaaagttacacttaatctcccgacgcccttccatttaaacttggtgacttgtgcacactgtcccatagctgcaggtccagacccgcctttctgcccatctgggtcccctgccctgaagcctcctcagctgctctctgaccaggatcctaccatttacgctgacatttgactctatcccctaaacctttagccactcctctcctcctgttggtattctcacactcagttcaactcacactcacagacactcattcacactctgacccatgcccccatatttgggttcccacttgaggtgtctgtaaggtgcccctttaaataaaactcagcaggccaccctgcttaggttccactttggggaaacagaggcacagagaagttaaacgaagcgtccaaagtcaaggagcaaattagcagcagatcccaaaccggatgccacagtctcaggtcttcaagaaaatctctcccatcccggtcttccctctgctgccctctttctctgttactcgtttttcttttctttttcctccctttatcctcattagtgagcttcgaaggccatttgtcatagttgataattgttgatggagctatactatgaaaagaaaattgcttaattttaggagtgaaattacaaatgagaaatactgcagcaaagacctgcccttctaaaagttcttgaatctacctcaaatttctccagacaacaggtttatctcagcatcttctaattcacctttcttttcctctaaaaccagccttgaagttaagatttttaaaaaattgtacttggcagatttaattatcaatgtggcaagcttatgtgtgcctgtgtgtgttggctgattgtagaaaaccgtaaacatgaaaaggtagacagagtgacccagtgagcccccacacatccagtgccaagcttcagcgattacaactcgtgccgttttaaccatgactatttcagcacacgtcctgaaaaggtgggattgtctgtctctcatagccacaataccatgatcataccaaaacatccaggaattcctcatgtcaagtattcagtgtcagtcacaacatttctgtgttgtgtaacttcttcttcttcttcttttttttttttttttttttttttttttttttttttttgagagagtttcgctcttgttgcccaggctggagtgcaatggcacaatctcggctcaccgcaacctctgcctcccaggttcaagcaattctcctgcctcagcctcccaagtagctgggattacaggcatgcaccaccacacccagttaattttgtatttttagtagagacggggcttctccatgttgaggctggtctggaactcctgacctcaggtgatccacccgcctcggcctcccaaagtgctgggattacaggcgtgagctgctgcgcccggcctgtgtgttatgtaacttcttaacccacaaaacataatcatgtcatctttaggggcttgtggactggactagtttcctcatcactttgtgcccttgtccctatgggaacatgcatccagcgacccaccatttggctcagtggtggctgtaggcatgaagcatttgggagtcactgcttgtcttgttgtttgtgtgtgtgaatgagtgtgtgagtgtgtaatcttagcaggatgccataaatgacttgtttgcaagtctctgcctctctctccttccctctccccgctttccctgtctccctccccttctctgtctccctctttgcccccaccttcttattcctctggaacttgctgtccctagctgcaggtggctgtgagcacttagcatgtcccagctgagatgtcctacaagtgtaagatatgctggagtgcaaagattgagtgtgaaaatgccaaatttctcaataatttttatgtggaatacatcttgcaatgataattgggatacattagggtaaataaaatattaatttcacctgtttcttatttttaaagttgggataaaattcacataacatacaattcattattttagccattttttaatgtatcatacatctcagtggtttgggtatgttcacaatgccatgcaactataaccactgattccaaaacttttttttttttttttttttttttgagatagactcacactgtgtcacccgggctggagtgcagtgttgccatcttggctcactgcaacctccacctcctgggttcaagtgattctcctgcctcagcctcccgagtagctgggattacagggattacaggtgccaccatgcccagctaatttttgtatttttagtagagacggggtttcagtatgttggctaggctggtctcgaactcctgacctcaagtgatccacccacctcggcctcccaaagtgttgggattacaggtgtgagccaccacgcccagccagaacatttttatcaccccacaaagaaatgtgtacccattaagcaatcactccccatttccctcttcccctagcccctggcaaccactaacctgctttctgtctctagagatctgcctattctggacgtatcatgtagtatagaatcatgcagtacgtggcctttgttttgtgtctggcttctttcgcttagtgtaatgtttccaagcctcatccgtgttgtagcatgtgtcggtaatacttctctcctatggctgaacgatagtcccttaggtggatataccatgtttgctttatctgttcgcctgttgacggacatttggattgttaccactttttggccttcatgaataattctgctgtgagcatttgtggacaggttttccagtggggatatgtcttctttctcttgggtgtacacctacaagtgggattgttgggtcatatggtagctctgtgttgaactttttgagaaactgacagactttcacagggattgcattttacattcttagccactgtgtattgggggggggttctagtttctctccagcttttccacattcttgtcaacacttgttattttccttttttatttttatttatttatttttttgagacagagtctcactctatcacccaggctggaatgcaatggctcaatctcggatcactgcaacttccgcctcctggattcaagcgattctccctacctcagcctcctgagtagctgggattacaggcacctgccaccacatccggctaatttttgtagttttagtagagatggggttttgccatgttggccgggctggtcttgaacccctgacctcaggtgatccgcccgcctcggacttccaaagtgctgggattacaggcgtgagccacctcgccctggctatttttttttttttttttgagacagagtcttgctctgttgcccagtctggagtgcagtggcatgatctcagctcactgcaacctccgcctcctatgttcaaatgattcccctgcctcaccctcccaagtagctgggactacaggcacataccaccatgcctggctaatttttgtatttttagtagagacagagttttgctgtgttggccagttctgacctcaagtgatccacctgcctcggcctcccaaagtgctgggattacaggcatgagccaccgcgcctggcacctttttaaaaattatagccatactgatagatgtgaagtggtatcttctcattttgatttgcatttcactagtgactaatgaggttgagcatctttcatgtacatattggccatttatgtctactttagggagatgtctttgcaaatcttttgcccaacctgtttctttttacttaattcaatgtggctattagaaaatttttaatttccgggtacaactgacattttatttctattgaatagcactgttttggatagcaccattttgaaattgctaagaggtaaaaagattccaatgaatacttgatattcttcccttcattcttatgtcattcctaggttactaagattaactttttcattctaaggtagtaacaggagtaactctgaagcagtaacaggaatttcagtacaaagaagttttccaggcatctgattgcagagggttgacttggattagataagggtcctttttaaggctgaaagttaaggtggactcacgccctcaaagcaggttggttattttaatgagccaaagaaatacagtagttaagtcaccttctggaggggacagctggcttcagccaggctcggtggacaccctggccctctcgggacagagccgccagtctccagtgtttctcagggatgtgactgaggcccaggagggccctgcttggctgtggggtgcgcactgccccagcaccttcttgccctccacgctcacccagggccgcagcatgcctatggctccgcttccagccgggagccctgaacacgggtgtgcagacccaccctaaagggtggcccaggccccacgctaggcaaggctgacaaggaaccgaaggcagcatgtgaggcctctcctgggagtggggggttctgtttcccacagtggcctcagctgcaccccggctcgggtgagcccacaggtgggagccgggaggcactcctcccaaacactcctctcagaccataaagcactcctgtttcactcaaaaaaaaaaagtcaccttctactttttacagtgtgatcagcatccttcttccaagtgagtgtttcaaatattagtatttttaaaattagtcactacatcttattgagctttcataatgtgatactttattgtagatttgttgctttgaaaacttatgaaatattgagcttatttttctaggaatctaatacagaaaaagtttgatccaaatatacttgtttcccagaatggaatggtcataataaatttgtacatgggtaattcacccagattctttgaggtttagtttccagttaatttctggtggcgcttattgcctccttgtctgtgtttttaggggacagcttacaaacaccaggaagtacagctacccctaaagtccctctgcaccaaaatgtgaaaaacaacctggctgtttagagtagaatatataattcatttaagaacaattttgttgaattatggcccagcaccatggctcagtcctgtaatcccagtgctgcaggaggctgaggcaggaggattacttgaggacaggagctgggggctgcagtgagctatgatagcgccactgcactgcagcctgggcaacagagtgagactgtctcttaaaaaatttttttttggctgggtgcagtgcctcatgcctgtaatcccagcactttgagaggccaaggcgagcagatcacgaggtcaggagattgagaccatcctggccaacatggtgaaaccctgtctctactaaaataaaaaaaattagccaggcgtggtggcgggcgcctgtagtcccagctactcaggaggctgaggcaggggaattgcttgaacccgggaggtggaggttgctttgagccaagatcacgccactgcattccagcctgggcgacaggcgagacttcgtctcaaaaaaaaaaaaaaaaaaaatttaaataaaaaataaataaaaatcattttgtcgaactcagggttttttcttctttataatatgttgaaccctgaaagaagctaagaagcattttcgtagtttccctgaaaatgattcaacaaaatttctataaatataaaattatatataaaagatcttgatggcattttatgatcctttttttattttcctaagtggaggctgtatttttccatgcataagtaagtagataggggaagataacaaaaatatatttttttggaagaataaagtcacatggagacagaagtatctttagatatttcaaattgcagtagtatctgaaccctcagatagttgtaagcactaatgtgatttgggtcgggaggggagctaaggggaatggacagaaaaggacacatcaaattgccataattttcatagaaattatttacccaggagatgtgaaagatattatttacccaggagatcaactctgggggtaaacactgtgtaataatttaagtgtttttggtttgtttttgttttttttactgttcggttttcactctgatttccagaggaaacatggttttcacaccgatgcaaggtggaaatttcagtgtacagatcagtgatgtgaaggatattcacgctgttgtgcaacagatctctagaaattaattctgcaaccctgggtctcgatgctcactaaacaccaatttccctcccccctctcctatccctggacagccacctttctattttgtttctgtggttttgatgactttaggtacttcatatgaatggaatcctacagcatttgtccttctgtgactggcttatgttttcacttagtgtaatgttgtctgcattcatccatgttgtagtatgtgtccgtatttccttctttgtaaaggtagcataatatttcattgtatgtgtatgccacattttgcttatccattcattcatctgtgaccccctgggttgcattcgcctcttggtaactgtgagtgatgctgcagcgaacatgagagtgcagacatctcttagggatcctgctttaaatgcttctgggttcatacccacaagtggggttgtgggatcatatggtaatcttttcgcttttcacgcagagcgagctgtttccaagagtagcaggtgctgcgtaaatctgattcctactgtgtggatcctcctttaatttcctagtctctctccccgcaaaatccctgatgtacagcatacctgtacacaccccttcggattatctttccctgagggatgacttttacaggtattatcgccataacttctctcctgttgccccaggaaatgttccatatcctcagagctcccaaataccagatttgtttgatgcgatttcatttgtgggcatgcatccctgtgttcataaacaccttactccaaaaggctgttgtttgcctaagccttgtttctgtccaggcctgagaaaacaggatggttgcatagaaaggtcccagaggaggaagaggcactgtgcttgccatcgtccaccactaagcaggaatgggacacaaatgtgtctccacgttatgggcagcatgtcaagtaatggattatttgcaaactttgtggatgatgacacagtaagaaatgtttgcattgtggcccagcacacatacatgctgtatgtgtctgtctgtgagatggcatttacctgtgcagtgcactctgatatttaatattctgttccctgcttttttcaggcttttgtttgtttttaacattaggtacagcctactacgttggtgtcctgcttgggtttgtagcaatttggcaagtagctttgaagaacttgctctctggagcacacttgttggagctggagtttggctttgcctcttagtaggcgggtgaccatgagccatttaagcagccagtgcctccgtttcccttttcctaaaatgtgataatacactactacctcacataactgtcaagaagaatacatgaggccgggcgcagtggctcacgcctgtaatcccagcactttgggaggccaaggcggccgaatcacttgaggtcagaagtttgagaccagcctggccaacatggtgaaaccccatctctactcccagctacttgggaggctgaggcaggagaactgcttgaacccaggaggtggaggttgcagtgaaccggagatcgcgccattgcaccccagcctgggcaacagagcaaaactctgtctcaaaaaaaaaaaaaaaaagtcaatgagtgagtagatgtggggtgcttagaagagctcctggcataaagtgacttgtcagggcatactggccagttgttacattgagcttgacactcattcttcctacttttcactttgtcgttgttatctggattctgtgtggcttctgtcctcctctactgttgactttcccagcatggtgagactgtgtgtgaaaccctccagttcctaagcttatagactctgtggacaggagaaggaggccagaagttaaagtgcatcgagaggtcttgttagtggaatggccactgcattcccttttcttttttagtcagcctggaatttggagtttgagctctgaggcagggagacctgggctggtgtggagtggagtggtgcagagttgtgcagttgtgagctggtgtggtgtagagtggtgtggtgtggtgtggtttggtttggtgtgtgatgtgtggtgtatggtgttgtgtggagcggtatgtgatgtgtatggtttggtgtggtgtgtgcagtagtgtgtggtgtgtgtggagtggagcagtctgtgatgcggtggggtatgtgatgtgtgtggtgtgtgtggagtggtgtgccgtgtgtggagtggtgtagcatggtgtggtgtgtgttttgtagtgatgtttggtgtggtgtgtgatgtgtgtgtggagtggtgtggtgtgtggtgtgtgtgatgtgtgtgtgtgtagtgtgtgtttggtgtggtttggtgtggagtggtgtgttgtgtggagcagtgtgtagtgtggtatgtgatgtgtgtggtatggagtggtgtggtgtgatgtggtttggtatggaatggtgtgtggtgtggtgtggtttggtgtgaagtgtgtggtgtggactgatgtgtggtttggtgtgtgtggtgtggagtggtacgtggtgtggagttgtggcgtggtgtagtgtggtgtgtggcctgctgtggtttggtgtggtgtgtggtgtggaatggtgtgtggtgtggtctggcgttgtggtgtggagtcatatggcgtggtatgtgtggtgtggagtggtgtgatgtgtgtggtttggtgtggagtggtgggtgtggtgtgtggtttggtgtgaatgtgtggtgtggagtggtgtgtggtttggtgtggtgtgtggtgtggtgtgtgtggtgtggagttgtggcatggtgtagtgtcgtgtagagtggtgtgtggtgtggtctggtggtgtgtggagtcatatggcgtggtgttgtgtggagtggtgtgtgtggtgtggtttggtgtgtcgtggtgtggtttggtgtggagtgctgtgtggtgtggtgcggtgtgaggttgctgattagccctctgggtgcccagagcctctgctgtgtcgggcaggaggaaggagggcctggctggccctttcctggaggagcagcgtttcctgggctggagtggggtctggacccgttggcttttgctcgggtccagaggcggtggtggggagcggatctctaggtcggcctgttccttttcagcagcagacatgggagggcccagcctgagcgctgagtgcgagctccttccctgacagcagcgctgggttggggacaggccccatcattggtttgtatcacatctggctgtcaggctgaggtgttggtttgggtgtttcatgcgagtttatcttcgttgcaggcggttttggtgaataacatcaccacaggtgagaggctcatccgagtgctgcaaggtaagttccgctcgctcctccacaccaggcactggcctttgaggaggaaactccctttctctccttctctaggcccaggtgggtctccattataatctcatggcggatagtgtcatgagtcattgagcaatctttattctttttgcctaagtctatctccttaagaggcttttccttttaaaaaaaaatattgccaaatacattgcaagctgttaggtacagaagagttaagagtgtcactcatgaatgtgttaagagatagtatttatgataggtacatgttctgttatatatacatatggtatacatgtgacctgttaatttggtcatgctgaatttagattgtctgcatgaaacttagaaaaactgtccagcccaatttaattccccctctttgccgctctgactcaacttggcagctggggattggtcttcctttgagtccttctgaagcagccacagagcaggaaatggggtgctgtcctttgtcgggggctccttccactgtgacaggagtgacaggagggtcagcagggtccatgctactgggctaaatcatctgttgggttgaataatttttactctaaaaatgtggttactgggaagttaaaaattccttatatgacttgcattataattcttttggtcattgctggtttcgaattctagttctaagtcaggttctaagaatattaaaaagtcttatgtgaaaaggggtcactttgtgaaatgtgtttgtgtaaccctacgtttcccacaaagttgaagaggctgcctggctgcgggggtgggagttggggggtctcacataaaggttcagtttgacagcggttttgatagagcatacatgtcaagtaactccaccagagtcaacacagggagcatattcatcacccccaaaagcttgcttgtgcgccgtggtgatccacttccctcaggcagcctctggtctgccatgtagactagtttgcatttttaataattgggtgcgtgccccagattcataaagcaagtccttagagacctacaaagagacttagtctcccacacaataataatgggagactttaacaccccactgtcaacagtagacagatcaacgagacagaaagttaacaaggatatccaggacttgaactcagctctgcaccaagcagacctaatagacatctatagaactctccaccccaaatcaacagaatatacattcttctcagcaccacatcgcatttattccaaaattgaccacatagttggaagtaaagcactcctcagcaaatgtaaaagaacagcaattataacaaactgtctctcagaccacagtgcaatcaaattagaactcaggattaagaaactcactcaaaaccgctcaactacatggaaactgaacaacctgctcctgaatgactactgggtacataactaaatgaaggcagaaataaggatgttatttgaaatcaatgagaacaaagacacaacataccagaatctctgggacacgtttaaggcagtgcatagagggaaatttatagcactaaatgcccacaagagaaagcaggaaagatctaaaattgacaccctaacaccacaattaaaagaactagagaagcaagagcaaacacattcaaaagccagcagaaggcaagaaatagctaagatcagagcagaactgaaggagatggagacaaaagaaacccttcaaaaaatcaatgaatccaggagctggttttttgaaaagatcaacaaaattgatagaccactagcaagactaataaagaagaaaggagagaagaatcaaatacatgcagtaaaaaataataaaggggatatcaccaccgatcccacagaaatacaaactaccatcagagaatactataaacacctctatgcaaataaactagaaaatctagaagaaatgggataaattcctggacacatacaccctcccaagactaaaccaggaagaagttgaatctctgaatagaccaataacaggctctgaaattaaggcaataattaatagcctaccaaccaaaaaaagtccaggaccaggcaattcacagccgaattctgccagaggtacaaagagctggtaccattccttctgaaactattctaatcaatagaaaaagagggaatcctccctaactcattttgtgaggccagcatcatcctgataccaaagcctggcagagacacaacaaaaaaagagaattttagacctatatccctgatgaacatcgatgcaaaaatcctcaataaaatgccggcaaaccaaatccagcagcacatcaaaaagcttatccaacacaatcaagttgccttcatcccggggatgcaaggctggttcaacatacgcaaatcagtaaacataatccatcatattaacagaaccaaagataaaaaccacattgattatctcaatagatgcagaaaaggcctttgacaaaattcaacagcccttcatgctaaaaactcaataaactaggtattgatgggacgtatctcaaaataataagagctatttatgacagacccacagccattatcatactgaatgggcaaaaactggaagcattccctttgaaaacaggcacaagacagggatgccctgtctcaccactcctattcaacatagtgttggaagttctggccagggcagtcaggcaggagaaagaaataaagggtattcaattaggaaaagaggaagtcaaattgtccctgtttgcagatgacatgattgtatgtttagaaaactccattgtctcagctcaaaatctccttaagctgataagcaacttcagcaaagtctcagaatacaaaatcaatgtgcaaaaatcacaagcattcctatacaccaataacagacaaacagccaaatcatgagtgaactcccattcacaattgcttcaaagagaataaatacctaggaatccaacttacaagggacgtgaaggacctcttcaaggagaactacaaaccactgctcaatgaaataaaagaggacacaaacaaatggaagaacattccatgctcatggataggaagaatcaatattgtgaaaatggccatactgcccaaggtaatttgtagattcaatgccatccccatcaagctaccaatgcctttcttcacagaattggaaaaaactactttaaagttcatatggaaccaaaaaagagcccacattgccgagacaatcctaagccaaaagaacaaagctggaggcattacgctacgtgacctcaaactgtactacaaggctacagtaaccaaagcagcatggtactggtaccaaaacagagatatagaccattggaacagaacagagcccacagaaatgataccacaaatctacaaccatctgatctttgacaaacctgaccaaagaaatggggaaaggattccctatttaataaatggtgctgggaaaactggctatccatatgtagaaagctgaaactggatcccttccttacaccttatacaaaaattaattcaagatggattaagacttaaatgttagacctaaaaccataaaaactctagaagaaaacttaggcaataccattcaggacataggcatgggcaaggacttcgtgtctaaaacaccaaaagcaatggcaacagaagccaaaataggcaaatgggatctaattaaactaaagagcttctgcacagcaaaagaaactaccatcagagtgaacaggcaagctacagaatgggagaaaatttttgaatctacctatctgacaaagagctaatatccagaatctataaagaacttaaacaaatttagaagaaaaaaatcaaacaaccccatcaaaaagtgggcaaagcatacgaacaagcatgtctcaaaagaagatgtttatgcagccaacagacacatgaaaaaatgctcatcatcactggtcatcagagaaatgcaaatcaaaaccacaatgagataccatctcacagcagtttagaatgacgatcattaaaaagtcaggaaacaacaggtgctggagaggatgtggagaaataggaatgcttttacactgttggtgggagtgtaaactagttcaaccattgtggaagacagtgtggcgattcctcaaggatctagaactagaaataccatttgacccagccatcccattactgggtatatacccaaaggattataaatcatgctattgtaaagacacatgcacacgtatgtttattgtggcactattcacaatagtaaagacatggaatcaacccaaatgtccaacagtgatagactggattaagaaaatgtggcacatatacaccatggaatactatgcagccataaaaatggatgagtttatgtcctttgtagggacatagatgaagctggaaaccatcattctgagcaaactatcacaaggacagaaaaccaaacaccgcatgttctcagtcataggtggaaattgaacaatgagaacacatggacacagggcaaggaacatctggggcgtgtcgtggggtggggggaggggggagggatggctttaagagaaattacctattgtaaatgacgagttaatgggtgcagcacaccaacatggcacatgtatacatatgtaacaaacctgcacgttgtgcacatgtaccctagaatttaaagtataattaaaaaataataataattgggtacatgcatacagatggaatcagaccatctgttatcattttttgcctgccttttctctctcagcatagttatttgcgattcgtccatgtcactgtgatacaagtcattcatttctttgactgctgagttgtattccgttatctcttgcctagttggattgtggggtgtgttcagttacgcatattaaagtatcgtttatatacaagaacatttacccctcgtgggtacagttggataagtcctgacaaatagtctcgcagatcaccactgcagtcaacatggcagctgcccaccgctccaggaccccccacccatgccctgcgaagtcaccagtcccctctctgtctaggcccagcacccacccagctgttctcttcgccacagctttgtctcttgagggtgtcacgtgtgtgcttttgggatgagtccgtgttgtgtgtatcgtaattcacggaacgcttccattttatttcactttattttccacctgagactattgtaggtctagtgttgtgagggcccaccttggggatgcctgcatctgtcctggcctgtctgtcctggctgtgtccgggcctggctgctgctgccgcccactgtggtatccgcctggtggctgccttcccctctgccccagcttggccctttgtccgctagggctcttttatgagccaagtcatcagggcagcagggatggggctgattaatttccttaaagaaagccgctctttccctgatgagagtgttggttgattaaatgggcacagggccttggagagtggcttggctgtgaataaatgacgagggaggatgctggcaggtagcctggtggccgagggcagggtgtccagcaggagtggctgcttatctgaccaaacatcaaaaatcagtgttttacagatggaaggatgagtcggccagggatgagggcagggtggtgtgtgtgacctttggggacagctcggggcttatgatgtctacaaaagagacaggcacacagaagcttccaatatacattaaaggctagcggccaaaaaggagatttaagagagacatttgggaaaggatcaagacgcagcttctttcggcttgctgctcttgcagagcactctccacagctggggtttagtgactctggggagggactgtgttttcagctttttctctctcccctcctttgtcccaatctgtccttgccctttatggtctgatgtgtgagtctgcctctgtcatattttggctgaatggcatgacagctgtgccggtgacctgtgcaattccttgtccccttggtgtagaccagttaaagaccctgcagaggaattacggcaggctgcagcaggatgtcctccagtttcagaagaaccagaccaacctggagaggaagttctcctacgacctgtgagtacacctcagagcgcgtgccacagtgcagggtgcacggcacctgggaggcggggattaagctgagatgtaacctccgatagagcatgcaccttctgctccgtgcgggactctgagaaaggcacgggcccctctaggattcatgtcctacacaaatgcacaaggaggccagctctcagcaggaaatgaatttctcagcatgccttaaaatgtaacttaaaactctgtaaggcacaggtgtactggttaagtcaacaacataaagctttaaaaatgtgtttcataggtgctcatgcgtgagctaaatcaaattcgttgactaaaagacattttggcaaaatattgatatagtaatagtttattgcctggcgatcacattgtggacattgttttcttcagacttttcagtgattttcccaatttttacagtgagaatggaatactttgataatcaaaaccaagcaatattaaactattaaaaagtgagctaagccccgcaggaagatagtaaaagccagtttgcaagccagaggataaagttgtgtttattttttcctcataaaaacaatatagctaacgtgtgggaagtttgggattcagagagaaccaaccacccatggcccagccctcatgactgtccttttccctttgacttacctctctccagtccatgcccaagttcacatgaatgtttacttaattgcagtcatcatcaaaaaaatttaatcatttttttacttgcgttatgtacgtgtgtgtgtgtgtgtgtgtatatactttttttttttttttcttgagcggagtctcgctgtcccccatgctggagtgcagtggcacaatctcagctcactgcaacctccatctcccaagttcaagcagttctcatgcctcagcctcctgagtagctgggactacaggtgcccaccaccacacccagctaatgtttgtatttttttagtcgagatggagtttcaccatgtcagccaggctgttcttgaacgcctgacctcaggtgatccacctgccttggcctcccaaagtgctgggattacaggtgtgagccactgtgcccggccatattcttagtcacaaacattttattttattttattttttgaaacagagtcttgctctgtcacccaggctggagtgcagcggtgcaatctcagctcactgcaacctctgcctcccaggttcaagcagttctccagcctcagcctcctgagtagctgggactacaggcgcccaccaccacgcccggggtttctactaaaaccctgtcattggtcaggctggtctcaaactcctgacctcatgatctgcctgcctcagcctcccaaagtgctgggattacacgcatgagtcaccgcacccagccacaaaaattttatttataaaagtaaaattagatagacatgcgatgataaaagggattttaaggataaaaatatccattgccataatttgtctcctaaataatgacaacacattagctatagcctcttttttttttgagatggagtttcacagctcgtttcccaggctagagtgcagtggtacgatctcagctcactgcaacctctgcctccctggttcaagtgattctcctgcctcagcctcccgagtagctgggattatgggcacgtgccaccacacctggttaatttttgtatttttagtagagatggggtttcaccttgttggctaggctggtctcgcacacctgacctcaagtgatctgctcgtcttcgcctctcaaagtgctgggattacaggtgtgagctactgtgcccggccagcctcttattttttaatttttaaatttaaaaaattacattacttgcattatatttaaaacatccgtatagctcctaattgtcttaaaaattaccattttggattatttccttctaaaaggctcatctgtagtttagcttgttgctgggtgtgaattgtcaaattgcattctgaaaggatttgagccatctgtgtggtcaccagcaacctgggagaatcagttgcctcacgtgcattgcgttcttcggcatttccatgttcctccaaaacattgtccacctgccgtaatatcttcctactaactttataaccacatacaactgaaaacatgaagccccaagtacacgtctctgtagaggacatgagcagccagtcaatagaagggaaatgtgattgtcacttgtgtgtggaatcttattcagctatgccagtggttctcacgtgggggcagtcttgtccccagtaggcctttggcaatgtttggagacatttttgtctgtcatggcttacaaggaggctgctactggcatctagtgggtagaggtcagggacactgctaaacatcctataatccacaagacagcttcccacagtcacgttttatctggcctaaaacatatacagtgctaaggttgagaaaccttgagttaggctcataattaaagaattgcatttagacagaaatgaagtacctcagtcttattattcatccttaaagaaaccttaatgcaaatatttccctcatatagattgaaacacaaaaagccataaatggcctcacttgataaatgttggccgagaaggttttgacctagctggcaatcagtcaggatccagtgacagggaaggaatctctgctccccatgtaggaaagcttgggccgaggcgatgggtggacacctctgagctgggctggagacacatgtaggatgcactccttttgctcctggcaggttgatacctagattgaaagctctttctggctgactgtgcctatttcactacttgtgcccaaggccgtgtaccagatatgcagtgcttcccagggataatgttcgtggagtgttggaagcaaaaaaaagctagttattcttcactttctttggattataggcccttttagagaatctgataaaaagtacgaacactttgttagcaaacttataaatggacacctgcctaaagtgtgcaatttgtgcaaattatatgggcctctgaaacatatctgcacgccctcccttaaaacatcctgtctggtctaatccttctatagaaggcagtgccgagaacacaaaagctgatggagaggccaggtttcctgatgtacaaggtagtgttctttccgtttgaatcagtcagcacacatcccactttttactctcctacacctgtggcaggcatcactaagcaatcactgcactccatccgaaaatagccttgcgttctttctccctgaagcacctggagtcagcacatgagatgaaccgctcgccatctcatctccctgctatgaggagacagtttccaatgttgacactggcatataaagtaatacagtgatggtcggtgccctgggtgatgggatcacctgccctgatagatccttgtacttgaacacattccatcagtggtactctggccatcaattgcaccagttagaataatcactagtggccaagtcctgtattcctctccaatttagctccagttagtgctggaatatttgccacttacatgtaagaaaaagccaacctaagtcctcaggaagaaacactgtcacaatctgcatgacctttgtctcagaattgaggatggaggtagtttgttcctggctctcaagttggaacatggaaagccccagttgatctgcaaggctgtgagataaaggctcttcgtacttgattttagcagggctgggagcaggtgcaatcagtacttcccttttgcaggtttaaaggttcagggatagcaaacgacctgctcatttagttctacagtatacagacagctttttgttcgctatgtttcagctcctgtgcactaatctaccacctgtggcttgtatatttgtgagaattgtatttaaatgaaattttcacctgatctgtcagctgttcaaggtcaggaactcggcactgcattatttccatagcacctggttcccttctctgtgtgtggtacattgtgacccagtggtgctttgaactcaagggtatattccaagagtcagaggttgatgtagtactcactcacatttggctctgaaatgcctgcaactcagaaaaggtgagctgtgtggtggagagggcacaacagtaaggagccctggagtctggcttcagtttccacctccctctgaccctggtccatgccagacaaccatgtcaccccttagtattcttatttgcaaaacgagtgggtaattctcttaattacttcatagctctggcacttgtcaaaatactcttaaaataaatccaggcagcaagctgaagcaatgcaatagcaattcaaccgagtgtcctccagttcaagttttgttttgttttttttgagacggagtctcgctctgtcgcccaggctggagtgcagtggcgcgatctcggctcactgcaagctccgcctcccgggttcacgccattctcctgcctcagcctcccgagtagctgggactacaggagcccgccaccatgcccagccaattttttgtgtttttaatagagacagggtttcaccgtgttagccaggatgctctccatctcctgacctcgtgatccaccgcctcagcctcccaaagtgctgggattacaggcgtgagccactgcgcctggccccagttcaagttttgatactacccacttagcacagaccccctaggttaaggggctccctcccatactactgctcccacctcagatgccagccacaagtcttgatgtgtcccctagccaccctcacttctgcctggctggctacagctttagggttacccgccaccccctcagtttgataatttgccaggatgactgtcacatgattcaggaaagctgttttgacttttacagaacagcccagtggtagagtcctaaggtgagggcaggcgccggggggagacaggaacggctgccctgtggagtcagccgcccccatccagtgcatcgttaggctccccagccagaaagctccccaagccttctggtccggagtttgtctgagtgttttatgtaggcatgattgattacaccatcggccacagggttgaactcaatctccactcctcccttccctggaggaggtggagctgaaagttccaactttccagtcatgtggctagttcctctggcagtcagcctctgtcctgaaactatctgacgcccatccttccccacctccaagacccccttattagtataaactcaagtatggtccagaggggcttgtgaatcgccagatatccactcaggaacttccaaggcttttaagagctctgtgccagtagccagggacaaagaccaatacatattttttttattattctacagattgtatgttaaaaaaaaattttctgcctaatcagtaaagttcactgttttagaacaatgggatgatgatttttagtgtgtttcttttggtcatttaattgttgaacacacacccgtgttgccctgtcttaagtgccctcttcagatgaagtgcctgaagcaggaagagggtctgtgtctcttatggaagtggatgtcaccgtccagcagagacacagtcatagacgtcaggcccttcctttgctttctttcaccaaaggagccagtgcatcaatcagatgaaggaggtgaaggaacagtgtgaggagcgaatagaagaggtcaccaaaaaggggaatgaagctgtagcttccagagacctgagtgaaaacaacgaccagagacagcaggtaactggggaatttttgccaagagtttctagaaggtacccctatcttcaggcattttgtttcttttatgtgccgcctggctttctctggattctgccctcctttgcgggcttggctccctgagatataacagagcagaacctggtactgggatgactggaccctaaccaagggttctgacctccagccccgcttcacaagctcagggctttacgggaattatcgtatttaaagctcgcagccagcctgggagagagttgctgttttcctgacttgaggaccccagccccatgggaggggttaagttctgtggccagtgtcacaccacctggtcagtggtagagcccatcaagacctcaggtctggccgactccatgtctcgtgctgtcattccacctcctgtgcagagcacagcccacgaagctgctgcttgaagccttctgggtgatctttgagtagttttttaaaaatatagcagctttattaagatataatttgcattccctatgattcacccatagaaaatttacaattcatgggttctgagtatattcacaaagttatgcagccatcaccacagtcaatttcagaacatttttattggcacaaaagaaaccgtgtatcccttagttctctcttcagtccccacagccctagacagccaactgctaatgtactttgtgtctcttgatttgcctaatctggacaatttcctgtcaatagaatcatatatgtgtggccttttgtgtctgactttttttttttttttttgagagggcatctcgctctctcacccaggccagagtgcagtggcgcgatctcagctcactgcagcctctgcctcccaggttcaagcgattctcctgcctcagcctcccgagtagctgggattacaggcacccaccaccacacctggctaatttttgtatttttagtagagacggggtttcatcatgttggccaggctggtcttgaacggctgacctcaagtgatccacccacctcggcctcccaaagtgctgggattacaggcgtgagccaccacgcccggactgtctggtatctttgactgagtatgaatacctcagggctcatcggggttgcagcatgtgtctgtactgcattccctttaatggctgattaatccatcctgtggatagaccacatgtggattattcatcatcagttgatgggcatttggagtgtttccatgttttggctattatgaataatgccgtatgaacatgaagcttttgtgtggtcatatgttttcatttctcttggttaatacctaggagtggaactgctgggttatatggtaatctatatttaacctattgaggaactcccagacttcttccaaagtggccataccattttcgactgccaccagtagtttatgagggctccagtttcttcacatccttgccaactcttgatactacctttttcatgatacccttcctagcaggtgtggagtggcagctcgttgtttgggtttgcatttccctaataactgtgatatccctgatgatattcagcatcttttcacatgtttcattggccatttgtatatcttctttgaagaaatgtctatttgggtcctttgctcattttttaattgagttatttttattattgaattgtaagagtttttaaaatctattttattaaagatatatgataatggatatatgatttgcaagttttttttcccaattctgtggggtttttcactttcttgctggtgtttagttgaagcacagaagttcttaattttgacaaaatccccattttatttattttttcttttgttgtgtgttcttggtattatatctagtaacactttgcctgacccaagatcttgaagatttactgttacattttcttctcagagttttatcgttcttagttcttacgtttaagcctgtgattcattttcagttaatttaattattgcatatggtgtgaggtagagctcccacttcattcttgtgtgtgtgcggttatcaagttgtctcagtaatcacttgttgaaagaaagactgcttttcccccactgaattgtcttggcacctttgtcagaaatcagtgtgctgtaagtatgagggtttttagtgagcctgagtgttttagtgagcctgagtcccttggctgtgaatgtcccctatgcttctcttcagtacccactccctaccccagtgggacaaagtggctggaatgggctggagttgagtagcttccttctcccacgtggaagtctagagcttactggagttgggtgtttcattcccccaggtcagttaggctcagataatatgcccgcaggagctctgggtaatgcgctcctcgtgagggccggcctggttaaggagaatagagcactctggcctgtttcagaatggttcctttccccgccacactgctggaagcacaagccgatttttctctgatgttcactgagagcctttctctaatattcactgagagcctggttgagctcctaggggtaaaactcataagtatgggagtcccttatgactggggcaggttttttctttttcttttttttttttttcttttggtgttggagttttgcttttatcgcccaggctggagtgcaatggcgcaatcttggctcaccacaacctctgcctcccgggttgaagcaattctcctgcctcagcctcccgagtagctgggattacaggcatgcgctaccacacctggctaattttgtattttttagtatatcggggtttctccatgttggtcaagctggtcttgaactcccgacctcaggtgatcagcccgtctcagcctcccaaagtactggcattacaggcattagccaccacgcctggctggggcaggtttttaactctcagactcatccacactgagcctcaaacagttcataaatgacagggtcaggctctcccaccctgacaccagttcccgtggtgatgtctgcccaagcctgtcctggtgagccgggactctctgtattgggctgtctgtctccaggcttaaggacagtgatttacactctgtcctcacctctcctatggatccaagaagagctgataacttttcagtctgtttagttttttacttgttaggactaagtggtgacttttaagcttctcacgtgaggaacagaaaactggaagtcttctaatacagatgcttgaaggtgtacatttcttctaagcactgctggagctgcttcccataagttttggtatgctgtgtttttgttttgtggcaaagcattttcttttttttttttttttttttgagagacagtctcgctctgtcgccccaggctggaatgcaatggcatgatcttggctcactgcaacctccacctcccaggttcaagcgattttcctgcctcagctggaaatcacctccttgcctcacctcccaagtagctggaatcacaggtgcctgccaccacacctggctaatttttgtatttttagtagagatggggtttcaccatgttggcaaggctggtctcaaacttctgacctctggtgatctgcctgcctcggcctcccaaagtgctgggattacaggtgtgcgccaccgcgcctggctgtccaagcattttctaatttgtgttgtggtttattgttggactcactggttatttaggagtgtgttgtttaatttccaaatatttgcaaatgtcataagtttcatcctgttattgatttataatccattccatttctattaatttactttgtgtgattttagttaaatatttaagtgtatggaggcttgctttgtggcctgccatttgtccatcctggaaaatattgtgtgtgtgcctgagaagcaggtgtgtttgcccttgctaggctgagggttctgcagatgtttgtttcgtcaaggagtattgtgtcgttcatgtcttttttgttgttgatcttccgcctaggtattttattattccgtaaatgcttcctctcagcagaatcactgcccagttttattctgtattgacagtactttctgggagaccttgactcaacctcttgtcttctgatttacgccacatgaccagggcgtgaccagagtagactgtggcgtttctcggggtcttggttggaaggatatggtggtgggattggtgggattcattgcattggtaggattcttttacggcttctgttcacagagccctgccctggctggctgtcctgtgcttctgtttcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaaggtaagcagagcccagcagttgccctgttcccagctctccagagccccatcagaggaagcagtcccagcgagctgctgaggcagtcagtgaacccggcagcggcgcagccaggagcagggacgtgtctctctgggcccctggaattggggctttggggcttctctgacagatgtctcctccttgtaaacgaagtgccttgttcctgggcagctgtgtagagaaaggcccaggctgcacctttatgcaggacattggtgggcttgtgggactcgggggaggcggctgagccccagacactgggaaccaggaggctgctgtgtctgtgagcaagccctgggtgggcctgcctgccctggctcccaagtgcttgctccagcggacccgatgatcaggtcactcagcaggatacccttttccctttgtaccttgtcaaggtaatttagtccaggtgtttttttttttttgttttgtttttttttttggtaagctacttttccctttgtcgcggttctgacgatgagctgcaggcacagaaaggcctgcagtctgtggctgaggtcacaaaaggagctacctggttgttctcctgtgtgcagcccaccccacccccactccttgggaaggctctgggaattgagtggcaccaggttttgcttttttttttttttttttttttaaatcaaatgctggcaaggtcacagctaactgtgttctgtgcacagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaaggtgggtgtgaagtttcgggggccgctgtggactcccttccaccagacacccagcccacctccatgtccttcccagcaccaacatatcaccctgaattttaccaaacagcagtccacaatttgccaattccttttcgtttgaaggtttcttattcgttatcaagagggaggcaggaaggaagagcagcatatgctctagaactcgaggttttagatgcaatattggcagggagtcgaggggaccttgcaagtggatggcctgcagatgggtgcttagcatcaagtggacgccccctcctggcaggcaggccacatgccccatttttgtatgtccaccgtcgtgcagtgtctggtgccatttagacaatcagtgcctagtgaatgaatgaaggaaggaaggaaggaatattgggtagatgaaggttaatgcatatgtgaacattgagaaaaaatgacatgtgaatcactcctttttggtttggttgactcttttctttttaaagaaataaagggtaggaattggagatcaaccgactattccaggatgtatttcagtcccttcagatatggaaaatgtccttcccacctgagccaggaacacttctgaggacatgacacctgcgctctggggtggaccaagtcacagaagttggagaatacacttatttgcagaagttaccttgattccatttaaatctaattttcacttcagtgtcttactgaagaacgtgtccttccaagttccagttaaagaattggattttgtcagcctccccctaagtatccctgctctgtccttgtgttccgtgctcacccagcaagaagatgcttgtggtgtgtgaggcggggagatctcactggctcgctcagcctgtggcgctccagtgtcagacccctcagcggctggtcacaaagcgtaacaaaggtgggcctgagatgccacagtgcctgcaggatgcacctgcttctagatgcaggtgtggtgacctcatttgaagaaacgcggtggacacataggcctgtgcagtttccaccccaggcagtgagccagagaaagagactagagctgcttttccaggtgtgcacttttaaaaaagattttgtttggccgggcgcagtggctcatgcctgtaatcccagcactttgagaggccgaggtgggcggatcatgaggtcaggagttcaagaccatcctggccaatatggtgaaaccccatctcttctaaaaatacaaaaattagctgggcatggcagcacgtgcctgtaatcccagccactcgggaggctgaggcaggagaatcgcttgaaccccggaggcggaggttgcagtgagccgagattacgccaccgcactccagcctgggcgacagagtgagactccatctcaaaaaaaaaaaaaaaaagattttgtttaccagcctgcatacacatataaaatatgtaagttaaaccctttgagtaggtctcttgaaagccttttgtcctcatcttctctggctgctgcccactccagggaagaatagagtaatgggtgctctcatgctctaagtatgagggacaccttctcacgtgtctcacagtggcagctccatttcctctctccattctaaggagatgctgtcattagctgtagatatccgttccttcctaaaacagtggcacctttcttttatcttgagttgattatctctttaaaaaattgagatttgggttgttagtttctccatgttctgcctagaatgcacccttgtatttagggccatgctgtctgtagattccgagtccaagtggagtacacataatgcatgtgcttgtcctggaagccagcccttgcgtccctaccatttccagagaggcagcagacagatctgattgtgagcaagtatggctaacccccagcacttgtgctctgatagtcctgtgacatcaagacagaaatgatgtagcttatgttttatgtgctaattttacagggagaaaccagcagaaactgagaggagaagatgactacaacatggatgaaaatgaagcagaatctgagacagacaagcaagcagccctggcagggaatgacagaaacatagatggtaagaatggggcctacatcggtgacgaggtcacctttcatttctctttcctggtccttcaccgtgattatccaatgaatccccaaaattatattgtaattaatgggtcatttcaaggagatcgtctgttctttaggagcttttaaaccaggggcagtggagggaagtgagggttgagaagcccaaggtgatgaaaaccattcggaaagtctgcatcgtttctagaaacatattcagtgtggctcaactctttaagtaggatgatttttcagtgacatttagggatttcccaacaaaatggctaggtcactacttgatcagtctgcctcccagatgagaagccccagtatgtgcatagagcttccaagcagctatgaaagctgccctttgtattattattttgaatttttgaagagtccaggccagtatcttgtagaatgtatcaaactctggccttgtctgtttgcttgtggtggattcaggctgatgaattcttgcttctccccaggaggcataacagcaggtggtcctacaggtgattggttgatcccttagctaacatggtgcccacaaggtctcagaaggccattttccttttgatattaatacgtcatctagaagaggatgctttgaacttgtgtagctttaccatccattgatgaacattgcccaagtggtgacattttacatgctgccatcacagcacatttattacctgacattttttaaggaactcctctccctcctccaacacacttgtttgttttggtatcactatggactcatagtattctttcttaaaattcatttttctgggccaagtgtggtggctcacacctgtaatcccagcgctttgggagaccaaggcaggcagatcagcgggtcaagagattgagaccatcctggctaacacggtgaaaccccgtctctactaaaaagagaaaaaattagccaggcgtggtggtgggcgcctgtagtcccagctactcgggaggctgaggcaagagaatcgcttgaacccgggaggcagaggttgcagtgagctgagatcgcaccgctgcactccagcctgggcaacaagagtgaaaatccatctcaacaacaacaacaaaagaatccaagccatgtgactgtagtttcccacagcctgaatactgctgattatagagtcatgggggagttgagtgagttcgcctggtctctgttttctgtagagtggcagctatacccagagacttgatgagactcaggtcctggctcaagccctcggtaaggtgagtggtggtgtgttctttggttctttcatcgggaggcacgtcatgtctggcgtctttttttttttttttttttttttttgagatggagtctcgctctgtcacccttgctgaagtgcagtggcgcgatcttggctgactgcaacctggcgtctttctttttgtgatgccagttgatggtcaatgcctgtatcaattcatttttatgttatttgttaattggaatgttcttagaaatagacacttcagctgggcgtggtggctaacacctgtaacccagcactttgggaggccgaggatggtggatcacctgaggtcaggagtttgagaccagcctaactaacatggtgaaaccccgtctctactaaatacaagaaaattagccaggcgtggtggcacatgcctgtaatcccagctacttgggaggctgagacaggagaatcgcgtgaactcgggaggcagaggttgcagtgagccgagattgtgacattgcactccagcctgggcaagaagagtgaaactccgtctcggggaaaaaaaaaaaaaaaaaaaaaaaaacctcagtggtattgtttgtataaggtagataggataaatgcttgatttctttcctttttaacagttttcatgactatgaattacttccccatcttctctgagggtaactgcttttaaaatatcatcataaacttcagaattcagcagaaatcctcagggcagcaggagtcgttgtaacaactacttcacttcagtttcggccttgctgatcctgccgatgccctttttttttttcttcctcagatggagtctcactctgttgcccaggctggagtgcagtagtgcgatctcggctcactgcaacctctgcctcccgggttcaagcgattctcctgcttcagcctcccgagcagctgagattagaggcgcacgccaccacgtccagctaatatttgtatttttattagagacggggtttcaccatattggccaggatggtctccatctcctgacctcatgatccgcctgccttggcctcccaaagtgctgggtggcgtaagccaccacgtctggctaacaataccttcttttattaccatctgggcaatgcattattcatttaatgttttaatacttacattttttttaccttttcattttgaaataatctagacttctttaaaaagcaaaaaatttctgtatacccttcacccaggttccccaaatgttaacatcttatataaccacagtaaaattaccaaaataaggaaattaatgtttatacaatgctattatctaatctgtagactttgttgaaatttagtgagtgtccaattcatgtctttttttctgggttcaggattatacactgcatttattgtcagacctctttagtgttctttatcgtggagcagtttatcatttatgttgttggtcttttttgaagggtagtggctcagttatttggttgaaagtccctcaatctgtgcttgtctgatttttcaacaatgtccccctaaaaattatcttttatatttctccaggatgtcagttgtttcaattggcagagttgtttggaatttttagaatccaagtcctaatttgaattttcagctgtcttcatttaggcaattttttaaaaaggcaaatggcaaaatacactagcagccagactttgaagcaaatacaaactctctgttgtcattgactccactcatttatgttcttgagcatgtttcacggtctggtcactgtcttacttctattcttttttttttttttttttttttttgagacagagtctcactcttcttgcccaggctggagtgcaatggcacaatcctggctcacagcagtctccgcctcctgggtttaagtgattctcctgcctcagcctcctgagtagctgggagctgggattacaggctcatgccaccatgcccagctaattttgtattttcagtacagacagagtttcaccatgtccactaggctggtctcgaaatcctgacctcaggtgatctgcctgcctcagcctcccaaagtgttgggattacaggtgtgagccaccaccccggctctaaccaccttttaaattgggcctagtttcctactaaatgatgggctttgcggtgaagcctttttggatctctcattccctacactcaggtgtcctaaggacttgaccttgtgcaaggttttaaacaaagtaagtaggtaaggtaaagaaaatgagtgccttgtcagctctttgaagaagctgaagaaatgtcaacatcagcttcaacattattttaagattgtgtcattgaaacagtgagaccttacttgctccagggaaattagaagaaaaaagcattagctccaactttattaagagcctttaacagataccgttaatttaatatggcaggtatttaatggtcattaaactaccatttaatgtgccatagttataaatcaagaccgtggttttaggttttatttgtgatgtgcctttttatgttttctgtgtgttaaaaggatagagtaagatcagatggtagaagctacatacagacatcagctctgtaaagggagagctttggagtcacaagagctgtctgaagctgcagacagctctcaggaggcagcgtgtgccattagaagtgcagtagcaagggagtcacgccgcacaggagcgtggtgattatatttaaaatgtcatgagtgcacttgatactgtccattttctatggcatatggggcattatgtcactgttacaaacaagtatggaatctttaggtgcttcagctttgtttcatggcacattgttggtcatccatttggacactttgaaaggggaggagttccagctgggcgtggttgctcacgcttgtaatcccagcactttgggaggccaaggcgggcggatcacgaggtcaggagatcgagatcatcctggctaacagggtgaaaacccgcctctactaaaactacaacaacaaaaagaaatcagccgggcgtggtggcgggcgcctgtagtcccagctactcgggaagcttaggcgggagaatggcgtgaaccccggaggtggagcttgcagtgagctgagatcgcacgactgcactccagcctgggtgatagagccagactccgtctcaaaaaaaaaaaaaaaaaaaaaaaagttcccttatccccttcacagggcatgcaatgggggtatggctttcttcttcagtgccccacagctcaaacccctaggggaagcatgcggacggacaggttgtggggaggatgggtttcaaccccgcggcagcatctagggttgagtggttacagctcctggagccccactgggtgtgtgttgcagtgcgttctttcagcttagctgtccacaggcagcttgtgttaatcagttcaattagaccctctgccttatcgcaaggacagagggctttctgtatcccaggttcttgccctagtgtactgaaaaaatcagatcatgtgggcttggagaatgaatgcaagatttattgagtggtggaagtagctctcagcagatggctggggagccagaagggggatagcatgggaaggtagtcttcctctggagtctggctgctcagcagccgggatctcctactgtccttggccgaatttcccttggcgtccgaatcgttccaccatcaatggcctgccagcgtctttcgatgtgttcttctgccagtgtgttcctcttgacgtccagccgcttgtgtgtgtgcccgctggggtctcagggtttttataggcacagaatgggtggcatggcaggccagagtggtcttggaaaatgcaacatttgggcaagaagacaggagtccttgttctcattaggtccatgggcacaagcctgagggtggagcccttgccagtgaccctgcccttctctacccagcacttccctgtccccctcccatatcaccgttgccatcttgtccttgatgaggaatacaactcccaattacagtgttgctgtgggagatgcagtcctctttatgacagtttctagaagttgataagaaaatgggacctgcctagggctagtatctcatttaatactctatagaatattatgtgtttttcctttttagtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttata

SEQ ID NO: 38207 - DNA, 25197 bp, Homo sapiens
tcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtatgaggcgtcgccgctccctaccccgcccggcgccccgttcggtcgctgctgctcagggcgcctgaggatcggctcagccttgcgggcctttcattctcccgagatgctgctgctcctccgctgccctttacctccccgcagggacagcttcctcagtcccgcggccccgcttgggggcctcgccgagccctcgcctcgccgcccagcgttgaggccctctcctcccttagccaaccgccacccggccctgccctgcccggcggatcctctgaactttggttcttcgtcactgaggtggatcctggccggtcgccaccaaaggcttccgaaccctccctctcgcccctccgaaattcacattcaccactactccccccaaaatctcagacgcaaaacacgaaatactcagttgaagacaaatgtgaagttaggtgggaaccaacattttattttttattccttttttttttctttttatgctactgttactactgcttttctgttccgaggttttcgcaccagatactgagagaaacacaaggagctcattcagaagtgttaatgaaggggttgctctgtcagatttcggaaggatgcattgagcgctttccagcagcggcccatgtggctcctgacaatgaaaatcacatttgtcagagctggaaattagtgaagctgagttttagcgagtttaaacatgggagttagtttctaatctactgtcaaataattattacatggtattttatattcacatgcaggtaggccaagtaagtgatagacttagtgtttccagttcctttgctatatccctgtaatgggcaggtcattcttttttttatgcttttactgagagttgacataattacctcatgcactgtgcctaggaatggaacagtttttagaacccctgtctcgccgtctacttttctgtaaaaaataggcaagacactagagagggccccatttcttattcttgagttgttgggaatccaaattatttcttgctgagtagacctgtgtgaattcagattccatatgttaaaggctattgcaaataaattctttgtacttagaacaaagactgattagaatgtactgtaacatccaaaacagaattggcacatttggggctagatagcatcggaggtgacagcatgttgcagtatatagtaagaacccttggggccgggcgcgttcgctcacgccttcccagcactttgggaggccgaggtgagcggatcacgaggtcgatgtttgagaccagtctgaccaacatggtgaaaccccgtctctactaaaaatacaaaatatagccaggtgtggtggtgcgtgcacgtaatcccagctagtcgggaggctgaggcaggagaatcgcttgaacccgggaggtgaaggttgcagtgagccgagatcgcgccattgtactccagcctgggcaacagagcaaaactcagcctcaaaaaaacaaaacaaaacaaaaaagaacccactactcaatacttctctgggagacggggttttctaatgatgttcagagctcttgccccaaaaactttgaatattcttaattctgatttcacaacatctatgtgttgccaagtagcccaggagttttggtgaaattcccaaatgctcagttgtaaaaatagttacttgggccgggcacggtggctcacgcctgtaaatcccaacactttgggagcctgaaacaggcggttcacctgaggtcaggagttaaagactagcctggccaacatggcaaaaccccctctctactaaaaatacaaaaattagctgggtgtggtggtgggtgcctgtaatcccagctactcaggaggctgaggtacgagaatggcttaaacctgggagatggaggttgcagtgacctagatcgtgccactgcactccagcctgggcgacaagagcgaaactctgtctccaaaaaataaataactaactaaataaaaataaaaatggttacttggtagcactttcagggagctcagacaggagttatttgtttatttatttgttgttgtttttgagatggagttttgctcttgtcacccagactggcatgcaatggcacaatctcggctcactgcaacctccgcctcccaggttcaagcgactgtcctgccttagcctcttgagtagctgggattacaggtgtccgccaccacacctggctaatttttgtgtttttagtagagacagggtttcaccatgttggccaggctggtcttgaactcctgacctcaggtgatccgcccaccttggcctcccaaagtgctgggattacatgcatgagccaccacgccagcccaggagttacttaataggacagattaagagtcacaacaataatcaaaactatgtcctacagcattcattctgtcaagtatctgtagtgttaaaaatcctgggtatattgtacaaagaccatggtaatcattaactatataaaatggacttcattagctgttaatgacagcctgtgtttttttgtttgttcgtttgtttgtttgtttttgagatggagtctcgctgttgtcggcctcggctggagtgcagtgacacaatctcggctcactgcaacctctgcctcccgggttcaagtgattctcctgcctcagcctcccaagtagctgagattacaggcgcccgcccctacgcccggctaattttttagttctagtagagacagggtttcaccatgttggccagactggtctcgaactcctgacctcaggtgatccatccccctcggtctcccaaagtactgggattacaaggcatgagccactgcgcccgaccgacagcctgttcttctaacatgaagttagcttgtaattctttcctaagtgaattatccagctatatctgcatttgccttttgagtgttttgtctgggttgccaaatatgcagctgatgctggcgtaatggatgtcttctagttttgttcaaatacaaaatgtgccttagattttatttagaaggtatttttgagcccccttagtaaactgtagctttcctaacgcaaaagttcccttctttcagtttgatattagcctatttcagctacatggtttacgtcatagaatttgaaccaaaatgaaacttggagtttattgaactcagtattaccaacagaagaaaaacctacaagaatgatgcttcatcattgccttggaaaacctatgctgcatttttacttgtgtttaaaaataacccaaattgtgttctttattcaagaccttgcaagcaagacatttctggaaatattgctttaatattgatatattccattgtttttaaaggtgggatatgagcctcttcctccaacaataggacgaaatatttttgggcggcaagtgtgtcagcttcctggtctctttagttatggtaagtgcctttgatttatttgggtttgcatgacgttgaggactgtgataggcaggagttgttattgaaagaaaatatatagaaagcttgtttctttgaaattgtagtatatccatttctcttgaccagaacttgacaacatctctgacttgtgttcttagctcagcacattgccagtatcgatgggaggcgcgggttgttcacaggcttaactccaagactgtgttcgggagtccttggaactgtggtccatggtaaagttttacaggtaagaggaaaattaaatcaatcttcccatagatgttgcttacctgttatgcatagtttgttctaaatatcaagagcaatttaaaagatacatttataaccctgtcctttcttcctcttgaaaaacactttctttttttttttttttttttttgagatggagtctcactctgtcgcccaggctggagtgtagtggcgcgatctgggctcactgcaaactccgcctgccgggttcacgtcattctcctgcctcagcctgagtagctaggactacaggctcccgccactgcgcccggctaattttttgtatttttagtagagacagggtttcaccgtgttctcaatatcctgacctcgtgatccgcccgcctcggcctcccaaagtgctgggattacaagcatgagccaccgcgcccggcgggactcagtgaaattgttgctgttacttccatgaaatttacatatggaaaggcagttgtcatctagccaaagaggtttgtgtatagacttagagaaaaagagaaagtgctgcttgagactaagttactttatgtaactgtaaagtaagacaaacttgaggtaaccaggtaccctgaatatgttccaaatgtagtccagtgaaatattacagggttggtactacacttagcatccaaagctgcttgtacagtcaagaagaaggatctatgcagggctgagaaaattattaacctttacaagaaataattttgtaaactgaacaagaattaaaatgaaattcaggaaatgtagaagacaggttagataattatatcgatggagtaaataacaaagtatagaaacaagtgaaaatttagagacctgaagctattagaattaattctagccaaggacctggaatttggccaaaatacattactttgctttatcttcacatttgttctcttgcccgtgatttttttaaacacaattctttttacaagagaaaatgttgtctatttttgaaatctgatatggctagaaaataataaaactgacattaaaaaataagaaaacaataaaactggtggttacacaagaaggagctctcaattgataattttattttcacctagctcacattctatttccaaaatacgccacaaaaaattcctcttgcaagaatttttctctgggctctggcagtattcatgatctcttctctagaagagaaaaaaaaaacctcttgcttgttttagaaaccatcagatacaaaggagaaagtgaggcgatttcagctcttcagtcttaatatcaattctctgtccttttatgcagggaagaaaagagtcttgccctaatttggtattggtcatgcgttttccatgagaaaagtgggaaccctgggctatgtttttactgacttattttctgttaaaactgaaagttcttggccaggcgcagtggctcatgcctgtaatcccagcactttgggaggctgaggcgggtggatcagccgaggtcagcagtttgagaccagcctggccaacatggtgaaacactgtctctactaaaaatacagatgttagccaggcgtggtggtgggcgcatgtaatcccagctactcaggaggctgaggcaggagaatcgcttgaatctgggaggtagaggttgtagtgagctgagattgaaccattgcactccagcagtgagccgagattgcaccattgcactccagctgggtgacaagagtgaaactccatctaaaaaaaaaaaaaaacagagttcttgaattttcttttttgttgttgttcttattttgtaattatttctttaaatttattattatttttttagagacaaagtctcactatgttgcccagtctggtcttgaattcctgggctcaagcagtcctccctcttcggccttccaaagtgttgggattacaggcgtgagtcactgcgcatgttcccttttcgttttttgggtttttttgttgtttttttttgagacagagtttcactcttgttgcccaggctggagtgcaatggcatggtctcggctcactgcagcttccacctaccgggttcaagcaattctcctgccccagcttcccacgtagctgggattacaggcacctaccaccacgcccagctaatttttgtatttttagtagagagggggtttcgccatgtcagccaggctgttctcaaactcctgacgtcaggtgatccgcctgcctcagccacgcaaagtgctgggattacaggcgtgaggcaccatgcccggccccttttctttttttctgagatggagtcttgctctgttgcccaggctggagtgcagtgatgtgatctcagctcactgcagtctttaccccccgggttcaagcaattctcctgtctcagcttcccaagtagctgggattacaggcgcccgccaccaagcccagctaatttttgtacttttagtagagatggagtttcaccacgtaggccaggctggtctcaaattcctaacctcaggtgatccacctgccttggcctcccaaagtgctgagattataggcgtgagctaccgcacccagccttcccttttctttttttttttcttgagacggactcttgctctgtcacctgggctgcagtgcagtggcgtgatcttggctcactgcaacctctgcctcctgggttcaagtgattctcctgccccagcctccctaagagctgggattaaaagcgtgcgccccaatgctccgctaatttttgtatttttagtagagatggggtttcaccatgttggccaggctagacttgaactcctgacctcaggtgatctgcccacctcggcctcctaaagtgctgggattacaggcatgagcaaccacacctgtccccttttcttttttcaaagaagagttttcatgaccatttgcttttcttccaactgaccaatatgttaaacttagcaacaagtttatcttggagatccatatttccagttgattaatgagtagaagttaactgaagatttgcagcttaaaaaaaaaaacaaaaactttaaaaaaaacttcagctaatttactttctgtcagtagagttttcattttatgtcttctttcacatgacactgtaataaccctaatcatcctttttctttttttctatagcattaccaggagagtgacaagggtgaggtatgttggagctgatttctaagcatgagggcctttcccttgcaagttgttactgcttttggggcctcttttggagaaaagccaagtagtcagtctcctattcatctcagtgagtgttgtcctatggggtggccaccagtttggacagttctgtttgaaaccatcaggatggctgggcatggtggctcatgcctgtaatcctagcagtttcggaggccaaggtgggaggatcacttgcatctaagagtttgagaccagcctgggcaacatagaccccttctctacagaaaatcaaagattagcggggcctggtggcacatacctctgtatctcagctacatgggaggttgaggtgagaggatcacttgagtccaggacgtcaagactgcagtgatccatgatcacatcactgcactccgcgtgagtgacagagcgagaccctatctcaaaagaaataaaaaccgtcaagatcggccgcccatggtggctcatgcctgtaatcccagcactttgggaggccgaggcaggtggagatcacgaggtcaggaaatcgagaccatcctggctaacacggtgaaaccccgtctctactaaaaatacaaaaattagcagggcgtggtggcgagcacctgtaatcctagctacttgggaggctgaggcaggagaagcacttgtacccaggcggtggagcttgcagtgagccgagattgtgccactgcactccagcctgggcgacagagcgagactctgtctcaaaaaaaaaaaaaaaaaaaaatcaagatctctattttctttgattttgatttccaggagttaggacctggaaatgtacagaaagaagtctcatcttcctttgaccacgttatcaaggaggtaagagatgaattacatcctgtgctgtttgcccagatcaaactgtggtgttgcaactatggaatcagaatcatcaggcctgtgtgttcagtgtctgttcccaaatgaaattaaaccttcaaattaatttgggctttactacatgtataacattaaaaagagagaggatcagtgcttgctgttcagaatagatgcatttcaagaaaactcattttgcccacacattccgtctttagaatactgaaagtcttctaatagtgttgaaaacctcaggaataaaagtgttaaaataggccaggtgtggtggctcacgcctgtaatcccagcactttgggaggccaaggcaggaagatcacttgaccccaggagttagagaccagcctatgcaacatagtgagacttcctctctacaaaaaaaatagaaaaattagctaggtgtgtggtggcacatatctgtagtcccaggtactcgagaggctgcggtgagaagatgacttaagcccaggaagttgaggctgcagtgagctatgattgtgccaccatactccagcctgtgtgatagagcaagaccttgtctttagaaaaaagtattaaaatagcgaccaggccctttgtatgttggatagtatctatgcagaaaggctcttttgacatttttctgactctgaaaagttcctcatcacccatttcccacccccatatgctgccataggtgtttctgtgcctggctttcagaactattctcttattacttaagtcttcacattgtcttaattgtcattaatgaagtcacaattatccaggaaatgcagccatccaaaatacatattccaaaggctgggcgcagtggctcatgcctgtaatcccagcactttgagaggccgaggcgggcggatcacctgaggttgggagttggagaccagcctgaccaacatggagaaaccccgtctctactaaaaatacaaaaattagccaggcatggtggcgcatgtctgtaatcccagctacttggggggctgaggcaggagaatggcttgaacccgggaggcagaggttgtaatgagccaagattgcaccattgcactctagcctgggccacaggagtgagactccatctcaagaaaaaaaaaaaaaaaaaaaaaaaatatatatatatatatatatattccaaaacaaacattactaaaggtctggaaaccagataaattagctctattttctgtaaattttcatgaaattagtttgcttaaaagcagggatacggccgggcgtggtggcttacacctgtaatcccaacaccttgggaggccgaggcgggcagatcacgaagtcaggagattgagaccaccctggctaacacggtgaaaccccgtctctacgaaaaatacaaaaaaattagctgggcatggtggcaggcgcctgtagtcccagctactcgggaggctgaggcaagagcatggcgtgaacctgggaggtggagcttgcagtgagccaagactgcgccactgcactccagcctgggagacagcgagactccctctcaaaaaaaaaaaaaaagcagggatacatgtattactatgcaattagtattttccttagtttgcccatccagtcccataggatcttatgcccttggagaaggggtgagggctgtcttaaaactcagtgactaggccgggtgtggtggctcacacctataatcccagcactttgggaggctgaggcgggcagatcacgaggtcaggcattcaaaaccagcttggccaacatggcgaaatcccatctctactaaaaatacaaaaaaaattaactgggcatggtggtgtgtgcctgtaatcccagctactcaggaggctgaggcgggagaatcacttgaacctgggaggtggaggttgcagcaagctgagatcgcaccactgcactccagcccgggcaacagagcaagactctgtctcaaaaaaaaagaaaagaaaaaactcagtgaccataaagatactgtttaaatgcaaaagccggccaggcacggtggctcatgcctgtaatcccagcagtttgggaggccgaggcgggcggatcatgaggtcaggagatcgagaccatcctggctaacacggtgaaaccgtctctactaaaaaatacaaagaaaaaaaattagccgggcatgatggcgggtgcctgtagtcccagctacttgggaggctgaggcaggagaatggcgtgaacccgggaggcggagcttgcagtgaaccgagttcgcgccactgcactccagcgtgggtgacagagcaagactgtcctaaaaaaaaaaaaaaaatgcaaaagccaatggtagacctgcttacatttgcaatcccagaacctaaatgcaaagattataatttaattttctttattacttccttacagagccctagagtagaaagataaactaggaaaaacacagcagctctaagatactgcacagttactgggttgtagtcacaaaacaaaattgttctcttctcccaaaaatgtgagtagagactaaatggagcctgtcatttatctagaatgatgtcagactctccaaaatcacttaccaataagagagcaacttaataatctcaataaaggcctcatattttttatttcagcttaatgactttgttggtgacctttcctgtttctttatttttttctcttacctgtaaaattgagaaaacaacagaagcctgctttgcagagaaattttgagaagtaactataatagaacattgagatccatgagtgaaaagtatgataaaatgacaatgaatgagatctttcacatcccattcaaactcttcttgactccagccagggcaggagggctgtgtcattcactttcttatcctataccacgatatccacccacattccttctcacaggcatttgagtgtcatttgtttagatttcagaagtgtgtgttgattgtttctagacaactcgagagatgatcgctcgttctgctgctaccctcatcacacatcccttccatggtatgtttgcagttgacaactgacctttcttttataacctgatctctcctgaccacttagataggttgacgtgggagttgactaaaatgccttgcctgcatgtttttgtttgcttgcttgttttggcttttatccaatttatccagatagcaaaatgtctttaggtggaaaatctttttttttcccagggctatcaaaatctatcttaacatagtttttttttgtttgtttgttttttgtttttgagacggagtttcactcttgttgcccaggctggagtgcaatggcacaatcttggctcactgcaacctcagccttccgggttcaagcagtactcctgtctcagcctcctaaggagctgggattacaggtgcatgccaccacgcctggataatttttgtatttttagtagagatggggcttcatcatattggtcaggctagtcttgaactcctgacctcaggtgatccgcccacctcggcctctcaaagtgctgggattacaggtgtgagccaccgcacctggccttaacatagttgtaaacatcttttctctatattccacagtgatcactctgagatctatggtacagttcattggcagagaatccaagtactggtaagtatttttgttttcacatactcaaggagatcttttgaagccaaagtactagaataatactactttgtatttttatgatacccttacaatttgtagaacaaattcgtatctgatgtcatttgatctgcacaaaaaacaataaaatgggagaaaatatacccaggcaggtttagtagcctacgtaggatttcagagtaagttgcagagcccctgactccatatgactatacccctaggtagttaatattttcacttctatctccaaatttagctatctttgcagagtgagagagtgctagaaaagtgtgagggaaggaggtcgtggatttgaccttgtccaatgtgataattgaaattattttgtttatagctccaaaagaatcttaatatattttaccttttcttcttgtgtacgtagtggactttgtgattccataataaccatctatcgggaagagggcattctaggatttttcgcgtgagtaaatgttgattagtgtgtaatttttgcatgagtgggaaacgttttctgaaagtaagaatagtgagtctttgtttaatccttggggaaaacgtactccctgggcttacctcacgttacattctatttaggccccttatttttttttcttttttctctgcagaaaggcatatttaggccccatatgactagaattatcttgtaaagatcccaaacctttacttctagatacttaaaacatttgaggccgggcgtggtggctcacgcctgtaatcccagcactttgagaggccaaggcggttggatcacctgaggtcaggagttcaagaccagcctggccaacatggtaaaaccccacctctaggtgtggtggtgtgtgcctgtaatcccagctactcgggaggctgaggcaggagaattgcatgaacccgggaggtggaagttgcagtgagctgagattgcaccactgtactccagcccgggtgacagagtgagactccgtctcaaaaaaataataataattaataaataaataaggaatttctttttttaacaaaggacttaattccaagtttctacccttgtagtaaactcccaattctatatagataataaaatgagaaaaattaaatgttgaaaaatggggaaatcatcttaacttgtattttccttaccgtaaaagagtaagtttttgcaaggcttgaatttactttggaagaacttagactactaccctcattcttctatgaggaaaaattttgcatcattaccgaaatggtgttttttgtttttttttttttaattttcagagtatctccccatacggattttgaatatcataaataccctgtgagataggcaggacagctataattagtatcactttagagattaaaaaacattgatgctctgagagtttcatctgctgcctgtcacatcgctgctgagtgctggagctggcatttgaagctggtcttcaatccgtggggaaatgctcttcccactattccatgctgcctcacctaggtcacccagaccctagaaatgtggtttttgatgcctctcatctgtatctgtacttgggaccattcttgctttgtaatttttctcgtcttttgctctgccaaatatgaatatcagatagcttagcaaaatcatttttttaagctagtcaaagcaaaacaatatttaagtctcttctgcaaagcacctcgcaaatcttttgcctccctgcttacagttatgaatagtaaggtgagccactgagggtatagccgacctgcattttaaacataggaacaaaagtcactggagatcagcttcaagtacagctgtgttaacgagaatgaactaggtatgcgggctggattctggtgtttgattccttttttacttccctagaatgttttgtgacctctaattatttgacaaacatttgtactgaagagcctgtcatgttactgatcacattttttggttcttatttttattgtttcttcatgtaggggtcttgttcctcgccttctaggtgacatcctttctttgtggctgtgtaactcactggcctacctcgtcaatacctatgcactggacagtggggtaggttgtgaccttcgtgagatgtgctcaccttggctttaatctggcagctagattagcttttaaagtaagatgggccgggcgaggtggctcacacctgtaatcccagcactttgggaggccaatgtgggcggatcacctgagatcaagagttcgagaccagcctggccaacatggtgaaacctcgtctctactaaaaatacagaaaaaattagctgggcgtggtggtgcgtgcctatagtcccagctacttgggaggctgaggcaggggaattgcttgaacccaggaggcggaggttgcagtgagccaagatcgcgccactgcattccagcctgggtgacagaaggagactccatttcaaaaaataaataataaataaataaacaagatgacagtttgctacatgccagactgaacaattatatagctaaaaattatcagtcaaattttcaaatgctaatgaaatgagcatactgttcactgtagaacgatactgtttactgtagaacgatacacgttaaaagtccgtaagatgtgacagagtatacccaagagacttagccctgtgttacttcagggctttaaagagatcacttctttactgatacttaacttgagagaacctgggaaagcaggacatctttatggtgtatcgggggcttttcatctaatctggacttaagagggtgcctgtattgggctttctagaaacctcagccttttgagaatcagtcttatctagaagttgtctttcttatctcagcagttgtggggcctcttgtatgtcggcagctccatagcatgatgataaattgaacacatcacagggtatatgactaaatccatgttgtaaacctcttgagtacagagagggattttcttcaacgcatctggtagaaagctagctgtgtaaaacaaaggtagtgaattgtcccttagatatactataaatgtggttttccagggactgtatttctaggatgtgtgaaaaggttatcaatctcattttctttagtatttgaaatccttttacattcgtccctaaagcattttagtataatatgaatttgtctgttaatattgaatcaggttgatcattttgaccactgccttattattctaataatcagtgttttatggttttgtcctcaaaattagttttagacaggtgtggtggctcatgctgtaatcccaacactttgggaggctgaagtgggagggtcacttgagcccaggaggtcaaggttgtgagatcacagctcactgcacctccagcctgggcaacaagagagatgagatcctgtctcaaaaaaaaaaaaaaaattaattttcaagctgtcaaactgataatttagagatagactatattgacatggagagcaaggcacagtagctccagcctatgattccagcgactcaggaggcttaggtgggaggtttgcctgaagccaggagtttgaaaccagcctaggcaacatagcaagacaccgtctcttagctgggcatagtggcttatgcctataatctcagcactttgagaggtcaaggtgggaggatctcttgagcccaggagtttgagaccagcctgggcaaacatagggagacccttatctcaaaaaaaaaaagacaccatttcttaaaaaatattttgaaattagctgggcgtggtgatgtgtgcttcaggaggtcactgcacttcagcctgggtgacagagtgaggcactgtctgaaagaaaaaaagaaaagaaaagaaaaggaaaaaagaatatattgatgtgttgtagtgttgtaggtaattaatttaaggctcttttcctattttaggtttctaccatgaatgaaatgaagagttattctcaagctgtcacaggagtgagttttttaaaatccttttaaccttctaggaatagttgtgttttgttttgttttccttttaaatctggcttgtgtcatcactgctttaagataaccagatgtctcactgggacatctccctgaaatttgttatatttgtcaaaggtaagaataactcagttttcggccaggcgccatggctcatgcctgtaatcctagcactttgggaaggtgaggtgggcggatcacctgaggtcaggagttcgagaccagcctggccaacatgatgaatccccgtctctactaaaaatactaacattagccgagcgtggtggtgcatgcctgtaatcccagctactcgggaggctgaggcaggagaatcactggaacctgggagatggaggctgcagtgagctgagatcacgccactgcacttcggcctgggcgacagagtgagactccatctcaaaaaaaaagagagaataactcagttttcgaaggaaccacagactcacatgtgaaaataaagagagtaaggcagaacccctgcctcacatcctgcatggtttggtactgcttagctttcataaggggcgtgcctttcctccgaaataatattgttcaggccagacatggtggctcacacctgtaaacccagcacttcgggaggccaaggaaggaggatcacttgaggccaagagttcaagaccagcctgggcaactgagcaagaccccatttctacaaaagtgaaaaaaaaaaaaaaaagctggggcaggcgcggtggctcactcctgtaatcccagcactttgggaggctgaggtcgggagttcgacaccaccttggccaatttggagaaatctcatctctactaaaactacaaaattagctgggcatggtggtgcatgcccgtaatcccagctacttgggaggctgaggcaggagaatcgcttgaaccccaggaggcggaggttgcaggagaatcgcttgaacccaggaggcggaggttgcagtgagccaatatcacaccattacactccagcgtgggcaacaagagggaaactccatctcaaaaaaaaaaaaagtagttgggtatggtggcgtgcgcctatagtcccagctactcaggatcagagaattcttctggccttttgttaaaatgttggatgcagtggtgtgctaagaggaagaagcatctccaggctcaaaactgtaactgttgtctttccagggtaccgatgaagcgagacaagtgttagagtgtctcaccgcagtggcactaggcctttaaggtaaaggaaaggagaataaagactaggaatgatctaataacagctgccttgtttccattttacagttttttgcgagtatgttgacctatccctttgtgcttgtctccaatcttatggctgtcaacaactgtgggtaagcactttgtatttcttattctagtaggtggttgactgtatgctgacaggcggagcagccttgtagaaatttaggaaagatgaatgatcagtatcaatctctgattggtatttttttaaaaagggggggaggaaaagtataattgataccattagaagattcctaatttttttctttgtatgccctatgcagcagcagcctcaatttgtatttatttattaattattattattattttttttttttttgagatggagtcttgctatgttgcccaggctggagtgcagtagcatgatctcggctcactgcgacctccacctcctggattcaagtgattgtcccgcctcagcctcctgagtagctgggattacaggcattcgccaccatgcccagctaatatttttgtatttttggtagagacagggtttcaccatgttggccaggctggtctcgaactcctgacctcaagtgatccacccgcctcagtctcccaaagtgctgggattacaggcatgaaccaccatgccaggccaattactattattatttatagtttttgtttttgtttttgtttttgttttttgagacagaatctcactctgtcacccaggctggagtgcagtggtgcagtctcgctccattgcaacagacacctcctggattcaagcagttctcatgcctcagcttcccaagaagttgtgattacaggcatgtgccaccatgctgggctaatttttgcatttttagtagagatggggtcttgctatgttggccagactggtcctgaactcctgacctccggtgatctgcctacctcggacttccaaagcgctggaattaaaggcgtgagccactgcacctggcctatttttatttatttttaatttttttagagatagggctgcaatgtggtggtgaagtcctagctcactgcagccttgaactcctgagctcaagggatcctcccatctcagcttcccaagtagttgggagtacatgtgcatgccaccatgcctggctaattattttttgtgaagacacagggtctcactttgttgcccaggctgttcttaaatttctaggctcaagtgattctccttcctcagcctcttaaagtgctgggattacaggggtgagccaccatgcccagccaacatattgttattttaaatctttatcttttctatgaaagtgacaaaaggtatatcagggattaaatgacaatccatacctgtttttcctaggggctttatggagaaagtgagttttaaagaaccagaattaggatatttagtctatggaaagtttgatgaccttttctctgtattggttagaagggcaggttttggtatagtggtagactccattgatttccaaattctagatgccaagtgactctactgagttgggcaaaattttgcctttttttttttttttttgagatggagtctcactctgttgcccaggctatagtgcagtggtgcaatctcgactcactgcaacctccacctcccaggttcaagcaattctcctgcctcagcctcctgagtagctgggattacaggtgcccaccagcatgcctggctaattttttgtatttttttgttgttgttattgttgagacagagtcttgctctgttgctcaggctggattgtggtggcgcgatcttggttcactgcatcctccacctcctgggttcaagtacttctcctgcctcagcctccagagtagctgggattataggcacttgccaccacccccggctaatttctgtatttctagtagagacagtgtttcaccatgttggccaggctggtctcgaactcctgacctcaagtggtccaccctcctcgacctcctaaagtgctgggattacaggcgtgagccactgcacccagccttgccttttttgtttaattcaaaattcttttcccatatggtacctgacatatcattaaacatgttactgttttcaaataagatcagatagctatgtggagttttgaacattttacattgtttgttttctggttttgtttgtttcatgttactcctggcaagctgtgatgttttctgatacgtagagcaactgccattttttagcacagtgtaaacttgaaggatgaattaaatgtattattattatttacagttttttcaagatgaagtgattatacctaagtaggaacatatatatctactgtttatatccgttttcatgtttagtatctttgtgaacaccagttagtttttaaatctcctttccctgctctttttttttttttttttttttaaaaaaagactggttcttactctgtcacccaggctggagtgcagtagtgcaatcttggctcactgcaacttccgcctcctgggttgaagcaattcacatgccttagcctcccaagtagccgggattacaggcatgcgccaccatgccagctcatgtttttgtattttcagtagagatggggtttcaccatgttggccaggctggtcttgaactcctgacctcaaatgatccacctgccttggcctcccaaagtgctggaattacaggtgtgagccaccgtgcccggccacctttccctgctctttaatcatgtaaatgctgtgttctggagtttcatttgtccacaaaggaaaagtctaaatgttttagaaattaaggttgaagtttatgtttatttatttatttgaaacctaaatataggggaggaattctcttttggatgcttgatcgttcccctgcttcaatatgatttgtttcattgaactaaaatgatctctcagggaatcttctgtgcagcagaatattttgacaaggtttatcaacgtctcaagagaatggttaatattaacatgaatagctccatgtttttttctattttagtcttgctggtggatgccctccttactccccaatatatacgtcttggatagactgttggtgcatgctacaaaaagaggtatttctttttctctgtctctctcattttattttgttttatttttatttatttgttttcttaaatattgtctctggaatcccaagttaactcttgtagctcactttagctagagttagtctagtctgccagttaatgtacactttacagtgttctgtgttttcactttggcataatagtaaaatgtgatgtttagaaatcatgagcaggagtaatgaagaagaaagaatccctagatgagacctagaagccatttgagtgcccacattcaacttacaaatacgatccaggtagattattatcctggtaaaatgatggccttgattttagactctttttttcccccaaactcacctttcataaccacttatttgtcacagtggtattgacagagctggtcttatacttctagagtcttgttagtggatgattttgcctagataccaatttagggtttgttattactatgaggtgtataatctgcaacaaaaaattatttattatctaggcaaagctttattggaaaataaaataatgggctgggtgcagtggctcacgcttataattctagcacttcgagaggtctaggtgggcaaattgcttgagcctaggagtttgagaccagttgaggcaacatgatgagacctcattgctacagaaaatacaaaaacttagccaggcatagcacctatagtcccagctacccaggaggctaaggtgggaggatcacctgagcccaggaggtcaaggctgcagtgagccaagattgcatcaccgcacttcagcctgggtgacagagtgagaccctgtatccaaaaaaggaaaataaaataacggctaggtatggtggctcatgcctatagttccagttactcaggaggctgagccaggaggatcacatgagtccaggagtttgaggccagcctgggcaacacagccagacgtgtctcttaacaaaaaactacaggccaggtgcagtggctcacaggtgtaatcccagcactttgggaggccaaggcgggcagatcacttgaggtcaggagtttgagaccagcctgggcaacgcagtgaaaccccatctctactaaaatacaaaagaaattagctgggcgtagcagcgtgtgcctgtagtcccagctactggggaggctgagggaagagaattgctttaacccaggaggtggaggttgcagtgagccaagattgtgccactgcactccagcctgggtgacagagcaagactccatctcaaaaaaaaaaaaaagacaataacaacaacaaatggattggctgtgggctaaatttagcacaggatcacttaaaatgattatcagtttaaagctgtttttgaaggggggtccacttcttaaaagattgtagaagaaagcgtataaagaagctctttgttgcattattttatagcactagtgatatataagagaaaggcctttgaaatctgaatgaaaaggcctaagtgttgtttgtagttgctcttgcttagtgtgcccacaaagcccctctgtgaatccaagcttgaatacttgaatgatttcagtacagacctactatgaacattgtgcatttcattctgagttttactctctattgtacagtgtggtccctgtttaaatggaaaaaatggcctttccttccttccttttctgactaacactctgttataggaagaaagcagacagagaatggattacggtgtcaaacacacttaaagtaggaacagttgttcctgtaggtgcttacaacaacagcaaatcttgattgggcatttactgtataccagatatcatgctaagagcttttcttacatcagctcatgtaatcctcaaaacagctgtgtgagaataggtgtcattcttaatcacccatttcacatatgaagaaactggggcttagagcagtttagtgccaattacataatgcaaggtcacatggcctatatttgggaaggctcagatttatactccagagtgtactcagttgcactcagaacattattactttatttttatttacttatttggttctttattttttagagacaagctctgtcgcccaggctggtgtgcagtggtggcatcacaactcactgtagcctcaaactcctggggtaaagcaatcctcctacctcagcctcccaagtagctaggactacaggcatgcttccaccatgtcctgttaatttttttgttttgttttgtttttgagacagggtctcactctgtcacccaggctggagtgcagtggcatggtattggctcactgcaacctctgcctcctggctgaggtctctggctcaagtgatcgtcccacctcagcatcccaggtagcttggactacaggcacataccgctaagcccagctcatttttttgttttttgttttttgttttttttaattttattattattatacttttaagttttagggtacatgtgcacaacgtgcaggtttgttacatatgtatacatgtgccgtgttggtgtgctgcacccattaactcatcatttagcattaggtatatctcctaatgctatccctcccccctcacccctgttttttgttttttgtttgtttgtttttttgttttgttttgttttgttttgtttgagacggaggcttgctctgtcatccaggctagagtgcaatagcacgatcttggctcactgcaaccttcacctcccaggttcaagcaattcccctgcctcagcctcctgagtagctgggattacaggtgtccgccactacgcccggctaatttttgtatttttagtagagatggggtttcactatgttagtcaggctggtctcgaactcctgacctcaggtgatctgcctgcctcagcctcccaaagtgctgagattacaggcgtgagccaccatgtctgcccaattttttgtattttttgtagcaacggggttttgccatgttgtgcaggctggtctcaaattcctgagctcaagtgatcctcctgccttggtctctcaaagtgctaggattaccggtgtgaaccatcacacccggcctttaattttttaatttcttgtagagatggggtcttactatgttgtccaggttgttattactttgattataagattttataagtagtccttagaaacatgatttcatttcattaagaaataaataggccgggtatggtggatcacacccgtaatccctgcacttttgggaggccaagataggcggatcacttgaggtcaggagtttgagaccagcctggccaatatggtgaaaccccacctccactaaaagtacaaaaattagccaggcacggtggcgcgttcctttcccagctacttaggaggctgaggcaggagaatcgcttgaacctgggaggcagaggttgcagtgagccgagattgcaccactgcactacagcctgggcaacagagcgagactccatctcaaaaaagaaaaacaaagaaataaatgaaagctagcacttactgaatgttaggcactgttctacatgactcatttgctaagccagctggaaagtggcaaagccagaatccaacctgggcgttctgtctgcccagagtaagaacttaataaggagaaattgtagttagttcatagtagctcagcctttcagagaatactaatccttgttctgtagtgatagtcccagttttgtcctagatttagtcacgtctcccaattggacctctctgctgatttggattggctgatctcatctcgctagatattatttgtgttttgttttgttttgttttccaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgt

SEQ ID NO: 38208 - DNA, 47880 bp, Homo sapiens
actgcgcaggcgcggcccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacaggtaaaggccgggtcgggcggcgggaagcgcgcgggatcgcggctccgggtacccgccaggacccctgccccctttgtccgcgtgcgcgccggagagcctgcagtgcgccaacaaggtcggcgacgcggtgcgcttacggcgtgctggcgcttttcgaggctcatctgcagatctcgggccgggggcacaaccccccgagggctgcaggaaccttcgggtccccagagagctcggcctgggcctctcaggctaccccgggcctcttctttgttcgcagtcggcggccttcatggagcccaggcccggccctggctgcctggccgtcggggttcgagttggctggggcccttcgagatgtgggatgagcttgttgggtcaggggtgcggttgtgacagcggcttgctgggccgtagctgaatgcctgccgctggcctgagaggtccagccaggcccctcggacgttactgaggctgggcgctgccggaggtgggggagggggaggggtggggggccacacccacctcgcaaccgttcagtgatggaaatcattctcattacttttaattttaaaattcacaagagctggaggaagtgatttccccctctgttctgaaggttgtgagctcaggtttgctgagttgcacagagaacttaaaaagttcttaagttacattaagcatttctgtttgagctccttggcccttaatgtaagcaagctgaaggcacgtagtagtggagactccaggacctgtgtatcctcatgtctctgtccaaactaaagattctgggctttgagaaactggaattttcattctggaaggttctttctttctttctttctttttttttcttttcttttttttgagacggtgtttcgctcttgtcgcccaggctggagtgcaatggcgcgatctcggctcaccgcaacctctgcctcccgggttcaagggattctcctgcctcagcctcccgagtagctgggattatagacgcgtgccaccatgcccggctaatttttgtatttttagtagcgacagggtttcaccatgttggccaggctggtctcgaacttctgacctcaggtgatccacccgtctcggcctcccaaagtgctgggattacaggcatgagccaccgcgcccagcctctggaaggttctttctacagtcattcttattggaaacttctccttaacatctatggcactttgtcatctctttcactccatttaactctctctgcctctgaacaggcatctgcttggatcacccgtggatccggtaaaatgtaggtgctttctgagtgtcgacttgaatttattgaatttaatataatctttgcttctggaatataaacagttttcctgttgaaagatgaagacagtagtggccagaatgcctttaaataggctatgacattgcatggtgtgtcgtttaatgtgttcatccagactgaggctatacttttgggtcagagtatgagtaaatgttctgtgctgtctccctctactgctccacggtggtttaatagaataggaaaaaacaaacaaaatcttttgtagatggggatcaaagtccccgtctagagagggttcttccagcagtcaataaaaaagtacggaacaggccaggtgctgtggctcacgcctgtaatgccaacactttgggaggccgaggcgggaggatcacctgaggtcaggagttcgacaccagcctgaccaacatggagaaaccccatctctactaaaaatacaaaattagccgggcatggtggtgcatgcgtgtaattcactatgttggctactcgggaggctgaggcaggagaattgcttgaacccgggaggcggaggttgcggtgagctgagatggtgccattgcactccagcctgggcaacaagagtgaaactctgtctcaaaaaaaaaaaaaaaaaagtaaccatctaaaaatttttggggaaaaataaatcatttttcccccttattgagtttttgttttctctggggtttcacatctgtagttttgaggcacccatatttcaactaccattagtttaaaagcatgatgttaccctcataaaagagtgtttacatgtgttagcaatcctctaacacatgtaaggtagtacagatttacaaaggtgagtcagacccagcttttcaagggcatgctatctagaaggaggcgtatcatatacaaacaaaaagttttgtgtaggagtatgtttattggtagaattggagttggatgttgaaccaggtatctggtgttaaaggaatttgttacctttctttcatttagttagtgatgacttccagaaatgagaattatttttgtcaaactaagactgggagaatgttccagaaagagaaaggcatagacttttagacacttgtaatctctgacttaagccgtgtcaatgcccaaaggccaccaataacacacccgtagttaaacaagttgggtttattactcattgcattgagagagcatactccatggggaaccctggggtgtttcattaggagggtgttagaactgattataggatttgggtgttggtgattaggggaggggagggttaaggaggttgggtttcacttcagataagatcctgtaagaaaatatgggagtttcgtggttgggtatctgaataaatcttacctgtagggcagggagactagtataagaacaaaactgtaattgctacaggagtagcagtcactcaatttggccaaagggtgtttggtatttcgtgagtggcatagccactatgtatttgtctgtgcttataacaaaattgtgaaatggcctttgtctcattttatgaggatttcagagtaaccttgtctgaggttggtattctgtgagattgtttatgtcccataggagaataacatggcctggctgtgagtgctatgcctgcttctggagtgtcacgggttgccttttttttttctttctcaactgattgctctatgcagggcctgttgaaaccagtggttttacatgtgcagatttgttatttaaaaaaaaaaaaaagaaagaaaagcagccgggtgtggtggctcatgcctgtaatcccagcactatgggaggccgagacgggcggatcatgaggtcaggagatcgagaccatcctggctaacacggtgaaacctcgtctctactaaaaatacaaaaaaattagccaggcgtggtggcgggcgcctatagtcccagctaccaggaggctgaggcaggagaatggcgtgaacccgggaggtggagcttgcagtgagccgagactgcgccactgcactccagcctgggggacagagcgagactccgtctcaaaaaaaaaaaaaaagaaaagaaaccagtggttctggctctggatgaagcacttcatttatttgttcagtaaaaatcgtttatggagtacctactcttgtctatcattaagctaggtgtggggttcttggacagcactttaacactctctgctttctatagcatgacccacagcttatgtgtaagtgtgagttttaaagtgttaagttccagtttggaggcattggctctgtctccctccatcctgacacagggaactgtccagtcatcacatctctattctgtcttggatgctgcagggctagtgactatgagagaacacggctgatgtgaggagaaatggtggacaataaagacttcagcagtggcatcgtctgtgcttgaggtgaacggtagcaaagaggccagctaaagcagggttactttcaagattgaatttactttcacgatgaacataatgaacgtgtttgtcccgagaaacatagttgttaaagcattggtttatttacaaggtgcttgtttgttttgggtgttgtgagcagagaacagagcgtagctgtgtttgagagctgtttgaaagatattgttcctgtccttacctaacagagtctggtggaaagagtgctaactgaacacatgagattgggtccttgttcttattacacttatgctctagtgaccatgattcacttaacctttatgaacctgacgctcttcatccagacagatatgaacagtagtgcctaactcataggaccattttgagatttgaattggaaaatggatttgaaagtgctttgcaaattctagtgtgcagttcaagtgagtgattatgatgattgcgatattaaaccttagatgagagggatggtcacagagcaatggaagaatagagcctattagcagacctattcatatatgaaaagttaaggtatgacaagaggcgctcttacaaattaatgaggagagaatgacccattcaggaaattgtactgggacaattggtaatccaaatggcaaaaagaaaataagatcctgccttatgccatacacaaaaatcagtttcaggtgcattaatgacctaaacgcataaagaaaaactactaaaaagaaatataggagactatctttataatattggaaagggggagaatgtgttaagcaagatgcacaaaacacaaaccctaaagacaaagattggcacatttaagacaaacttgaagaagacatttgcagtgcatatcattgagagatgactaatatcacgactatttaaagaacacctacagaccaataggcaaaagacgtattacctaatagaaaaaggggcagataatataaacatttcagagtaaaaggaaacaagaatgaccaataagtctgaaaagatgcttgactgcaattatgaccaggcacatgtacaggcataccttgttttattgtgctttgctttattgtgctttgcagataatgcggttttgacaaattgaaggttgtggcaacaaagtctgttggcgtcatttttccaacagcatgtgttcatttagtgtctctgtgttgtattttgttaattcttggaatagttcagattttttcattattattatatctgttctggtgatctgtgatcagtgatctttgatgttaactttttttttttttttgaggcagggtctcactctgttgcccaggttggagtgcagcagtgtgatcatagctcaccgtagccttgaactcctgggtttgagcagtcctcctggctcagcctaccaagtaggactacaggtacctgcctagctaattttcaattttttaatttttttagaggtggggtctcattatgttggccaggctggtcttgaactcctggacttaagcaatcctcttgccttggcctcccagatccctgaggttacaggcttgaaccactgtgcctagccttgatgttactattgtgattgtttattatttatttatttatttttgagacagggtctcactctgtcacccaggctggagtgcagtggtgtgatcttggcccaccgcaacctccgcctcccagcctcaagtgatccttccacctctgcttcccaagtagctgggactgcaggcatgtgccactgtgcccagctagtttttgtattttttgtagagacgaggttggtctcgaactcctaagctcaagtggcctgcccacctcggcctcccaaagtgctgggattacaggtttgagccactgtgcccagccaccattgtgattgttttatggcaaaatgaaatgcacctatataagatggtgaacttaatcgataaatgtatgtgttctgactgctctcactggccattcctccatctctctccctctccttgggcctctcctctgagacacaacaatattgaaattaagccagttaataaccctacaatggggtcgggtgtgatggctcatgcctgtaatcccagcactttgggaggctgtggtgggtgtgtcacttgaggtcaggagaccagcctggccaacatggtgaaaccccgtctctactaaaaatatacaaaaattagctaggtgtggtggcgggtgcctgtaatcctaactactcaggaggctgaggcaggagaatcacttcaacctgggaggctgaagttgggtgagctgagatcacgccaccgcactccagtggcagagtgagactctgtctcaaaaacaaaacaaacaaacaagccctacagtggcttctaagtgttaaagtgaagagttgcacatgtctcactttaaatcaaaagctagaaatcattaagcttagtgaggaaggcatgtcaaaactgagacaggctgaaagctaggcctcttgcaccaagcagccaagttgtgaatgcaaagaaacaatttttgaaggaaattaaaagtgctattccagtgaacacccaaatgataagaaagcaaaatatccatattgctgatatgaagaaagtttgagtggtctggatagaatataaatcagccacgacattctcttaagccaaagcctaatccagaacaaggccccaactctttcaattctatgaaggctgagaggtgaggaagctgcagaagagaaatttgaagctagcagaagttgattcatgaggcttaaggaaaggctccataacataaaagtgcaaggtgaagctacaagtgctgattgtagaagctgcagcaagttatccagaagatctaactaagatccttgatgaaggtggctgcactgaacaacagattttcaatgtaacagccttctactggaagaagatgccgtggaggacttttatagttagagagaagtcaatgcctggcctcaaagcttcaaaggacagtctgactcttttgttaggggctaatgcagctggtggcttgaagttgaagccagtgcccctttaccattctgaaaatcctagggcccttaagaattatgttaaatcggccgggcatggtggctcatgtctgtaatcccggcactttgggaggccgaggcaggtggatcacctgaggtcaggagttcaagatcaggctgaccaacatggcgaaaccccgtctctactaaaaaataaaaaaaattagctgggcatggtggcgggcgcctttaatcccagctacttgggaggctgaggcaggagaatcgcttggatctgggaggcagaggttgcagtgagctgagatcgcaccactgcactccagcctgggcaatagagagagactctgtctcaaaaaaaaaaaaaaaaagaattatgctaaatctactctgcctatgctctgtaagtggaacaacgactcctggatgatagcacatttgtttacagaatggtttactgaatattttaagcccactgttgaggccaacttctcagaaaaaaaaaaaaaaaaaaaaaaaaatatatatatatatatatatatatatatatatatatatatatgtatattcctttcaaaatattactgctcattgacagtgcacctagtcccacccaagagtgctgatggaaatgtcaaggagattaatgttgttttcatgcccgctaacataacattccttttgcagcccatggatcaaggaataattttgactttcaggtcttatttagaaaatactttccgtaaggttaaaactgtcgtaggtagtgattctgtgatggatctgggcaaagtcaattgaaaactttctggaaaggattcaccattctagataccattaagatcatttgtgattcataggaagaggtcaaaatataaaaatgaacaggagtttcgaagaagtggaattcaaccctcatggatgattttgaggggttcaagacttcagtggaggtagtaactgcaggtgtggtagaaatagcaagagaactagacttagaagtggagcctgaaggtgtgactgaatgcagcaatctcatgataaaacttgaagggatgaggagttgcttcttatggatgagcaaagaaagtgatttattgagatggaatctatttctgatgaagatgctctgaacattgttgaaatgacaatgaagggtttatactgtttcataaacttagttaataaagcagtggcaggggttgagagtatactctgattttaaaagaaattattctctgggtaaaacagtatcaaacagcattgcatgctgcaaagaaatctttagtgaaggaaagactcaatcaatgagacaaacttcattgttgtcctcctttaagaaattgccacagccactccagccttcagcagtcaccacctggatcagtccacagccatcaacattgaggcaggacccgccaccagcaaaaagattacaactccctgaaagctcacatgatcattagcattttttagcaatgaaatattttaaagttaaggtatgtacactgttttttagaataatactgcatacttaatagactatagtataatataaacataacatttatatatactgggaaaccagaaactttgtgtgactcactttattgtgatattagctttattgtggtggtctggaacagaacctacaatagctccaaggtatgcctgtaaattaaaatgataggatactgtttctcacattagagtaggaaaattgaaaaagcctgacatgaccaagtgtttctgagaatgttcagtgacaggactttttttttttttttttttttttttttgagatggagtctcaccgtgtcaccccaggctggattgcaatggctcaatcttggctcactgcaatctccgcctcctgggctcaagtgattctcccgcctcagcctcccgagtagctgggactacgggcgcccgccatcatgccctgctaatttatgtatttttagtagagatggggtttcaccatgttggccatgctggtctcgaactcctgacctcaagtaatctgcctgccttggcctcccaaagcgctaggattacagacgtgagccaccgtgcccagccggactttttttatacagttggtggaagtactaattggtacaattgatttggagaacagttttacactatcttgtcaagctgaagttgtatgtctttatgagttggaagttttgctttttagagaagctcttacacatgcaggtggaggtagaatgttcattgcagcaaaaaattgaaaacagcctcaatttttgtcagctggaagaatggataaattgtggtatatttatacaatggcacactgtacaacagctacaatgaatgaaacagaaccatctttatagaattaaagcttagaaatataatatcaaataaaaagcaagttgaagaatgatataggcagtatgaaattatttttgtgacatgtcaaatcatactgtatattgtgaatgcccaacgtgttttaatgaataaataaatacagtggaaacgaccaactccaatcctggagtagtggttacctgcgaagttggggcatgtttgagggagagggcattgggattgagaaattgtataatgtatctgtttctgttttatttctttttttaaaaattgaggcaaataaagcaaaatgctaatggatgttagatatagtggtgtttgctatatttttctgtttgattttgcttgaaatatttaataatagaaatcaataagtctaagctgtttattaccacagtacaaaaactacttataaagcagtaagttaaataatctggtaactgttgaccactcacaatggtccaggcacagtgctaagtactagatattcagtaatgagcaacacatataaaggcactaccttcagattgagggagacagacaatagatatgttaataaataattacctagataaagtgctatgagggaaataaagagggtgatgaaatagagaataattggtagaggctattttaaatagagtggtcagggaaggcttccttgaagaggtgatattctagccgggtgaaacttgaaagttaaaacaaatggtgcagaaagctggggcaagaacattccaacaagtccacagacttagaggcaggcaaaggcttagtggggttccaggagcagaaaggatattagtatgtttggagtgtagtgaggaataagttagagggagatgaggatagaagggtttgcaagatgtaggtcatgtagagccttgttgccatggtaaggagcttgggttttattgtaagagcaatgggaaactattaaagagttttaagcagagaagtgactttgtaggatttgtgtttcaaaaaagattattctggctgctatgtggattataaaggggcaaaagtgaactctagaaaaccatttagggaggctgttatagtagtatgggtaagagatgaggtggctcagtttagggttgtggaggtggaaagccatggacacatttgagatatatctgaagagaaccttgaggccttgatggactcgttggagaggaagggaaaagaattaatgactagtcttaagattttgacttaagcacagagtagatgacaactgaaatgattaagactggagaagagatttaggggccaaaatcaagagtccccttttggacatactagtttgagagtcttgttataaacaatttccatgtgaaaatgtgaactagtgatataactatacaaatacagagttcagggcagtagtctgggtgaaaatagaattttatagtatcttagacttaattgattgtaaaatgcaccactattttatttttttccctcatgatgaggggaaaaatgctgctgattatactgtgatacaagctttcttattactttgagtatttttaatttattgaaagagctctctgagagtttatttaaactgttaatgctgttcagccaaagatcaccaaaacacaccttgtagttaaataagttgggtttattgcttgttccagtgagggaaaacacacatcgtagggaaacatgtggtatctcagtaagatggtgttaaaaaagaccttgttatataggatttgggctttgattatgtgatggcgggggtgtctaaggaagtggggtccgctatagattggatgttgacagaaagcagggacagttctatgatttggtattttgtggttggcatagtgacctgtcattagacaaatttatgcaatggtcttgttttgtttaattttaccatggtctcatagtaacctcaagttggttggtattctttgaaattgtctgtgtccccaaaagggggaattagaagatgatacaaacttttacatacacccaattgagtattatacagctataacaagaaagagtaaggtctttatgagctgataaggatttatttaggtgaaaaaaaaagcaagatgtataagaatgtatattgtatgctaatttttgtatagaaagaagggaaaataagaatatctgttttggccgggtgcggtggctcacgcctgtaatcccagcactttgggaggccgaggtgggcagaccacgaggtcaatagatcgagaccatcctggccaacatggtgaaacggtgtctctactaaaaatacaaaaattagctgggcgtggtggcatgttcctgtagtcccagctacttgggaggctgaggcaggagaatcgcttgaacctgggaggcagaggttgcagtgagctgagatcatgccactgcactccagcctggcgacagagtgagactccatctcaaaaaaaaaaaaaaaaaaagaaaagaaaagaatatctgttttgtatgtttgtttgagacagggtctcactctgtcacccaggctggagtgcagtggtgtgatcctggctcactgcagtctccacctctcaggcccaagtgaacctcctacctcagtctcccaagtagctaggactacaggcacatgccatcacgccaggctaatttttgtattttttgtagagacagggtttcaccatgttgcccaggctggttttgaactcctgagctcaagcgatctacccaccttggtctcccaaagtgctgggattacaggcatcagtcactgtgcctggatgaaaataagaatatctaaatatatttgcaaatttttgcaaaacacgcatatacagagaatagataaaccagaaatgaatgaaatggttaccggtatgtggggaataggaatgtggtaaaggaggatgggtttgggagcaagacttctgaggaaatcattttataaagtttgaattttgaacaatgggaatgttttacatattcaaagataaaattgtcttaaaaaaaacaggccgggcttggtggctcatgcctgtaatctcagcactttgggaggctgaggcgggcagatgacgaggtcaagagatagagaccatcctggccaacatggggaaaccctgtctctactaaaaatacagaaattagctgggtgcgatggcatgtgcctgtaatcccagctactcaggaggctgaggcaggagaatcgcttgaacccaggaggcagaggttgcagtaaaccgagatcgtgccactgcactccagcctggcgacagtgggactctgtctctctaaaaaaaaaaaaaaaagaaagaaaagaaaaaagcaaattaaataaacagaaccaaaaggacctaactgtgtatcaaattgatgacaaaatcttacagataaattaatcaatacacataatatttgaacacagtactctggtactttagtagatcatgtcctttttaaaaatcaaccttccccccttttagtggaatatattctaaggacaaaaagaactgcaattaaatgttacacttacaagggttatttctcccttttctttttttttaaattgaatacaaattttcttttttcttattttccacagggaaacttctgcaagtaattagtaggtttattgttggtaaaaaatattgatattctaattctgaaacttttttgggataaaacaaatatataaatgtactaatgttattaggaagcttttcactgtaaaagatataaatcttaaataacaaggtagggagaagccttgtaagagcttgaattggaaacttcactatgacatcgttttttaaattcctagctagcccactgaaagatgaacattgactatacctcagtgtacttagatcatggcttctacattaccatttccaaccaaagaaactatgcctccttgaaaaaatggccaattattccaaatctgtgccagaaaaagaacagtatcctcaaaagctacacggtcatgtcagaatcatacaggacttgatttgaagggatttctactggccaagtttgtgacaatttgaacatcaacaagagtaataatggtaatggaatttggctgagtggatcacaaaagaaaatctgtgagtcggcggggcgtggtggatcacacctgtaatctcagcactttgggaggccgaggtgggcagatcacaaggtcaggagatcaagaccatcctggctaacatggtgaaacctcgtctctactaaaaatacaaaaaaattacccgggcctggtggtgggcgcctgtagtcccagctactcgggaggccgaggcaggagaatggcgtgaacccgggaggcggagcttgcagtgagccgagattacgccactgcactccagcctgggtgacagagcgggactccatctcaaaaaaaagaaaaaaataaaaagaaaatccgtgagcccatagtgaaagtaaaaaagaaatatagaccagagagggtacaggctggtggtgtttgcgaaggcatcatgagggatctagagctgttcagtctctttactgtgacagttggtagatgaacctatacaggtgatcaaattggatagaacttaacacacagacgcacatgcacatacctgcaagcgaatgcaagtaaaactgggaaatctgaataacataggtgggttgtgtcaatggcagtatcctgattttgattttatactatagttttgtagaatgctaccattgggggaaactaggaaaagtgtacaagggatctctcagtactatttcttttttaaaaatttttatttttgtgggtacacagtaggtgtgtatatttatttcttagagcttcatgtgaatccatatctcaataaaaatttcaattaaaaaaagggagaggagaaaaagggaaaactcctttttacagaagaatgccaactagaaaatgaaaaaggaatgattgaattagaaaattataatgttgccgggtgcggtggctcacgcctgtaatcccagcactttgggagtccgaggccagcagatcaccagaggtcgggagtttgagaccaacctgactaacatggagaaaccctgtctctactaaaaatacaaaattagccgggcgtggttgcacgtgtctgtaatcccagctgctcgggaggctgaggcaggagaattgcttgaacccgggaggcggaggttgcggtgagccgagatggcaccattgcactccagcctgggcaacaagggaaattctgtctaaaaaaaaaaaaaaagaaagaaagaaaattataattttgtgacctccagtgtaaaattgcatcaggtaaggattaacaatggttgaccgtaccattggatgaaagagtgttgtgagggaatggcagattacattattaggtaacttgctaattacaaaaggaaacactacagtggaaagttctggcagtcaccttctcaatttaatgatcaaatttattgtcaccctcttaacataaggatgccataagtaaccatatcacctatgaaatatttttgttaaaaatggttaatatgaaggaatggccagacaaatccagaatatgatacattttacaagacaattggcatgggctaataaataaaagtgtaagtctgtattaaataaaaataggcatggcaatcaagaggaatgcatgaacctggattggatcctggatttttttttttttttttgagacggagtctcgctctgtcgcccaggctggagtgtctcagctcattggaagctccgcctcccgggttcacgccattctcctgcctcagcctcctgagtagctgggactacaggcgcctgccaccaggcccggctaatttttttttttttttttgtatttttagtagagacagggtttcaccgtgttagccaggatggcctctatctcctgaccttgtgatccgcccgcctcggcctcccaaagtgctgggattacaggcgtgagccacccgtggccgattctggatttttttaaagtgtaaatgtagtggcttcaggataactgcatcaagagtgccatcaaaattcgcaatttatttcttctttccctgaatctgggcaggccctctggcagcttagtgaatagaatgctggagaatgatgctgtgaccagttccaggcttactctttgtaagagaactgccagcttccgcttcttctctcttagaccacttgctcttgagacattccctctcggaactgagcagtcctgttgcgggagacccaagccacatggagtggccaaatatagttattctggtcttagctgaactaccaaatgacaaccagcaacaattatgagctaagtgagcgacccgtcttgaatgttccagcccaatatactatagccccagccaacatcacatggaatagaactatatagctgagccccagtcaacctgtagaatcatgtaggataataaaatagttgttttaagttaagttttagagtggttgcgtgcattacagtaaataacaaaaacaattgaacatctttgagacaattgttcatgtagattttttattagataatatggaattattgttcttaggtattagaaagctttggtaattatacaagataatataatttcttaggagaggaaatatgtggaggttaagtatgatgtctgcagctcattttgaaataattcagcaaaaaactatgcatataaaaggcaaatattgggagctttcattatattttgtagaatggaggctacccccaccctaaaaaaaccaaatatgacatttagcaatcaattggtagaaggtatatgagttttcattatattatactattttttctttttttacttgagacagggtcttgctctgtcacccaggctggagtccaggctggtcccaaactactggcatcaagtgatctgcctgctttggccttccaaagtgctgggattgcaggtgtgagccaccatgcctggcctagtttttcaatttttttgtagatttaaatgttttcaaaataaaacattggggtgaaaaggatcacattaaaaatacacagagttttggggttccccggcagccaccagtgtgctcagtgatttgctcgaaggattcatgggacttagtatataattgtactcatgactaaggtttgttacagctggagaatacaggacaggatcagtaaaggaaaaaaagcacaagtggagtctggagaaatccacgtataagcctctttatcattcttcctcctgtgagggggtatatttgagcacactccaccagcgacgaaaaatgcaatgacttatgtataacttttctgcccagggaagcccgttagtgattgagttcccaggattttttttttttttgagacggagtctcactctgtcaccgaggctggagtgcagtggcctgatctcggctcactgcaacctccgcctcctgggttcaagcaattctcctgcctcagcctcttgagtagctgggattacaggcgcacgccatcatgcctggctaatttttgtatttttagtagagacagggtttcaccatattggtcaggctggtctcgaactcctgacctcatgatccacccaccttggcctcccaaagtgctgggattacaggcatgagccaccgcgcccggccaagtacccatgatttttattggggcttgttacttaggtaacctctgcctaacatgtaccaaaatttcaggctcctagaaggaaagttgatattcaccataaatcacattgtttgtaggcacagtttaggaacattggaccacccttattagttaggtgatggaggaaagccgagtttctagatagatgccagccaaaggctgatcttggaagcaggcccttttaaagactgcagcctcaggcttgctatattaactcttctgcacacatactaatcacataaatttgaagataaatactaatgatttgaatgagaaaggaaactcttgtctaaagggttagatagcaggtagtttattgtgaactctttgtagttctgccagagattctgaaaatgggatgaattgatttcagttcacttaacagttattgaggcattaggtatatggaaatgaataagacacagtccctgccatcaaagaagtcaggtcaagaggggcagttaaatgatcaacaatgattgtggaacagtgtgataagtattatagtaaaggtgaatacaaagtaggaaggaaactgttgattctgatgttagggtgaggaggagagaacaggaattaacatttgacctgaactttgaaagagaagtagtgttcaacaggcatggaaacttagatgggcactttagtcagaggaaaaaaagcaactggaatgtgaattcttactagttgccagggtctgtgtgtgctattataacttaatccttacagcagacctgtgatgtaagtgattttattgttatttttaaaattatggctgggcatggtggctcatgcctgtaatcccagcagtttggtaggctgaggtggaggattacttgagcccaggagttcgggaccagcctgggcaacatagtgagacttgtctctgcaaaaaatttaaaaaagatattagccaggcatggtgatgtggacctgtagtcccagatacttgagaggctaaggtgggaggatccttgagcctgggagatggaggctgcagtgagccgagattgcaccacttcactccagccctgggtgacagagggagattctgtctcaaaaaaaaaaaaaaaaaaagatgattaagatgatttgaaaattttcgtattcccttttccctcttcactcctttttttgagacagggtcttagtctgtcatccaggctggaatgcagtggtgcaataaaagctcactgcagcttcgacctcctgggctcaagttgtcctcccagcttagcctcccaagtagctgggaccgcaggcatgtgccaccacacttggctaatttttttatttttgtagagacggtctatgttgttcaggctggtcttgaactcctgggctcaagtgatcttcctgcgtaggcctcccgaagtgttgggattataggcatgagctaccttgcccagccactctctttctctttttattttttaaaagaattagagacagggtctgactacttgctatgtatgttcccctagctgcatttgaacccctgggttcaagtgatcctcccacttcagcctccccggtagctgggactataggtgcatggcaccgggcctggctgttcactcctcctttcataagcaaaggcacagtttcttttcttgtaagagatgggctaggttgtgtagattgagctttctaataaaaacaactaaaagtgttgaataaaaatgtcttaaaaacatcgaaaagttaacacggtagaaatgaaattgggaactcagataagctgaacgtggaaactgcttttgccttgcgaacatttgctcaactaagtgaacttgaactttggttttgacagcccaacagggcgcaggcaatagaagtaaggtcaaacccagcctggtgcggtggctcacagctgtagtcccagcactttgggaggccgaggtgggcggatcacaatgtcaggagtttgagaccagcctgaccaatatggtgtaatcccatctctgctgggaaaaaaaaaaaaaaaaaaaaaaaattagctgggtgtggtggcgcacacctgtaatcccagctgctcgggaggctgaagcagaagaatcgcttgagcctgggaggtggaggttgcagtgaattgagatggcgccactgtactccagcctgggtgacaaagcgagattccatctcaaaaaaaaaaaaaaaaaaaaagatcaaagcccaagacccaccaaaggtgtaacatgtaataggaaatcttctccataaaccgtatttcagagaggactatacacttagggttaggatgaactagaaataagcccattccatctgcctgtctccagttgccttaacacttagctaagtattaatagaagaaaaggtccttgagaagttaaaactgtaagttggctctcaaaggttatgtagcccaaattcacacaatttaggagaaccaaaactctaaacttgagaaccctcaagccatgcatttagtttaaagtggcctcaactggtaggacccctaggtccctggcagaagcaaatgcagatcgatcctctgtagtagctatgctgatatcacacaaaatagacttttaggcacaagtgtatttttagagatagaaagggcagttcataatgataaggtttcagtttaccaggaagatacaacaatattaagttatatgcatctaggctggacacagtagctcatgcctgtaatcccagcactttgggaggccgaggcaggcagatcacctgaggtcaggagttcaagactagcctggccaacatggtgaaacctcgtctctgcaaaaatacaaaaattagccgggcatgatggcagtcgcctgtaataccagctactcaggaggctgaggcaggagaatcgcctgaacctgggaggcagaggttacagtgagccgagactgagccattgcactccagcctgggtgaatttttcaaaaaaaagaaagaaaatattaaacaagttcatatcagataaaatggataaattccaagaaataaagacagtttctataaaagagatagaaaacctggatagcccaataaccattaaatacatggattcagtagtcaaaaatcttcccacagggaaacttgcaggtctaaatggcttcacctggaagttctaccaagcatttaaataaataattgcagttaataattatttgttaatctgttgctacataacaaatcacccaatatgtagtggcttaaagcaacaatagtcgtttattgtctctcacagtttctgtgggttaggacttcaggaggggctctgttgggttgttctggcttggaatctcatgaggttgtggtcagatgacagctgtagttggggaacacagaaagctaagcccacagaagaaaaacaaacaccgtgacactgggaaggagctgcctcttgcttgttaaccttgagctggaagtaggagttgggttgtttctcatccactggaaaaagtgttaagtagtttcactttacattatgatgctaaattgaaggtatgtagcaacttctgggaatcaatgagcagtctggagaattttgacctctcccgagtcttgtttcctttgggggttaagagagtctggagcctctaagttagagacacaggcacagcgtgtttcattttcattcaccacctgcaatcctctgcccttccctctacctgttggaattaatttatcattcaggttgcagtacaggtctcacctttggtgaagcttttccccaccactctattcctgttgtgctctctctctctcctaactctgctaacacttactgccttttaccacccttttcgtcttgaccatatgtttcttaataactatttgatatcttctcacagaaagtgcctcatctgtcccactggatcctctgttctacagctcaggggttgagtcctggagatctctgtattcccgtgtcatatctcacatagcaccttgcatgactggccattttcagaatggactaattcagtacttgattgtttgcacagttagagcaggttagggtccttcttgcaggagtctgcagtcttagataggtacagacagacatagagaaagcctacagagatgtgaataaatgactaaatatatttctgggggaggcacagagtaggagtttgagtccttatgggagagggatgaggggaagaagccccttgtttaatctcattttttctcttcattaaaatgccttcttgcatccttggtctcttttcacagaaccctgccatcagcatcactgaaaacgtgctgcatttcaaaggtcagtatcccagcaaatgctcccatctctatacacagttaaggaggtgtggtggtggtttcccttttttaaaaaaatgtatttgtcttacttgttttttgctgatgttcacgcctctgatcctcatgaggtaagctaaattgttttgaaatatatgattagaaaagtcaaagaattggtttaaaatcctgtttcccccatggagaggcagtagatacagtgaaggaaaaaaaaaaaaagaatcctgggttagaaatcaggagacgtgtcttctagctctaattctgccgctatcttggacaagttattgacttctctggacctgtacaatgaagatgctgggttttaatctgtgtttctcaaactcgaggacccgtggacaccaaataatgtttccacaggactctcaagggctcatggacccgagattgagaaacgtgaagaattaaatatggtcactttaagtgatatttggctccactgcagctgtgaatacagacacacatacagctactgattgcatggcagtacttgattatgaagtggccatctagatgatccagaatatgctgctttttttaaaaaaaaattattatggaaacataaaatagaaaatttatttatttatttattttgagattgagtcttgctctgtcacccaggctggaatgcagtggcatgatttcggctcactgcaacctccgcctcctgggttcaagtgattctcgtgcctcagtctcccgagtagctgggattacaggcatccgccaccacgtccagctaatttttgtatttttagtagagacagggtttcactatgttgtccaggctggtcttgaactcctgacctcaagtgatctgcccacctcggcctctcgaagtgctgggattataggcgtgagccaccgtgcctgttttttgttttttgtttttgtttttgttttttttaaatatttttcttttttttttaaatttattatttttttattatactttaagttttagggtacatgtgcccgttgtgcaggttagttacatatgtatacatgtgccatgctggtgcgctgcacccactaactcgtcatctagcattaggtatatctcccgatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaataaaaatatggaacgcttcacgaatttgcgtgtcatccttgcacaggggccatactaatcttctctgtatcattccaattttagtatatgtgctgccgaagtgagcacatatttttctttttaaacatttaaaaaaataataattatttattacatcccttctcactattcctaagaaattttcttgatgagactttgtggctccctgatactagattagcagaccagtttgagaaacactacactctagatgatgtctcaggccttttcagctctgacagtctctgattctgtgaatctgcctctatctgccttctcctcagtccctcagcagatttactgctctactggagagggtgggatttccattcactgtcacccagtggggtaggattctctctgctctctgttccagttcctgggattattggagcataaagagtttctgctttatgtgaaattccatctactgtaatatacttgcatgaaagtacagcctggcttttgtatctgcttttcaagatgagagtagtcaccactcagctcaggttttttgggaattatatacatttacatgaaaattaaagtgataaaagcatatcttgccacttagaccttatatactgtcctaccttaaggaatttatcgtcacagagaataattgctacctgtagcgaatattaggcaggttattagtctacatatgatcagataaggaaagagagtcccagaagggaaccaaatggtaaatgaatcagagaggagagtggaagggtggttcagcagcagctgctgggtccagcagtcactggcatctaggcatggtgccagctagaattggggaaaggagccatgtcaaggcatagggatggggcattggccaactcaggtacttccctcctagttccacctgtccttcataagctgcgaaagattgtatttctttttccttgttccatttgggatgtgctaaaggaggagtcagcttctgccttcattctctctccctggttgggaggttttagattcagagctgtccaagacaacccagcatttccatgtaccctgcagtcaagatgatacacccaccaatttttgtctgctctagatttagagccaaagtaattgtgaaagttaaatttatatccgtgtggctcctttggcattgctttctctattctttttcctgcctgttatttgtgtggggtatcatcagggtcacagtggaagattgggtaaatacgccaaaactgacatcagaggacatatggagataaacttgtgtcaaagatttggcctatctagctgttgaggagctctgcgcacaagcccccacacattttaacaggacccattaagatttgtggactacgatgcttcttggccttttggctacaatcaagtatgatattcgtgccaggtacagtggctcatgtctgtaatcccagcactttgggaggctgaggcgggtggatcacaaggtcaggagatcgagaccatcctggttaacacggtgaaaccccgtctctactaaaaataaaaaaaattatctgggcatggtggcgggagcctgtagtcccagctactcgggaggctgaggcaggagaatggcatgaacccgggaggcggagcttgcagtgagccgagatcatgccactgcactccagcctgggcaacagagcaagactctgtctcaaaaaaaaaaaagtgtaatattcgcatacttgggaaagaactgcaccaagctggcttttggatggccttgctctgctcaagtttgcagtaacccacatttctttctttatagctcaaggacatggtgccaaaggagacaatgtctatgaatttcacctggagttcttagaccttgtgaaaccagaggtatgttctttcctttctcacttcccttcccattttaggaaatgaataccagtagtttagtgaaatggggagcagggtttgtggagagaagaagataaaaaccaaaggggaataatagagttcttttatttggaacagagcccaggttttagctgcagaggaatgggaaagtcagagaccccaagttgagtcagggccctgccatttattagcagtgtgatcttgaacaagtctcttaacttcttcgagttctggtgttctcatgtgttaaatgaaggtctggactaagtgatccttccagctctgatattctctggttttagtgatggcagaggaatatggcacccattgagaacagagttacatagagtggttgaagcccccaccaggggttactttcatgtgactttgccacagttgcaggtgagaaaaatagaaatcagaaagggtgaaggcagctggccttcagaaagaatgctgcagatatcatcaaaacttcccttcccttagagcctgaggaagcttctctcataagcagggagagaatccaatagatggggtattttggcttctggaattacacttagctctggtggcttgagcttcttgatttccgtgcgcaggtgctcagttgttttgagaaagcatgaataataaccagtggtacagtgggcagagaacctgtcatggagcttcctttggagaaaagggacaggacatgtagacaaacaatgagctggaatggcctataagaatttgagtttagttgggaagactccccaaattgacccctgtgaaaaaatctgtaactgatccaatacagttctgatcttgatgcaggtgtttctaaaaccggggtctgctgagccaggacagtcattttcatgggaggaaaatttataagctgagggtaattggatgcagtacccttgagagggtgattggacatagtaccttgcatgatgtggctgtggcaggaggttcatgctagttccctccagcctaaccaggaactatttgcctttcttatcctgatatcctcctgtatcattcactgggggaatcagagaaggacattatgtccttaccagttctccatgccagccgttggtctagatcaacctttttggcaccagggaccaattttgtggaaggcactttttccacagatggtggaatggggatggtttcagggtgattcaaatgcattacatttgttgtgcactttatttctgttattattacattgtaatatataatgaatacaactcaccataatgtagaatcagtgagagccctgagcttgttttcttgcaactagacagtcccatctgggggtgatgggagacagtgacagatcatcaggcattatagtctcataaagagtgagcaacctagattccttgcatgcacaattcacaatagagttcacgctcctatgtgaatcttgtgccaatgctgatctgacaggaggcagggcttaggcagtaatgcaagtgatggagagcgagtctaaatataggtgaagtttcactcacttgcccaccactcagctcctcctgtgtggcccgattcccaacaggccatggaccagtatcagtccatggcccaggagttggagacccctggtctagatgttccctttgcatcaggacttgcaggaccagagaaagaaggagaataaatatatcctgcagcttctatgtacggcgcccctggcatggtgctgcttcagggaacagaagagggcattctcacattttcactttctctcctagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggttagtaaggatcctaggatctagccattgaggacaaatcatggggaacccacgttattcaggccacttcagatacctctcggtctgaaagaatagctacaaagttacaaattcatttaaagacctggtgatgtgattttcaagaagtattggctatgtattttatagactttccttcggttgaaatctgtctgatgtttctcttacaactagactaaggtgatagatgttgaggagaagaccactgaagtaaagtgcaattcttatcacatcatatcaagagtacatacggccgggcacggtggctcacgcctgtaatcccagcactttgggaggccaaggtgcgtggatcacgaggtcaggagatagagaccatcctggctagcacagtgaaaccctgtctctactaaaaatacaaaaaattagccgggcgtggtggtgcatgcctgtagtcggagctgctcaggaggctgaggcaggagaatggcgtgaactcgggaggcggggcttgccgtgagccgagatcacgccactgcactccagcctgggcaacagagcgagagtctcaaaaaaaaaaaaaaaaagtacatactgtcaacgtgacacatcactgttgatattaaccatgggttagctggcttgaggtgacgcttatcaggtttctctaccataaggttattttcctcttggctctccttggaaggaagtcactatgtgtagcctacatttaaggagcagggagttatgcttcctgtcctttagatggagggagtatctacataatttatttggaattcttctgcataggagaataattatgcatgtctattgtctcccatttatttattcaatcatttatatcatgtgagtacatgggtatttattttatactttgagttataatctaatattatttattttgttgctcaaattcttccagctttggcactaactggcctttggttatgtcctcatcctgcccatctttcatttggcttttgtatctttttgagaaagcgccatcattatgggactgtttttttttttttttttgagcacttccttactttctggcagtataagctgctccaggcttatcttgcatgtatgtttcctgctccagccctggaacagccatttcttcaagcatctctgttcttattgtggaatagcattggaaaccaagatctgggtgccgggtatgctcattgctaccaggttgccattgcctttaagttctcttcactgacagaacaagaaaatatatgtttggatagtaacccatgcatacacatacacctgtaaatatttctgtatggatccatctgtatctctgttaagctaaacgtgagttcatagtgatgttggaaacatgatcttagcttctggaaaaattatactaaaattctagaagtcttgaaaaataaaatagcagtctacctcctgccttaaacttctgttttatttctctgactgcgacagatcttctggatgtcctttccagctttaagattccaaggtcacttgtcagtttggaagccagctcactgggttaattttgtgaacaatggatgggcacctgtgatgctaatgctgcttagtaagcaggagtcaggcgtttggccctatgacctagaatattctcccaatgatgcactgaccccaactggaggagttggctttgagggagtcagattactcagccagcatatggacttttgcaagcatctgggaattctaacttgtgttcttggaaaacttttgtctaaattctaggaagaagagcgcctaaataaactccgactggaaagcgaaggctctcctgaaagtaagttgtgctgctgccatggtagttaccagttaacttgtgctagtgttggaagtatggataattgtgatgtggcaggagagctaatgatttcatcccggtgagctgtgtgggtgagtttatgaaaaagcttttaggtccagtgcttaaggtctgcactacccacgtcagaatccttacctttaatgtgtcctttgtgttttggttgttatttcatgagtacaccaaggctagtgtagcagaatgaaagaactcctggactggcctcatggcagatggcaaccaaatcctgcagagacttgtggaaatgattgcatggatccaaggctacactccttcagcctggtgtttttctcccagctgaaatctcaaaggctgtatgatacataagtgtggttgtcagcctgaaagatggagagtattctgtgtagtcctgctattcattaacctttaacaaatcaatttctgtttccgtctaaccactttaagcaggaagctctgtaagtgtattatcttctgggtgatgtagttagattaaattcagcagctatctgttaaagtcatgctgtgtggcaagcattgtgctgggcccttgactaagagccagagggatccatcgtagcgcctatactcaaaagggcttacattcttagtgagggaactgcaggtgtatgtaaaactacctctgaaaagcagaatgaaataagtccttcttacttgttctaagttgaaatttttcaaattttagtggtacttatctagcatgccataaataagggaggggaaagttttggagcagtagttttcaaactgtgttccatggtgccccagggggttcccagagatgctttggaggagtagatcacacaaacaggtctacctcagtcagagcagctctcttttgagtgttatgtgttggcattccgaataaggtttcttttgagaaggaattttaaaaaatatttgaatagcgactaccttaggggaatattctttcaggaaagccgaggaggggagaggttcagtggaggcaaagaataacaacataaaaaagccactttgagatttaaattaatgttttggtgtcttaaagggataaacttcaaaaatagataaaaattctaatatatggattttttgggtgttaggtaaagctttaactgttttacctaaattcataaagttttctgaacaaggaagttctttatggtggggaagtgtaatagatttttgtagttttgaagaaataacttttaattagctaaatgttgctagaagtctgacattttttggagtcttaggataaggctgtgttgtttttttttttttgagatggggtcttgctatgctgtccaggctgatcttaagatactgggctcaagtgatccttctacctcagcctcccaagtagctgggattacaggcatatgccactgtgcctggcttaggctgcttttgattgaccacattattaaatgtgattatttgaggaccaaccagatgtctttgcagaatatctgtagcctaggaataaatatgtagcagcaaaatctgaacaccatagatctcctcttaagaactgtccttttctttaccctactcctttgactcaacaatgactctgtcaaagcctcttgtttcttcctttactctgtaattggctgtatcttcatgaatcttaggctgcagataaaattaatgtcccttattttcctgcatgttggtttgaaattgtcctgctttggttatgtcctcagtctgcccatctttcaaagcccagatcaggccaagtatgatggctcatgcctctaatcccagcactttgggagactgaggcgggaggatcttttaggccaggagttcgagatcagactgggcaacgtagcaagactgtgtttctacaaaacataatggaatataaaattagcaaggtgtggtggcacagacctgtagaactaactacttgggcggtgaggtgggaggatgggttgactccaggaggtcagggctgcagagagctatggtcccaccactgcattctaacctgggaacagagtgagaccctatctcaaaaaaaaaaaaaaaaaagcccggattagataccagctttatccatgtagactagcttgatgcctacttctccagcctaatgtcgttttttcaccttgaaagtttcacaagacattacttgttactccccacctggtattacagtttttagattgtaagctctgagggcagccttgaactacctttgtatcccagtagttcttctcacagtaccttgcacattgtaggtattcagttaatgcttggttgagtgaatatataaccaaatatcagggttgtttttttcatttactgtatctgtctctttgagctagtttgacctcagtgaccttaaagaaattccagaaaagaagaaactatggattatattaagatgactggagggccaggcacggtggctcatgcctgtaatcccagcactttgggaggccaaggtgggcagatcacctgaggttaggagtttaagaccaccctggccaacatgatgaaaccctgtctctgctaaaatacaaaaattagccgggcgtggtggcggaagcctgtaatctcagctactcgggaggctgaggcaggagaattgcttgaacctgggaggtggagcgtgcagtgagccgagattgtgccactgcactccagcctgggtgacagagcaagactctgtctcaaaaaaaaaagaaaaaaaaaattgagccggagctgaggaaatctttatttcctttttgtaatgcctcttcagatggccactcatttttttgccaggtgttatggaaaaaatacaacactacaacactcaactgctttttcctattttcttactcaacaacaatcaacacagaagacttctgtgaccaagtgggtgggttttttcccccacataccaagcaagcaatgagttctgcagcagacaccagctgggtgccctctggttcaattctgacactgtttacctagagatagcatcaggttcccacagatggagggctcagtccccaagacacacccctgcccccagcctgtcccgagtctgaacctccagaacttgtgaccaataggctgtaaattacggttcccacaacccgctcctgtggtttgattgatttgctagcgtggctccacagaactcagggaaacacatttgttcatttattataagggatattatgaaggatacagatgaagagattaggaggaagtatggaggaagtggcgcggagcttccatgccctccccaggtgtgccaccctccaggaacctccgtgtgttcagctgtctggaagctgactaaaccctgtccccttgggccttttatggagacttcatcggataggcatgactgaagcgtgttgaactgtgttgaaatgtgattggacaaaaagggtctgacctaaacccagcaaggcctgtctgtccagattcttctcagcctctctgtgcagtgttccctcctccagagtatgaggcaagaccctctctggaatgagggtcttaggacccacaatcagattagagtcgtgccttgggcagctgaaaggaaggcagggaaggtcatagagggagattctgttgtctgaggcctaaagtgtcccaacattataacaaaaaactgtaacaagggctgtgggagttataagccagaaaccgttgccgaaaacctatatatacatatacacatatcataatatcacaccaggggtaatatttttttcttgggtttgttatgtctgtatacctattcttcaaggctgggaaaggaagtcctgctgaaaatacatgctggagagcaatgttccttgtatgtttctctgtgggagtaggagcccaggctggtgaggacctggaccaggtatttgtgtgggagcttaggagcattcaggaaggaaaaagggttgaagtcatccagatatgcctcatacacctgtctcctgctgggactattgcttttaatagcttactgctttgctttgctttacagctcttacaaacttaaggaaaggatacctgtttatgtataatcttgtgcaattcttgggattctcctggatctttgtcaacctgactgtgcgattctgtatcttgggaaaaggcaagtaagacatttttggattaattttccctttctcagtagtttggcccagtattcaccaaagggagcactctctgcctttgatgttaataataacccctgcatttgtgcagcaccctctacttttcgttgtgctttcatagctcttatttcccatggccttgtgaaataagctgactggtattctttccatataacaggtaataaaatataggcctagagatggtcaaaaatggttcacatccatagctagccagagccacatcttgggctagaatccttttgtaaaaatgttcactaacaactaaataaattgatgtgatacttccagtgccaaagttatgcaaggccaaaagggttctcacccttttggagcctaaatacgttctaaaatgaactattctaaaacagaataaaaagagcatcataaagatattagttcttcttaaattaatttatgtgtttagcaggattctggctttgaccagtggcattccattggtaaatgccaatgggaaatttttgagaatttgatctaaagtattctgaaactttatttgatgaataaataggtaataaaatttaggagaagaaagattaatgggagaggatttttctacctgataatgaaagtatggaccaggtgtagtagctcatacctgtaatcccagcactttaacaggctgaagtggaaggatctcttgcgcccaggaggttgaagctgcagtaagccgtgatcatgacactgtactctagactgggtgatggagcaagaccttgactcttaaaaaaatttagaaaggtggctgtgcgtggtggctcacgcctgtaatcccagtactttgggaggtctaggtgggcagatcacgaggtcaagagatcgagaccatcctggtcaacatggtgaaacccccatctctactaaaattacaaaaattagctgggcatggtggtgcgtgcctgtagtcccagctactcgggaggctgaggcaggagaatcacttgaacccaggaggcgggggttgcagtgagccaagatcgtgccactgcactgcagcctggtgacagagtaagactccatctcaaaaaaaaaaaagagaaaggcatataaggtgtacgtgttaactttctggtaactggtagagcttactattcatgaccccattggcctgcacccttcctgcttagttaagtaagaaacttgaatctgactggatgtttgttattcctttcttacagttattttcacgaaaggagtaatctagtttgagaaatagttctgttggaatttaccaactgattcacccttaatgtatatttttgcctatagagtccttttatgacacattccatactgtggctgacatgatgtatttctgccagatgctggcagttgtggaaactatcaatgcagcaattggagtcactacgtcaccggtgctgccttctctgatccaggtattgaatagttaagctgaagggtgggtaatggaaggtcccattatttgtctagtgggtatgtgtattagtccattttcatgctgctcataaagacatacctgagactgggcagtttacaaaagaaagaggtttaattggacttacagttccatgtggctgggaaggtctcacgatcatggtggagggcgaaaggcacttcttacgtggtggcggcaagagagaatgaggaagaagcaaaagcagaaactcctgataaacccatcagatctcgtgagacttattcactatcctgagaatagcatgggaaagaccggccgcactgattcatttacctccccctaggtccctgccacaacacgtgggaatcctgggagatacaattaaagttgaaatttgaatggggacacagccaaaccatatcattctagccgtggcccctccaaatctcataccctcacatttcaaaaccaatcatgccttctcaacagtcccccaaagtcttatttcagcattaaccccaaagtccacagtccaaagtctcatctgagacaaggcaagtcccttctgcctttgagcctgtaaaatcaaagcacactagttacttcctagatacaaggggagtactggcattgggtaaatacagccgttccaaatgggagaaattggccaaaataaaggggttacagtgcccatgcaagtctgaaatccagtggggcggtcaaactttaaagctccaaaatgatctcctttgactccaggtctcacatccaggtcacgctgatgcaaaaggtgggttcccatggtcttaggcagctccactcctgtgactttgcagggagcagcctccctcccggctgctttcaccggctggcattgagtgtctgcagcttttccaggtgcatggtgcaagctgtcagtggatctaccactttggggtctggaggatggcggcctcttctcacagctccactaggcagtgccccagtagggattctgtgtgggggctccaaccccatgtttcccttcctcactgccctagcagaggttctccatgagggccccatccctgcagcaaacttttgcctgggcatccaggcatttccatacatcttctgaaatctgggcggaggtttccaaacctcaattcttgacttctctgcacccacaggctcaccaccacgtggaagctgccaaggcttggggcttgcaccctctgaagccacagcctgagctgtacattggcccctctcagccaaggctggagcagctgggacacagggcaccaaatccctaggttgcacacagcacagggaccctgggcctccgcgcctgtgatgggagggactgccatgaaggcctctgacatggtctggttacattttccccatggtcttggggattacattggggattacgttaggctccttgctacttgtgcaaatttctgcagccagcttgaggttctcctcaaaaaatgggtttttcttttctactgaatcatcaggctgcaaattttccaaacttttatgctgtttctcttttaaaacggaatgcttttaacagcacccaagtcacctcttgaatgcttttctgcttagaaatttctcctgccagataccctaaatcatctctctcaagttcagagttctacagatctctagggcaggggcaaaatgctgccagtctctttgctaaaatataacaagagtcacctttgctccagttcacctttgcttccaagaggttcttcatctccatctgagactacctcagcctggactttattgttcatatcactatcagcatttttgtcgaagccattcaacaaatctctacgaggttccaaacttacctacattttcctatcttcttctgagccctccaaactgttccaacctctgtctgttacccagttccaaggtcacttccacattttcgggtatcttttcagcaacatccaactttactggtaccaatttactgtattagtccgttttcccactgctgataaagacatacctgaaaccaggccgtttacaaaagaaagaggtttaattggatttacagttccatgtggcgggggaaggtctcacaattgtggtgcagggcaaaaggcacttcttacatggcggtggcaagagagaatgaggaagaaacaaaagcggaaacccctgataagcccgccagatcttgtgagacttatttactaacatgggaatagcacgggaagaccagcccccatgattcagttacctccccctgggtcccttccacaacatgtgggaattctaggagatacaattcaagctgacatttgaatggggacacagccaaaccatatctgtatgttacattttgctaagaagtctcaattagtaaaaacacctatttgtacaggaatagcattattttacctgaacaagaaagaacatttaaaaccccagggttatttaccaaagtagacttttactatttcaggtctttttcattttttataatatccttatgaaatcacaaagttataaagagctttaagactagggaaatttgactcttaggcaggagctgaaaaacctaccttcagtctccttagttagaaatgtatgtggtctcctcccaccttgtgtagatgaaggcagtacttcttaaaaacttgtattaatgaaaagtacaataatcaaactttaaaatttacagccaggcatggtggctcattcctgtaatccccatactttgggaagctgaggtaggaggattgcttgaggccagcagttggagaccacccttggcagcatagtgagaccccatttctaaaaaaataaaaatttgccaggcatggtgatgtgcacctatattcccactacttgggaggctgagacggaaggattccttgagtgcaggagttcgatgttgcagtgagctgggattgtgccactgccctccaacctgggcagcagagcgagacccctgtctctaaaaaaaataaaaaataaaaatttaatggatagtttgtgttgtagattagacatagctgaagagaaaattagtgaactgttttgagatacaggaaggaatagagagcacaaaaagtaaatatacagacgtaattttcttgaattataagactcaatattataatattgttagttctcatatttccctgtagattcaatacatttccaatcacaatctaaaaaattttggaatgtgaggagaaaattctgaagctttttgaaaaaacagagggccatccaggatagtagcatcattttcgataactaaaatgtgcaagcaacccaagtgttcatctacagatgaatggataagaatgactgttacatacatacaatgggatattatgtagccttaaaaatgaaagaaattctctcgtatgctacaatgtggatgaaccttaaggaaactatgctaagtgaaataagccagtcacagaaagtcaaatactagatgattctgcttacatggggtacttaaaatagtcaaaaccatagagacagaaagtaggatggtgtttgccaggggctggctgaatggggagttattgtttaatgggtcatagtttctttcttttttttttttttgagagtctcgccctgtcgcccaagctggagtgcagtggcacaatctaggctcactgcagcccctgcctcctgggttcacgcaattctcctacctcagcctcccgagtagctaggaatacaggtgcccatcaccacgcccagctaatttttgtagttttagtagagatggggtttcccatgttggccaggctggtctcgaactcctgaccccaggtgatctacccgcctcggccttccaaagtgctgggattacagacgtgagccaccgtgcccggcaatgggtcatagtttctattttacaagatgaaaagagttgtggagatggatggtgattatggttgcacaacataatgaaggtatttgataccactcaactaaacacttaaaaaatgattaagatggtaaagtttatgttatgtgtattttttttttttcagatggtgtttcactgtcacccaggctggagtgcagtggtgtgaccttggctcactgcaacctcggcctcccacgttcaagcgattctcctacctcagcctcccgagtagctgggactacaggcatctgccaccacgcctggctaatttttgtatttttaatagagatggggtttcaccatgttgtccagtctggtcttgaactcctgacctcaaatgatctgccagcctcggcctcccaaagtgctgggattacaggcatgagccaccgcacccagccattatgtgtattttaccacaatttttaaaatgggaaaaagaaaaaagcaaaaggtcgagaatattctttaaagacgagctcaaattggggacttaccctataaaaaatcaagacagtataaagatttagtagctaataccacgttgtatggtacaaagatagtcacacagaccacgggaacagaataaaacccagaaacagacaacccagatatctatgaagaatagaatgtctatcatatattggaatgtcttgccacgtgaaaatgagtggactatagccacatgcatcaacatagatgagtcttggccgggcgcggtggctcatgcctgtaatcccagcactttgggaggccgaggcgggtggatcacaaggtcaggagatcgagaccatcctggctaacatggtgaaaccccgtctctactaaaaaatagaaaaaattagctgagcgtggtggcgggcgcctgtagtcccagctactcgggaggctgaggcaggagaatggcatgaacccgggaggcggagcttgcagtgagccaagatcgtgccactgcactccagcctggacgacagagcgagactctgtctcaaaaaaaaaaaaaacaagaccaaaaaacatagatgagtctctggcccgtaactctgagtaagaagtagtcacagaatgatacatatagaatgatttcagaaagttttaaaacaggcaaaatgaaacaatatactgttcaggaatacatacacaagcagtaattcataaagaaaagccatgggccaggcacagtggctcatgcctataatcccagcactctgggaggctgacgcaagaggatcacttgagcccaagagtttgagcaagcttggccaacacagtgagaccccgtctctacaaaaaaataaaattagccagtgtggtagtacacacacctgtgatcccagctacttgagaggctgaagtgggaggattgcttgagcccagaagttcaaggctgcagtgagccatgattgcaccactgcactccagcccgggtgacggagcgagaccccgtctcgataaaaaagaaaagccatggaattattaacacatgatagtagttatttataggggtcccacgtttgtagtgctctatttcttaacttgggttatataaactcaaatgtttatttggcagtattctttagactgcgtttgaacatgtgtctgtattttaaagaaatgatttatgatatagttacacaaaatactgtacctgtctagtcacaaagactggtttgggcactttacttgttccagaactggagcaggattaaactggtcgaggtcaatcttttctatttgccttgcatttagtggggttagatttcagataacacatttctataactttacatatattttattaacttttttctctcttttgggtctttctaatagcttcttggaagaaattttattttgtttatcatctttggcaccatggaagaaatgcagaacaaagctgtggttttctttgtgttttatttgtggagtgcaattgaaattttcaggtgggtagaaatgccaggatggtgtttgaatgctgctccctgtttgcagcagctctgttcttgagggagttgttatcttagccagagtctcatttggtttgggactaagattacatatgtggagaattctggttgcacctatgtgctctgcaaagttgagacagatttttttaaagccgtcattggatcataataccagactggatactagggagcagaagaggagaaccagagaaagggaagactcatcttaccatgacttcaggatcttgcagtcttggaaagagaggacccatccacatggaaaaattcttgaaagggctgaagaaacaggaggttgaaggagcaatccaggttggatagaactaatttaagactaaatttctacaagggatgatagaaatgaatcttataccacaagattattgaagtttgaaatggcctctaacccaattttcccgttctcggttgttagtagcataaatatcttttaagaaatggatctagttaaagtagatgtattcttctttaccagaccatacacactccatatgtcttccctttcagtcagctggagcaaggattttgcaaatgaacttctcagctccaggtttggtggtattttgacaaagttgctagttgagagagagaacaggccatagcagccttaaattgtgtcttaaccatggtctgtgtcccatggcacccagtgtaccctctaatagccttaatacaaaggtaaaacagattataggtcctatgtttttcaaatcagacacgtaatgtgctgatgtaacaaggtttgagggaagcacatctcacacaggagagtgaaaatccagttatcacacttatgagctataaaaggatcagattatgggtccttaatgcaatgtttactgtttgagaaggaacatttattttctcaagggatgtcttttaaaatagcatatgtctgattctagattagaggtcttctgtatactttaattttggtaacaactcacttatccagaaataaagtatctaatatccttacccaccgggaatgtatatcagcactaggaataaagccaaaaaacatctgagtatccagtccgtttaccgaataaagagggttcctttgagacctaaacttagtctgccattaaagagcgttcagatcctttgaaaatttagggcgcagtgtggcaggagtttatgggttgatagccagcgttataattctgttctgaagaagccatgtgtggctgagaaatagaattcttctatttaaatgatattctaaggttgcattcggaacctgaagtggcttttcacattggaatcatttattttcaataggtactctttctacatgctgacgtgcattgacatggattggaaggtgctcacatggcttcgttacactctgtggattcccttatatccactgggatgtttggcggaaggtactctcagggactcttagctttcatagcttagctccagggggtacccagaggctgagagaccagtcctttcttccccggccttagtccgataaatggaaatgttggatttttcagggatttctttccatgggcttccttccataatactcctggtacccagactgttcgagaaaagtagctcattttgtaacattggaaagccaggtggttatgtcctgcatgcttcccatttgtatgatgcttttagtattccaaagggggttcttactgatgactttattttattctgacaaacatctcatacataagtcagctagggattttcctctccattttatagaatagaagaagcccactaccatgacttcctcatctgtctctctgttgacaggttggaggctgatctcttagaaaagtaggggaaaaaaaggagaggcatgagctttctgtacaaagggaggagaaagcctttccagcacacccagaactgaaactttagagtactaggactggaagttcctgtcattaaatgtgactgtttcatttgcttctaacaagttcttgtttctgttttcagctgtctcagtgattcagtccattccaatattcaatgagaccggacgattcagtttcacattgccatatccagtgaaaatcaaagttagattttccttttttcttcagatttatcttataatgatatttttaggtaagtattgattctttaatacagactttttcttgtcacttcttagacagtagaattaaatcattcagaaatgtaaaagtccatatgagaattcttttgggacagaattagagaatgattactttgcaaaaacagacccactaggggaatatgctatggtaaggaaatatttcttttctaaatctccagcagttaaattatgttctttaagtgctcttggtgattgggaatataccataagatatttcttgtttaaaacaatgtaaggggacaggcatggtggctcacgcttgtaatcccagcactttgggaggctgaggtgggcacatcacaaggtcaggagttcgagaccagcctgatcaacgtggtgaaaccctgtctctactaaaaatacaaaaattagttgggtgtggtggcgggtgcctgtaatctcagctactcaggaggctgaggcaggagaatcgcttgaacccgggaggcagaggttgcagtgacctgagattgcagcattgcactccaccctgggcgacagagcgggactttgtctcaaaaaaaaaaaaaaaataaataaataaataaaaattaaaaaaaaaaaagtaaggagccttttaaaatagactaagaagctcccacttttactaatttcagtagcatattcctcatccagagtttatagaggtgataagacaaccagcagcaaggaaggaagaagggaataaaggcctctgagcagccaagggttgtcataaagccttccacctcacaataggaaagtcccctgctcctcatggaaaacctgctgacctattaatttatataaaatcataaattcctgcctttataaactaacagaagggaaaaagaaagaaacctaaattattacaaatatgacaaatttaaaaggcttcctaactataaggatttttttttgttgttgttgttgttaaattcttattagaggccaggtatggtggttcatgcctgtaatcccagcactttgggaggctgaggtgggtagatcacttgaggacagaagtttgagaccaacctggccaacatggcaaaaccctgtctctactaaaagtacaaaaattggctgggcttggtggcgcatgcctgtaattccagctacttgggaggctgaggcaggagaatcgcttgaacccaggaggcagaggttacaatgaaccgagattgtgccactgcactccagcctgtgtgacagagcaagactctgtctcaaaaaaaaaaaaaatttattagtaatcagtatttggtaatttctaaatgcaactatacatgattctacccatattatctatactatactctatacatagatgtgaaaatacatacattcttatgtgtaggttaaatacaatttgagaaaaataattttttccttttaagagcaaactaatacgtatcgattttagtatgacaactaagaacataaaaacagaatgaaaggaattttgtcattaaatatatttgagaggagaaaacactgattatcatacatagaactttacatgtttaaggataagacaagctcctaactataaggactctttaaagttctgatacattttagtggtaatttatatatttctccttgctttatttcacaaaagacttaaggtggccctaaataaatataactgtccagtctcctagccacagaaggatgcaacaatagtatattagttctctattgctgtgtaacaaatgacccccaaaacttagcagctgaaaacaataaatagttattatctcacatagttcctgaaggtcaggaagcagcctggctgggtggtactggctcagggtctcatgaggtttcagttaggctgtcagctggggctgcagtttctgtagacttgactggggctggaggatctgctccaagctcactcttgtggctgttgacaggaagcttcagtttcttgccatagcccgtctccatatggctactcatggcatggcttcccccaaagcaattggttagagagagagagcccgaagccacagtgcctaatctcagaagtgacaaatcatcacacagaccaacccagtataacatgggaggggactacacaaaggtatgaaataacaggagatagaggttgttgggatcattgtcacggcttgctaccccagacagtgagaggaagaccacgcaaggtaagcccaggaagccagaaagcccagtggtcttggtcatttagtgttgcgggaggagagacttataccatagtattaggagccccttagtgtgccagtgcctggcagatgtacagttaaatagtatacattgtaggcccacgtcatttgcaaaaggttaaaatttctttctttttttctgtttcagcaaagggtataatccatttcagaaatattgccaaccaaaaatattaaaatgttttgcccttgaagagaggaaccctcagttcagaaaatgtactaattaaagacagctttttacctttattactgtataaattcagtataactaggccccatgaaatgggcataagataaagaggaataaatattggaaagacatttaaaatattttagtgaacagggtagaggggtagaaatattttaaagtgcattgacttagtatctttttttgtgttgtttatattgtacactctaatttgcaagattttatgttcatatctactttgcttatagtgaatatgtagttgctcttttcttattctttagaatgaaataaatcctaatttcacatttataattttgaagcagtgtaaacagccagttaacatttgtatataggtcaaaggactttttagtttttttttttttttttgagacagagtcttgctctgtcacccaggctggagtgcagtggcacgatcttggctcactgcaacctccacctcctgggttgaagcaattctcttgcctcagcctccggagtagctgggattacaggcacctgccaccatgcctggctgatttttgtattttcagtagagatggggcgtcacaatgttggccaggctggtctcaaactcctgacctcaggtgatccacccatcttggcctcccgaagtgctgagattacggtcgtgagccaccacgcctggccatgttcttgagtaggcttgaattaaaaattaggttgtttctgcactttagatttgtgcatttcattgtaaattttactgtaaaagaaagaaagaatattgaactatacctacctgaagaattaggggggtgaggtgtattgatatctgcaacttaacactgaagtgcataaaaaatgagatggctggagggatagatgaatagggatgtgatatagccaatatagtaaaaagcagtaaatctagatgttccctgtataatgatttaatcttttgcgtgtttgaaaattttataagagaaaaaaatgttttaaactcactgggaggctgggtgtggtggcttacgcctgtaatcccagtactttgggaggccaagctgggcagatcatttgaggtcaggagtttgagactagcctgaccaacatggtgaaaccccacctctactaaaaatacaaaaaattagccaggcatggtggtggacgcctgtaatcccagctactcaggaggctgaggcaggaggattgcttgaacccaggaggcggaggttgcagtgagctgagattgtgccactgcactccagcctgggtgacagaatgagaccctgtcgcaataaataaataaataaacccactggggaaaaattgctttgtgtctattgtattgttaatttgttctaaattgtactccttcctgagccgctgcaataagctttttgctgtggaatatgacgacagctagatactgtccctgccacaagagcttctggttataaatagacaaagactctaatttctaattgacctcttttctttttcaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatc

SEQ ID NO: 38209 - DNA, 5584 bp, Homo sapiens
gctgccccggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccggccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgaggtaccttccaggacagggacccccgagcgagggaggggggagcagggccccggccgcccctgctgtggctgggcccctgctgctctgctggccgaggacagggactcagtgccaagcgcaggaggggagggagccccggtgggcccggggcctgcggagggagccgagctcttggtgcttttcccgaaggagcgcgggaggcccacgggtccggcgagtgcccggcatggcggcttttccagcctgctttgtgttaagccgaggtcctggcttctctgtgtctcccagctgggggccatgaggctccctgagatgactcttttccccttctcccaactccgtggcgtgactctcagcccagtattgctgctccgctgctcaggacagattccgggggctggtcctcctgcctcctggggttgaggtggcgtcccgttcttctccgtggcttggaggaaactacatcaggatggtggctgggaacgtgtaggggccctcagaggcccctgtgtagttggttgtcccctgtctgctttctggctttcagagatgagcggctagaatcaggcgaggggtttctgcttctgagccttagagtcttgtgaggagacccctccctgatgtggtggcacaggagcctgggtgggggcgggggtgactgggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggtacggagcccagtggggggaccttgggtgtctcagtcctgctgaggggtccagggcacactccccgctgcagcctgcacagcaggtagaatgatcctcctcagtgatcgctgtcgtctttttctgaccccgaaaccatcagcgtttctgattgcgcactcacatgaggcttgtagctcagcttcagatgctgctcatggagaagccagggcaggtctcctccccgctcagcctagcgaccagcagtcactagtgggtgtctatccccgaaagcccccgggtgcagggtcccactcctgaggctcctgcgccaggcccaccccagcggtcttcgtagctcctgggacagcagtcagtctcgtacccccatgcccggttctggttatgggcccagggcgacattctggctaggacagtcaggccccaactcctgaccctcagggcctggggccagggtcctgcctcccatcctgcctgactcttgtctgtgcctgctcccaggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtgaggccaggggcttggcgagaggaagcagaggccaccaagggagcgcgggtgtctgggactgggcccccttcctgtgccctgcatctcccacccctgtgctgggaagtcgggcgggtagagctctcgctctcttttggccagcagtggaagtgccctgtgtgtgtgtggcttctgtgtgtgtgcatgcagggctttgattccaaggggagctgttggagactgtggctcaggggccgcctccctgctggtttccccacccggctgtaggctcctggggcagcagttctctctgtggccctggtgcagactggtccctagaggtggggtttgaggccagcgggaggtgcccacctgtgtgccggttgggcctttgagggcagcctgagattggcggcttcctcccctcctccctggcccccgtgaccgccgccatcctgatggccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcggcctgcctcggcgggcgggggtgggcagcatggctgggccattggggcgcccgggctcacttggctctgcgcccccccgccaggtcagcgtctacttgcagaattggtctcatgtgctcagctacgtcagcaaggctgagtccaccccagagattgccgaggtacgggccacctcctcagagaccttgcccccaggattcctgaccactgctggcccctcctgtcctcccccacctcattctcccccagatctgaatctgccttcatcccctctcagtctgggggctgggcatcgagctctaggaaatgtggagcatgggcctcacgcatgtggcttcctcctacagcagcgaggagagcgtgacagccagacccaggccatcctcaccaagctcaagtgtgccgcaggtgagggcctgggtcacgcccagctgaccccacgttcccctgttgctaagtcctcccagcccagggcagtaggctggtccctgcctcagccagggaaaacttccctggcagggcgcaggatgttgtgggcacatgtacaggtgtaggtggtgcctaaagtctgccccggggaagccagtgggtgacgtgtggtcagggtctggctgctgtcactgtgggcgtgaggcaggtctgccagcccgagctgctctgaactggggtgtcctttgcagccctgctagcacctagggcttccctgcatgcctggcttcagggagcctcctcagcattggtggggctctttccacccgtgactagagtatctgtccccagcgctgaggaacagctcccggggcaggagaggccagcgagccggctggtggtcgcgttctccctggtttccaggcgttagcggcttccccaggctctggggtcttaccccctctcccccctccccgcccccggctccttccactaggcttggcagagctggccgccaggaagtacaagcaggctgccaagtgcctcctgctggcttcctttgatcactgtgacttccctgaggtgaggagccctctggggacttgggaggcagagcatgggctcatgggtcaggctgcttctgtaggagggtgaggtctctcacaaatggggtcttaggcattctccgagcgggtgatgggcaggcaggggtggcctggcccttcactgcctgtgacgccaggtctctgctcctcagctgctgtcccccagcaacgtggccatctacggtggcctgtgcgccttggctacctttgaccggcaggagctgcagcgcaatgtcatctccagcaggtaggtgccccggtcctgcagccctgaaggctgtccccgtccctctccgtggctgctgcttcggccttgcatgtcctggccccctggccccagcgttttctcaggtgtttgtctggggactggtgtcccactggccacttggagggaggggcaggcagaggacagagttctgaggggtctgcctcaccagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggacaacctgctcctggacatgtatctggccccccatgtcaggaccctgtacacccagattcgcaaccgtgccctcatccaggtaagcgtgggggtcaggctggcacacggcaggcgggcatgcagggggctgtggagctgacttccctctgccctgcagtatttcagcccctacgtgtcagccgacatgcataggatggcggcagccttcaataccacggtggccgccctggaggacgagctgacgcagctaatcctggaggggctgatcagtgcccgtgtggactcacacagcaaggtggctgtgggctgcggggcggtgggggcagctgggggtgagcctgggccccgctgagcttgtgcctgcacagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 38210 - DNA, 13315 bp, Homo sapiens
gattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccaggtgagcggcacaggctggtgggccgtggcggtcgggcggagaggactggggtgggggtccgagtcggagtgggcctggggtcggcggagggatgaggggagggtggaggaggccaagggtaggggcagggcggggtggccgagtgcccggggtctgagaaggctggtgtccgagtcagaggcggggcggggtggggagggcccggggtctgctgtccgggcttggtctcctataatggaatctggccgtggactctacctttgaggaaccaacattagctctttaagagcttataccattctagaatatagttctctactcagtgtttttcaaatttctgtcgtgtaaaaattttaaggagactgtgaagtagtgcagatttccaagcttcatgccaagatgttctgaattagtagattgaggcctcggtatttatattttagaccaacacttcccacccagtgattctgactctgggagcttgggtgccgcatcttgagagccatattttgattttcttgcggggcttcccaacaattctgtatgagagatagtgatatacttttttttgtttgtttttaatgggtgaagtcactgaggtaccaagaggttatatcacaaccagctagaactgaaagccaggtttaacgctttttagttggacactagtggtacaaaaggattccacacggaagatgcaaatgaagcatgggatctgtagggcttacaggcttttacttgtttctggggcgctttaattgctggaacgtgttagaagtaacacagacacttccagaccattcgtgggagggattggggtgactcaggcacgaaagaaggaggaccctacatggtcggtatctatggtcatcttgtctcaaaatctgatggaatctgccgtttggattctgttttccctgcttcagtgcagctggttcttgatgagagttctttgccaaggacttgctggatgtaaaaaaaaaaaaatgttattttgttgaaactttctgcttctttgagttcttttaaaaaaatatttttaattgtggtaaaatggtacacaaaatttatcttcactatctttaagcgtgtagtgagtgcattgatatgaaatagattgatagtgttgtgcagccatcactgtcaatcgtctccagaactcctttttatcaaattcgtgtctattaaacacattcccttctcccccagcccatggcaactgccattctaatttgtctctgtgattttgacttttctggcgaccttagataaatggaatcatatagtttttgtgtgtctggcttatttcatgtagcataatgtcctcaaggctcatgcatcttgttgcatatatcagaatttctttcctttttaaggctgaataatccattgtattattcaccacattttgcttatctgttcatctgtcagtggacacctgggttgcttccacatttcagccattgtgaatgatactgctatgaacatggatgtacaaatatctcttcaagaccctgctcgcatttttttggtatttacccagaagcggaattgctgcattatcttttagctccttcttggggttcttggtctttgcagtctttaccatggcctacattcactgctctgtgttgttgcttttctcagatggaacttttggtgccaacttggctctgattctttttcctttttccttcccattagtacttaagattctcagagatttcacttgtaggacttatacctcacctgcttgggatgcccacactagtttccaatgactaacagctgcaacactaaagggacatctctactaatatgtcttaaaacaacacatgtcccagctgatttatttatttatttattttattttagatggagtcttgctctgtcacccaggctggagtgcagtggcacagtgtcagctcactgcaacctccgcctcctgggttcaagtgattctcctgcctcagcctcccaagtagctgggattacaggcgcgcaccaccacacccggctaatttttgtatttttagtagagatggggttttaccatgttagccaggctggtctcgaactcctgagctcaagtgatccgcctgccttggcctcccaaagtgctaggattacaggcttgagccaccacgtccggcctgagcttgttttcttataagaccgctttacttacgtcctttgtgccctataattacccgattccaaagttgaaaaagtagtttcccagcttttttggtctttgtatacatgctgtcacaatgcagttcttcctttgtctctttatagccgtgtctcaaatgctgtctctaggtttactgcaaagccttccttgtttgaggtcttcttttctgaggggttattttgatcacttcagtccctcaagatattaacaagtaatactgtgtgtgcaggcattgttccaagtgctttacacgtattacctcgtttaactgttgcacaaatcttgatttttttaatgtggaggcacagcacacaggcccagagtcaggccttcagttacctatatggctctgctggagcctgctgcagactcccatttgagcaccctgctttgatggccctggttgccctttatatcacatcctcagttggaggctccttgtcagcacctcttcctctggctgtaccatctcctgtgactgttctgttctggatagatctctctgttgagcccatgatggaccttctccctttcaccctttgtatgagccatttcccacttctttgtcttggatgagcagttttccttttgttccatccagagtgtcttgcgctcgttctgtggacgagccccagcagacctgagccagcactcactatgggtgtatgtggcattgcgagggtctgtcatgtggacacagccataaatggttgtgcatttctgcctgacagtttttgcacactattcttctagtgcagttcttataaatgtcctgcttcttggaagttattgggaccttgagagcaggacctgcctcttgtttttccattgcattccaaattatgcattcaccaaaatgtaaaattgactgtatcctgtggaaaaaccccccagaaaattcacctgttttggtgagccaggtagcaaacagatggagctttcatggtgatgataattcataattatcagtatttgtgctcatttatagagtgtttgttactagggatgggagggaaaggaatgaaaccaagaagcaatgtctacttaatgtataagcccagaggtcactttccactgtgttggggacaaggtgataagaagtaggcaataaatacattttgtgtttcttagcgttcaggaattcatgaccttcacgagtcaactgattgtggagcgctcatcgaaaggcactagagcttctgtcaaagaacaaggtaagaagaccctccaacttctgtgcgtgtgctggcctggctgccatgcctcacctcacatagcacccagctttctcctttctactgggaccctactcctcctctagcttgttctctctttcccacctcttccttttcctatttatgcagaattctgtgcccactgttgaagtctgagcttcccagataaaattgccctcaaacttagactcatttaagattagggtctgactcttttggagcagtaagcagccttcatatcgtattcttccctatcctcttcagagttgcagacccctcaaaaaaggatttccagctagcactgttgaggtactatatgtattctgtgcatcgtagattttttgatcaggaatctgaaaaaactattttttctttctgataattcaggtttaggcatttatttagatgtgtatgttatacagacagatcaggaaagagttacatgagtttcatcaggtagggacaaagatcatctcacacttatgctaacctcaagtcacgtgacatagagttactgaattgatgatataaatgtcagttatgatacaggcaggattgactatatacactttatgtgggatctctgtgctattaacatcatagaagtgaaatcgcatcacaaatatttcagtgttcttgctctgttcttcaaactgtgcctgcccttcccacgtttattacttaaagacaattcctccactgaccaggttctcagtttctttggagggtatgcactttgaccccatgtttgaatcttaattggggatggtatacaaaatctggagagcattggtgacaaccccctgtcctcttcctcctcctcattcttgttctcatttatctctgctcttttctgatttcaggggctcaccatcattccctcctcttttatttgtttttctgttgtttagcattggaatcttctgggtcagatccttaaggacaagaaggttcttatttgtaagctgtaatccttacatttctctttccttggggatatggttagctgtatcaactctgaatcctttcaaagtgatggaaatgaacaatcctgtggattgtgaatattttgcggaagacctgtacaactgtacctttcaatcatatgaggattttagcacagtgctctggaggccttagctggcagtagctaatctttttctagactaacccccctactcccagtcacccaccagagtggagcaaacccagcaggttgctataatatggaagactgaggccctggggggtaatttcctgtcttttggctgctctgaaaagattttttaagaaagcagaggcctcttggcttgtccagggttccctaagtttgggagcagcacagagccccaagggctccagatccctaagatatagcttggcctgacccgagcttaaggaatacacttggaaatgctcctggggccatgttgtcaagggtgtgttttctgcaccactggctgtttctttaagccctggctttgcatactgggcctctgggtatttactggtcctaaagcaggcgttgggccaagctcctgtgtgtggcccattgggctgtgctgctaagcctctccacaagacttgcccagagctattgagcttccgagtggcttcatttggcctaacattggatgctttgatttggggggattaaaagaagtctgaagccctcatgtcagcatccatgtgtctgatctcttgtctccttagactatctgtgccacgtctacgtccggaatgatagtcttgcaggtgtggtcattgctgacaatgaatacccatcccgggtggcctttaccttgctggagaaggtgagttttttatttgcctctcctggacttggatgatgaatgggcacatttatggactgggacaggggttgatggcagtccctgagacataagggatgaaatgatgtgtccaaagtcaacacatttttcagcccccttccctgcaacccaagagacaatttggcatccctgtatgggtttcctccccggtgctgtccctcatgtgagctgggtctaggccactgagtcatagcatctattctctgggatgggaccctcggagacagctgtgccttgtgttctcgccccctgtgcttctgctcaaggagtctccctcttgaatgccttcactctccccattgcctcctgcagttgctgcatccctctaccttgatgtcagtcagttgcaccacagagcttagcacctaagcattctttaaatttttttgcgtacggtgctaattactaatattaactctttgaagtcagaggcttcatcctataccccagagcaccaaaatacctccaaacacatggaatctggtggtttcttaaatctaggggacctaattctcttttttaaaaaattgctttggaaaattagaggaccagtgccccttttttctggaaatctgtagtttaaaattcaaatacctttattactccccaagtgaggttcatctcgggctgggcatacttttgattctcagaatatttaggatatgttttaatgataaaaatttggaaagaactttagcctagattttctctgttgccattatatgtccccctcattcctccttcctgggctgtgaaggccaaggagcctcattcagggtgaggtgctcaggggtgaagccctgtcattgagaccactggtgagtgcacagtgggaggcttgttgagtctcctttgtcttgcaggtactagatgaattctccaagcaagtcgacaggatagactggccagtaggatcccctgctacaatccattacccagccctggatggtcacctcagtagataccaggtagggttaaaggaagcttcagcagacaccatgtggcccagaatccatgtgaaactgaaaaagccaactgccctgatagttctggtctaattacttctgacagcttctgatgctggtgtcctctctcaagccttactgtttggaaaacagagaatctacgttcagaccggggaacccaagctctaggcaggctttgggtttctgttacatgttaaacaggctgtgggtttttttttttgttttttgttttttgagttggagtctcactctgtttcccaggctggagtgcagtggcgcaatctcggctcactcaacctgcacctcctgggttcaagcgattctcctgcctcagcctcccgagtagctgggattacaggcatgtgccaccacgcctggctaatttttgtatttttagtagagacggtttcaccatgttggtcaggctggtctcgaactcttgatctctggtgatccacccgcctcatcctcccaaaatgctgggattacaggcgtgagccactgtgcccggcccaggctgtggtttttaacctgtgaaagtttgtccagcttcctcagttttaggttttgtttgcaggtagccactccagtcctgactttattatttttcactctttcctagaacccacgagaagctgatcccatgactaaagtgcaggccgaactagatgagaccaaaatcattctggtaagcaggaagatggagagcaagcccaagaactgaggcgggggtgcgatttccactggccaggcatgcacagatccatcctcgttttaatataatagtaaccacggcactctccagcaagtgggattgcccaccccttcccccaccccgggcatcagactgtctttcctatacccttctcttggttaatggcacccattgtttctaggggaccaagctgggaaccagtggaaccctcaagtctcccttcctcatggctactgcctgtctgaccatttactgggttcctagggtttggcttctgaagacctggattcccaccctggtgcctttgttagggtttcgggtgcctccacaccccacaggtgcctccccttgcagcgtttgcattgaaggtgaacagattgaagcaccgtgcactgaccacagggcagcttctggaatatgggcccagggttgtcacataggcccctttgaaaagagccagaaccctgcattttgagctgaaatctcctgatttgtaactgttgcttcaactctttttttttaaatttttgcatacaagtggaatgtaagcagctatctgtttttctcaggtttttctcttacagcctttgcctctaagtggtccccttgcctcctgctcacctccagtctgtccaccagagagtagtcattgatctgcacaacttagaacccttcagcagctctcagatccgccccaggataaagtgcaaactaactcacagtctcctgactgggccctgttctctcttataccctttcttgcccagctcacacacaggcgcctgaaggttgggcctttctgaccagatgtcacagttttgtcactgcttgtttacatgtctccctgaccagcgtatgagcactgggacatctttccatcctgctcatgatacagtgcctagtttataccatgctcagcagttgatagatacctggagtggattgaaacccacatacaaagctttaccatttacacaggcatagctttagtgtgtacatcagcgtctcctggggttggagttgttggcctgcgatggagcctgggaacctgcattttataaaaagcatcccaggggcttcaaacacaggtgtgctgactgcactccaaataacgtggctttggaatgaacgatagatgtgaaagtctcatggtatctgtgtcttttgaaaccttgtgagctttcttaccacctaggtggcatttctccgttttctcctcaagccatctctttctgttgctcaagtcctagtctgagtaccatgacacctgggacacccgctgtttctcctctccccacggtggggagtggatgagtcctattcacccagcctcatctagctgcagttgtaaaatctagatgattggtgtgcatatctgaatcagttaactttctgtgttaaaaatttgagtcgctcagctgtgtgtagggatgaaggacattcttgctggctccttgttctatggcgcttcatgtgtgcatctagctgctgcagcagtggccatctgaggagagaagcgagctgctgcttcctgagggccctggcagcagagctgctggctcttgtgaggtctccatctctagaccccttcccatggggtcagtgttttcatttcctaagtcagagtttgtagtgatgacatttaggacatagcccatttagaaggcaggacatgttctgtcatagtgctgtctggtatatatttggggcatgtgtgtaacttagaattttctaggagccatattttaaaatgataaaaggaaaataggtagaatttaatttaattatatattttacttaacgcagtatatccaaatacaatttttccaacatgtaatcggtataaaacttgtttttttttcagtataaaacttactaatgaagcatgtgtgagtttgcatctgaaatctggtgtgtctgtactcagagcgctgctcagtttggacttgcctcacatcaagtgctcaatagccatttcccaccgccttttgtttcctgtggctgctgtcaacagaaaccctcaaatatttgcttttaacagatagctctgtgggcctggctggtgtcttttggggctctgagtgtctgtcccaggcctctctccagcctctggtggctgctggccatccttggcattccttggattagaggtgcatcacttcaggctctgcctctgccgtcacgtgaccttctgtgtgtgtgtttccgtttcttaccaggacatcagtcatggaattagatgccaccctaatccagtattacctcttcctaactagttacatctgccaagaccctatttctaaatatggtcacattcagagattctggggatgttaatttctgggatgcggttggggttggggggtgcggtgtgggtcactctccaacccagtacaatcatatagtgcccagctactcttttttccaaagctccatgcacacgcacatgtgcgtgcacacacacacacacacacaaatgtatatataaatgtgtgtgtatatatatatatgagttttcctggagtgctggttatctaagcctgtgctggggacagctttttgggaagtctgctacatcccagttagatcttctagatttcacgggaatgtcaccaggttctgttccatccacttggacagtaactattcttggaccgagtctcgacacctagaggtgaagtttgtgtgtgttggagaggaacccaggtaaggcactttcccccatgactgaaatatgaggggctcatgtcagggcacgtactgaacagagctggattctcttttcttttttgtccagcacaacaccatggagtctctgttagagcgaggtgagaagctagatgacttggtgtccaaatccgaggtgctgggaacacagtctaaagccttctataaaactgtgagtacccagcacctgctgcctcctgggtgttctctctagagagcagtcgcagcttgctgcttctggcactctccactatgaacgggtctttcttagactgttgaatcatggtggatgattccttgtgcggcaagagcctaaggtgagcgcctcaggcccaggtggttggaggcagttcacttgggcgccgttggagtcgatgcgggccgaggccttgttccactcctgcctctgctctgccctctgctgctctggctgatttctgaactcctactcccagtccaggaaggctggttcaagttctgatcaccagagatttactgttgaatcttattcctctttctgctgagtagacataagtctttaagatgcaagcaattcagccttcctgaagaggttcttaagcttttaatttccctttgacagaaaatatttaattgacaaggatgggtgctgctgactgccgctttctctcaggtcagtgctcatgtcttcctatgtggagatggcactgttggcccatggttggatagtcatagggacaaatttacttggtctgtccacacacatttgctttcatgtgcacattggagggagatggctaggtgggattaggaagatagtctgtgaccagaaagcaagagagaaggtggcaacagtggtccccacaaaccacatcccaagtgggaaccacatctgttgtcctcaggaccatcttctaggaagaaacaccaccgtggtggtcagatagcattgtgtgaagacaggagtggggcaaagttaagatattctgccaatcccatttgtattattggtcctttgtttgtacctggcctaactgtaggaattttactcactttttgatagcattaatggggtgtgagaaaagaaaggaaaaaggatcccagactagttttggaagccggggcccgccttgtgcttggtgatgggaattgcttgtggacagcttccctcaaggcctccacccccaccctgttctagtgctagtttctctgcctggctgtgtcctgtggagctccctctgccacgcctgccaggattggggcttcccttacttcgtcagtcctccttctcagctcctctttgtttttttccaaggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttc

SEQ ID NO: 38211 - DNA, 13315 bp, Homo sapiens; identical to SEQ ID NO: 38210

SEQ ID NO: 38212 - DNA, 8923 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtgagggggtcggctaggatgaggaggggagagactattactctttggaggggaggagcctcggacccagtaacgtgaggaaaataacttgtgggaggcctgtggtcactgagtcccaaagttgggagagttgttgggtaaactctaaagggccctggaggtcgcgattattgtctgggagtgggaggaggtgttagggggcaagggagagaagaggctaattttgacgggggaggcatgggcagaactggggcaaatctggatgtgatggtcttggaaacatactgacacctgaggagaaaaaaattctacttgtggatatccatcattttctccttactcatatgtcccatggctgtgttttagggagaaattgaggcacagtacagcagagttgatatcccccaaggtggtctgaactcagcagcctagtaggctgaactgatggcagctgaaagggctgtgcaaaatcaagatagcctaaatccagttgcttggctctctggcactgctgctgtctttacatgattctgggtctgtcgcggttgtaggtttgatttcctctgcatgcctgtcttccatccgcgtttcaagagggagttcattcaggaacctgctaagaatcggcccggtccccagacacgatcagacctactgctgtcaggaaggggtagggaccatcccatatgccccttaattattagaggcaataacaacttctgctttatcggggccctcattctcctccttttctgacttggatatatttgttagtccctgggatatagataacttgttttctccttgcttctctattctgcatcaggctatcccatgtctatgtagaaaaaacctttgtctctcatttctactcttgattcccaaaactaaaaattgaacaagtaaagtgctgaaccttattcagtatttgtctttcttgggtgggggagtgcagactggaatacgctaattgtgggaaagctttctccatggattcgtccagactcaaaagtggagaagattcgcaggaactccgaggcggtaagactgtttgacttctctgctggatttttctaaccaagctgggtggggagagtggtcccctcccatccccaataacttggtaaattaactgatagaatgaaattaaagctattaggctgggtgctgtggtgcacacctataatcctagcactttgggaggctgaggctgtaggatcactggagctcgggatttcgagaccagcctgggcagcgtagtgaaaccccatctctataaaatatacaaaaattagccaggcatggtggtgcatgcctgtggtcccagctactcaggaggctgaggagggaggatcagttgagcttgggaaggtcaaggctgcagtgagtggagactgtgccactgcactccagcctgggtgacagagtgagactttgtctcaaaaaaaaaaaaaaaaaagctgtttgcttgttagctcaaacttttcctcttcatctccgttccaggccatgttacaggagctgaattttggtgcatatttgggtcttccagctttcctgctgccccttaatcaggaagataacaccaacctggccagagttttgaccaaccacatccacactggccatcactcttccatggtatagctgaggggctcctttcctgctgcatatcatagtagtcagattgtgctaagtaccttcttgtgcctagccattcagtgaagggtgtgtttggcagaattgaagtatcagtattggcgggcacagtgggtgatgcctgtaatcccagcactttgggaggctgaggtgggcagatcactgagctcaggagttcgagaccagcttgggcagcgtggtgaaatcctgtctgtataaaaaaccaaaaccaaaacaaaaacaaaaaaacacaaattagctaggtggggtgtcacacgcctgtagtcccagctacttgggaagctgaggtgggaggatgacttgaacctgtgaggcggaggttgcagttagctgagattgcaccactgcactccagcctgggtgacagagccagaccttgtctcaaaaaaaaaaaaaaaaaaaggtcagtattgcgcacctctccatctaaaagtggtatgaagagagtttcaaaacatgtaaatgtaattattttggaaacttacgtaagacaaggcagatatttacataaggatctatatataaggtacatgttcacttacaaaattacaaattgggaaaagcatataaagggattaacgaggtctggatgaagttttttttattgagggaaactttctggacccaatgagttcaaaagagagttctaaaagggtgactgttcatgtgcagttctggatgcgggtacccttggtggcaccagaggacctgagagatgatataattgagaatgcaccaactacacacacagaggagtacagtggggaggagaaaacgtggatgtggtatgtctccctttgctgctgtaccagggtgcaagggatagggtgaggggaagtacagggtgcaacctgtagggaggtctccttgagctgtggtgattggtcggccatatctagtttactgtacttttctgtatttgactgaacaggtggcacaacttccggactttgtgtgactatagtaagaggattgcagtgggtgagtccatgagaatcctgggatgggtgtggcttctcttacctcctgtgaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaaggtgagtggtaggagggttctaaaggtagtccagctatacatcttgccttatttacctgtgtatgatcgttttttcctgtgaggctgactctttttctttggtttctggggagcaatttcagtgaagttgggaatcttgagaacaaaaaggtaaatgccagtagtagccctagaaacctttcaaaacaaaccaaacctcatgagaactttgcagaaggtttcatttaggaagttacagcaaggatccatgaggctgtttgggtgttgatactttcatggcataagagggctttttcttttttctttttttttttgagacagggtctcactctgttacccagactggagtgcagccataccatctcagctcaccagaacctctgcctcccaggcttaagcgattcttctgctttagcctcctgagtagctgggattataggaatgcaccactactgcccggctaatttttgtattttcagtagagacaggttttatcatgttggccaggctggtcttgaacgcctgacctcaaatgatccacccgcctcggccttccaaagtattgggattacaggcgtgggccaccacgcccggccaagggggctttttataagtttactgaagcctcatgctgcctttgttggtattgggacagacgctagagaactgttggtctgggccaggtgcagtggctcgcgcctgtaatcccaggactttgggaggctgaggcggatggatcatctgaggtcaggagtttgagaccagcctgtccaacatggtgaaaccccgtctctactaaaaatacaaaaattagccaagcatggtggcacgcacctgtagtcccagctacttgggaggctgaggcaggagaattgcttgaacctgggaggtggaggttgcaagtgagccaagatcacgccattgcactccagcctgggcaatagagcgagactccatctttttttttaaaaaaaaaaaaaaagagaactgttgatctgggccttattttacactagggctctttggccatataccataatattccagaatcttggtttgagggctgtgtctgatggtctgacttttctcacagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcaggtgggtctggagtgcacttagaggaggaaggtgggatggaaaatgtttcttgagaatatatgcctccaaatcttactaaaactcagaaagcagtggaaagtttttgatattttagtgcattgtcctttgccagaaactggctaactttgtccttttcctcattcatcagccactgatggacaatctggaatctcagacatatgaagtgtttgaaaaggaccccatcaaatactctcagtaccagcaggtactgtgtggtgcccagggtgaggaaagcacagggccagcatgacctggggaggatgggattacaaccatgggatattctctcctccctccaggccatctataaatgtctgctagaccgagtaccagaagaggagaaggataccaatgtccagtgagtgctttcccctcaatctcagggacttgcatacctatatctgtatatgccaagtctgcttgactcttccctttctttcttagggtactgatggtgctgggagcaggacggggacccctggtgaacgcttccctgcgggcagccaagcaggccgaccggcggataaagctgtatgctgtggagaaaaacccaaatgccgtggtgacgtgagtagcaacctgcttgctgggaagttagtcctcattgccaaatttccttaacatctctccttaccttattgtctctgtttcaggctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaaggtgcccccaggttggggtgtaggtggagggtgatgatgggtgagacagcaacctgggaggagggtacagggtttaggggaaagtgggttggacctgggtcacatcatatgagtttgagagccactgcttcactgcctctgtgcccctagcaaatgaagtcatctctccaaaccttagtgttcatatttgtaaaatgaagggagtgggctgggcgcggtggctcatgcctgtaattgcagcactttgggaggccaaggcgggaggtcaggagtttgagaccagcctgggcaacatggcgaaaccccatcactactaaaaatacaaaaattagccaggcgtggcggtgcacgcctgtaatcccagctactcgggaggctgaggcgcgagaatcacttgaacctgggaggagaaggttgcagtgagctgagattgtgccactgcactccagcctgggcaacagagcgagactccatctcaaataaataaataaataaataaataaataaataaatatgacatatgtaccctgagcttagctttcatcaggaacttttgtgggactttgtgaccccacaaaagttaagaaccaccagattagactatcttgggttctttcagttttaatctgtgtgactctgtaaattaacctagtagtggaatcctccatgacagtagttggaagcaggctggcttagtaatgtgacaacatgcatttgtctctttcttccatgcccatgccaacgttggttggttttgacatgggaggtttgatccttctgatccttcagttagtacagacataccatttccctccctctggaactaatttgactctcctgctgtgcagatgatggtgtgagcatccccggggagtacacttcctttctggctcccatctcttcctccaagctgtacaatgaggtccgagcctgtagggagaaggaccgtgaccctgaggtaaagaaccactctctctggaaagaagtggtactctttagtcctcttctttttctgtatttgcatcagctattttcttctgctggggatgaagaggtgaaggagaagttagggattggggaagcactaaagtaaaactttttttaatccttggggaagtagttctctcttgtgtgtcttccccaacactctctctctctttctgtctctgacaggcccagtttgagatgccttatgtggtacggctgcacaacttccaccagctctctgcaccccagccctgtttcaccttcagccatcccaacagaggtaggttcttttatggctgtcctctgactagaggggtacgggcttcttccttcctcctgctttcttcccttactgtccctagtctgccttatctactcttcctttcctgggtcttgctcatgctttatcaagttgtctagagcttctggccccttgtcacccacataattatttcctgacagatcctatgattgacaacaaccgctattgcaccttggaatttcctgtggaggtgaacacagtactacatggctttgccggctactttgagactgtgctttatcaggacatcactctgagtgagtgtctatggcagtagatggcagagtatgagggtgtgcttcctgggcagcttatatgtacatgtgtcatttagatttatggggggcccagtgctcaatgaatggagatctttgtgtgattagagaagagaccctcttcagcataggcaaaagtcacagccatggagacctctgttttttcattattttgtccacacaggtatccgtccagagactcactctcctgggatgttctcatggtttcccatcctcttccctattaaggtaggaactgcttttaagactctctagttaagcagtaacctttgcctttggtgttgtgcttctttccttctcccaggaagatagttgactatgactcatgttctcctgatttcatatgctcttggatcccagtggtaggtgttgggagtatttggagtggccttctgcctggctttcccgcatctactctggctactcttctgtctgttctctactttgagcaagagtcatcttttaaaaactcaaatttgatcttatctctcttgctgtcttttttttttttttttttttaaagagacggagtctcactctgtcgcccaggctggagtgcagtggcacaatttcggctcactgcaagctccgcctcccgggttcatgccattctcctgcctcagcctccctgaggctgagattacaggtgccagccaccacacccggctaattcttgtatttttagtagagacggggttttaccgtgttagccaggatggtctcgatctcctgacctcatgatccgcccacctcagcctcccaaagtgctgggattacaggcgtgagccaccgcgcctggcctgatcttatctctcttttttgcttaaaactcttcaatgccttcccattgtctttaggataaaagtcaaaatctgggacattgcttgtaagacttgatgtgatcgagtgtttgcttgcctttgcagctactgtccccttgcttacactgcttcagccttatggaccttctttttgttctaattgtctatcttctttcctacctcaggctttcatgcctttctcttgcctgtagagttctttgcttgtctcttcacacagttaacctatcttctaggtcttctttaaacatttttattgtgagataaactttctctgatctcctagactaggttagtgttccctttcataggtgtttttctgactctgtacatgttcacagctctcaccacacctttgattatttgtgttctgataggcttcaaataactttcatgagggttgggacagtcttgtcatgtttatcattttatctccacacctaccttaatacattgccatgtataattcatagcttcaccctgaaccttcctgtctttcttcttacagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgc

SEQ ID NO: 38213 - DNA, 50681 bp, Homo sapiens
agggggcgaaggcggcggtggtgaggaaggtacgcggcgagcggcggggatggctaggcgcccgcgtctctgcggaagctgttgcgcgcccaggctcaagcgcgaggggcgtgagcgccgggccgctggagcggggacgctgccggagcaggtgccggggcccggggatctggcccatgggtaggtgtgggcctcggccgagggatggcggctgcatcgggccgcccagggcgcgctgcaagaccgtggcgcgctcccatatgccggtgcgcggccgccccgggatctacggatggctacgggccctgacctccccggcctcccctgggtacaccatgtaaggaactgggccaagtggagacttcaggcatccgcgggccccttctttccaagagtatggagcctgcactggtgggtggcgtgggtggcggtggtggcagcgccgggatgccgcgggttttagctggccgcacgctgactctcaggggcctgggtccctagttccccgcggccctccaggcgttcatcatcccctcctcaaagccagactccctttgcagtatggcattctgtgtatgctggggtcttcctgttacagcaggacgcacccacataccccacctcgtccttcccccatcattatcccctgccctctgaggtggtgaggcccatcggatctttgtatttaagtggtgagccatataccgagcatgtgtttgtgggtgaactgtgctgggactgaggttcacttctctgttcaaatcagttagataagggcattctgtttagtctgtaaagagatattgagaaatgtcttgagtcaaaacgtgaaaactttcttcaactgatgatatggagtctaaacacacacacagagtcgagacacagtcacacaaatctagacacgagtctagatacacacacacacacacacacacacacactctctttgctccttgggatcaactgtgtgcttctcgagggcgtaatacactctgcctggtcagtcagagatggtggtacaggggagaggtcaggaggcttggtttctacgtcagtcttcaatctcttatttcagtgaccgtaggtgttcagagctttcaatgactcttggttaatagagaggtaaacagtcagtcaatatatgtgtgtgattgtatctaatagtgaatattcgttgaattctttgttcccgtgatgggtcttgaaggaaattaaggaaaaaataattgtaaggcatcattagtgcctaaaagacaaaaggaggaaaactgacatttactgaccatttgttgtacccaagcactttccacgcattctctcttttaattctcactataatttcatgaggtccatagtgttagtatccctgatttataagtgaggaaacagaggcttagaaaaattgggtaactcttacatatgtaactaacctgcacattgtgcacatgtaccctaaaacttaaagtataataataataataataataataataaagaaaaattgggtaactctccacaagacacacagcaagtgcagagctcgaacccaaatctgaccaacttcaaaggccttgttcctcatcgtttttgccatattgtcaatggaaagtttgtaatccagatgggaaaagcagtagtcatgagctatttaaaagctaacctatagaattatatccagctgtgaagactagccttgctggggaaggtttcttagggaggtggaactggaatttgattgttttaccctttggctcttctgtagttattttggagaattcacatgtaaataattgtttagcagccattattgaaggaatttatataagcagcaaacttagatcacgtgctaaaatcatacttcagtgttatgaaaaaattgaaataacaaagatcaattaatactttctgttgcctactagatgccatatgttttagaacagctgcatcctgccagtctcttctctgtcccatttcagtgcctttgtgcagtataaattgtaaagcaatgacaccattcctaatttttcttcactatggggctaaatgctagtcttctgaggcacatttaagagggctgggatatatccaccaatccatggaacaaaagttaaaaggaggcccacaaacaaagaaagtgaagtatttttcttaccttgtgaaaatagcagtgtctctgtagcataaaaagagctacaatattgggaggccgaggtgggtggatcacaaggtcaggagatcgagaccatcctggccaacatggtgaaaccccgtctctgctaaaatacaaaaaattagccaggcatggtagcgcgtgcctgtagtcccagctactcgggaggctgaggcaggggaatcacttgaacccgggagacagaggttgcagtgagccgagatcgctccattgtactccagcctggcaacagaacaagactccatcttaaaaaaaaaaaaaaaaagctacaataatgaatggcttgttctccctgtacatataggaaggagttccctacttttttgtgaaataaactattctttgtctaaagtctcaaatttgacccagggtgaggaaatgcccataactgccttatgttctcaaccgagatttgtagccatattctcttcctccacaggattaagatgttagccagttgtaggcattgccactgccttccaggggtacaagagttattttgtaatcctgtgggcatcaggaagaaagacatggcagcagcctctggcctttcctcttgcttttcatggctggctggcaaggatcaagctgacatttcaaataggtgcatttcctggttctgttgggagatgttagcagaaaggtggacatgattgctttaggatgttggatctgttacaggaattatatgaagatttagtattaacacataagcattgcacctgaaagattttttttaaatttggaagataccaaaaagagcaggtgttttttgtgtctcaaaatattcctaactctgcattattatttgcttacataaaaactaagatggttgaggcctagaaaggagccacttactttttctctcttttctataatatagaggaggtgggagtttccctaatacagaggagtttggagcaggagagtcagatttttactccgagggtaaggggaagtagagggaaataaaatgaattgtccagtatttttcattactcactttttaaaaaatgtattctgcagatactttggttagtgaccacatcgcagcatgttgagtcaagtttaccgctgtgggttccagcccttcaaccaacatcttctgccctgggtcaagtgtacaaccgtcttcagatctcgtatgtaccatagaaaacttatgagtatgtgggacgtttgatagtcaaagtatgtttcaacaaggttttcaaagagaaaaaagatgtttgtttgtttgtttggagacagggtctcattttgtcacacaggctggagtgcagtggcacaaacatagctccatgcagtccagacctcttggactcaagcaatcctcctgcctcagcccaccaagtacttgggactacaggcacacaccaccgcgctgactctaacttttttattttttgtcgagatgcgattttgccatgttgcccaggctggtcttgaactcttgagatcaagcaatctgcctgccttggcctcccaaagtgctgggattacaggcgtgagccatcgtgcccagccaagaaaaaaggtttaaaagagagagagagaaaaaaaagatgtaatttggcagaattggacaaaattctgccaaatagcaaggaggcaaagaggtagtctcctggtgaaatgttctcagtgtttgtgtcaataaagttgacccccaaataaatttttacatgctttttttttttcttgagtctcactctgtctcccaggttggagtgcagtggtgtaatctcagctcactgcaacctctgcttcccaggttcaagcgattctcctgcctcagcctcccagttagctgggattacaggtgtgcatcaccatacccagctaattttgtatttttagtagaaatagggtttcgccatgttggccaggctggtctcgaactcctgacctcaggtgatctgcccgcctcggcctccctcccaaagtgttgggattacaggcgttagccactgtgcccggccccatgctatttttgttcattactctttttttgtaattaagttttagattttgagctaattataaattcacttgcaattttaagaaatagtacaaaaaggtcccttataccctttacccaatttcacccagtatctgaaccaaggtattgacgttgatacgatcaagatacagaacatttcaatcaccacaggattttttatttctctttaacagccactgtcctcttccctattactaacccctggccaacattaatctggtctacatttttataattttgtccttataaaaatgttatataaatggaattatccagtatgtaaccttttggaattctgttttcttcagcataattctctggagattcattcaagttgctgtgtgtatcagttagttcctttttattactgagaagtatgtaatgctatgagtgtatcacagttagtgtaaccattcacccattaaaggacatctgggttgttctcattttttggctgttatgaataaggctggtatgaacattgatgtacaggattttgtgtgaacatagttttcatttctgtgggataaatgcctaagagtgtagttgctgggtcagattgtagctacatgtttagttttttacatagtttgaatgtatgtccctaccaaatctcatattgaattgtaatccccagtgttggaggtggggcctgtgggaggtgtttgagtcatgggggtgaatccctcatgccttggtgctgtccttgagatagtgagtgacttctcacaagatctggttaagtgtgtggcaccaccccctcactctctcttcttgttccctctctcgccattggagatgcctgcttcccctttgccttctgccatgattataagcttcctgaggcctcaccagaagctgagcagatgccagcaccatgcttcctgtacagcccacagaactatgagccagttaaacctcttttctttataaattacctagcctcaggtatttctttacagcaatgcaagaatggcctaacacagttttataagaaactgtcaaactgtctttgcagagtgacagtaccattttacattcctactagcactgtatgagtgatgcactttctctgcatctttaccgtcatttgatgtggtcactcttttttattttagccattttgataggtatgtagtgataatcacattgtggctttaatgtgcctttccctaatagctaatgatattgaacatcttttcatgtgtttatatcctcttcagtgaaatgttagttcatgtctttagctcattctttttgtttttttttgttttttgagatggagtcttgccctgtcacccaggctggagtgtagtggcgcaatctcagctcactgcaacctctgcctcccgggttcaagcgattctcctgcctcagttcctgagtagctgggattacaggtgcccaccaccatgcccagccagtttttgtatttttagtagaaacagggttttaccatgttggccaggctggtgtcaaactcctgacctcaagtgatccccccacctcagcctcccaaagtcctgggattataggcatgagcctccacacctggccttcagctcagtttgaattggaaagttgttttttttttaaactattgaattttgagaattctctatatcttcctgtcttagtccatttttattgctataaaggaatatctgaggctgggtaatgtataaagaaaagaggtttatttgtcatggttctgcaggctgcacaaaaagcatggcaccaaaaactgcattgggtgaatgcctcaggctgcttctgctcttggaagaggatgaaggggagctgttgtgtgcaaaatcagatggccagagaggaagcaagagagagaaaagaaagggccaggctctttttaacaaccatgtctcatgggaactaagagtgaggactcatgcattccctctgagactggcaccaggctgttcatcagggatctgcccccgtaattcaaacacttcctaccaggccccacctccaacactggggatcagatttcaacctgagacttggaagggccaaaccatatccaaaccatagcacttccaggtattagtcctttgttggataggtggtttgcaaatgttttctcccagtctcatagcttgtcattttattctcttaagagggtctttcatataggaaaagtttttcttttgatgacgtcaaatttatcagcttttgtttttatggattgtacttttggggtcaagtctaagaactctttgtataaccccgtattctgaagattttctcgtatgtttttttcccgaaagttcgatagttttatattttatacttaaatccatgatccattttttttttgttttcttgagacaagatcttgctctgttgttacccagggctagagcatagtggcacgatcaaggctcactgcagcctcaacctccagggctcaagtgatcctcctatgtcagcctcccaggtagctaggactatgggttgcaccaccacagctggctaatttttttctttgttttttttttttattttttgagacagggtgtcactctgtcacccaggctagagagcagtggtgcaatcattactcactgcagcctcaacgtcccaggctcaagcgattctcctgcctcagcctcccaagtagctgggactataggcgtgcaccaccatatccagctaatttttatattttttgttgagacagggttttgccatgttgcccagtcttggcacatttaattttttaaaaagttttttggttgggcctgatggctcacgcctgtaatcccagcactttgggaggccgaggtgggcagatcacgaggtcaggatatcgagaccatcctgactaacacagtgaaaccccgtctgtactaaaaaacacaaaaaattagccgggtgtggtggcaggtgcctgtagtcccagctgcttgggaggctgaggcaggagaatggcattaacccgggaggaggagcttgcagtgagccaagatagcgccactgcactctagcctgggtgacagagtgagactccgtttcaaaaaaaaaaaaaaaaaaaaatctgtaaaaatggagtctatgttgctctggctggtctcgaacttctgggctcaaaagatcctcccaccttgacctcccaacctgcaggaattacaggtgtgagccactgcacccaacttcgtgatctattttgagttaatttttgtataaggtgtgaggtttaggtcaatgttcatctttcaacttttaatactagttgttccagcatcatttgttgaaaggctgtttgtgatgttttgagttggctagctccttgatatcacctaaatcttatcagtagtccatttccaagcttcattgcaagatgacttgccaatcaactaatcaagcttgtcattagacagaaaaatctctttcctattaatgtagagtataagggctgaaagttcaggttttggaaccagttcctgggtttttaaaactagcccttctgcttatgaagtaacttcgtagcttaaaacaactgtctgtttaggtcacaattctgtgggatggtattttggactgggctcagctgcacagtggttctgtgtctgtgtcaggtctcagattgacttagggctgattgttggggatgaaggggcctctgctgggatgatacatcatgtacattccctgtggcttctcattctccagcaggctgttcattgctgctttgcatgatgcttgcagggtccccagaacaggaagcatggtagctacaagtcctcttgagatgtaaactcagaatttatgcactgttccttctgccacatttgtcaaagcaagttacggggccagctcaaatttaagaagtttggaagattgactcacctgttaatggagaagctgcaaaaggattgtggccatttttgtaatctggcaatgctggtaaattactcagttactctgagcatcagtttccttatttataaaatggggataataataataatgaactcataataatacctaacttatgaggcttaattcatgagaattcagtaagatgatgatgatgatgatgatgatgatgatgatgatgatgatgaaggtagaatatggaaaagctcaaactatttttcctctgctctcactccataacaacaatcaacacagaagacttctgtgaccaaatgtacggggttgcagtggacatcagttgggtatcctccaattcaattctgacactgtctccctgaggacagcccacaggttgagggctcagtccctcaagatcatccccatcttcctagtagtcctgagtccaggcttctggaacttctgactgactggcttcaagttggggttcccacagtaccctctttgggcttgattgatttgctagagtgatgcagagaactcagggaaacacttagatttaccaatttattacaaaggaaacagatgaagagatatgtagggtgaggtgtgtggtaagaggcacagatcttccatgcccttccggggcacgccaccctccaggaacctccacatgttcagccatctggaagctctccgaaccttgtccccttggacctcttatggagacttattggataggcatgattgaagcatgggcaactgtgtcgaaatgtgattgaacaaaaagaatgtgacctgatactaatagactgagtggggtaacccagcaaggcctgtctgttcagattttgtcttggtcttcctgtgcaatatttcttcctccaaggtatggggcaggaccctctctggactgagggtcttacaacccacaatcaaattagagtcctgccttgagtaggtgaaaggagttcaggagaataccagagagattctgtttccttacaccaacattataacaaaagactgtaaaaaggattattagagttataagccagggaccatggatatatatgtcatgtcacagtaagtaacactttttttacagtaccagttaatattcattgagtattttgtgccaatctctgttcatgcatgaacttgttttatccaccctaccaaccttatgagatagttaaggagacagcaagtaagtgaaggggttgaaatttcactcaggcagtctggctccagagccaacacttgtcctttttactcctgtagaaggtgtatgaatacttagcacaactcctggtatatagtaagtgttcacttcagtatttttattgatacttatcctcattagactcattcacagaaggaggcactttctaattgtttccctaggtttttgaatttggggatttggatttttctggaacgtggagctctttcactgaccatgataagcagaatagcagagggaaaaaaaaagaaaagaaaggcaaaatgagaacgcttgtggagataaacagagaaggcaatggaaggccagagagaaaaagagtagtcatgtctgggtcccttcttgttgaggcctggaacacagcctcattggttactgggcataaggattctgatgctgaagaagtaaagggttctcctctgtcagagtggtaagagtataatccgtggcccttaagaagaacatggacaacccctcccatcccccaccatgccacatctgtacacacatacacttcagtatgccctcatacctactaagaggggacagattttctttggaacttagagcctaaaagttccttagaagatgggaaacaattatttctctagaagccttgaattttcctaactaatcaaggccttctcagttttcaatatggaccctaacaagtataatacattgtagaacattaaaaaaatacccccaagaaaggtagggtcagccttggaaggtaaaaggcgttgttcaataggaaacccaacaagccctgagtcccctgaagctctcctttgtgctagaacctactggatttgactgagtcaactgcatgaaaccttgttgttagtggtgacctcctcttgaaccctaacaggccttatctactgctgttaccctattgtctccagccagaatgacccttgactacctggcactgaaccatgcgacccaccctcttctcctgatacagactgtgggttagcctccttcatgctagcctggctgctggattctgattggcttctaccatttgatcacctggacagacatgcatgccactgcctgtgttcctgaggtaccctctcaggctgctccacccatgctcaccacccttccaggtcaggataggccctccagcagacaggagagaaagccagaaagcctagatctgacagctaccaaaaggataatacatgatacttggcatagctctaagctctgcaaacagccactgatgatccctggtccaaaccctaggggagtaagcctgtccctccaccacccttctctctggcagatcagtaagaccaaaccattaggcatacaacttttaaacttaagacttagttgtacatattgcttaggataatattcctgaaagcagagtagggtacctatattattaataattaacccaatgaaggaaagtagcactccataaaacttagcctcaacaacaaaccagtcttttagtcccagggactcccacagcaggaagagaccgtgcacctgtggatccagcaatgccatcggaatcccagttccatcccagatgatggcttaccaagcagctctgtgccaggatctagatgccaagcctgttgtgaaaaaaaatcatattatctttcttatatctccacaaacctgaaacatagtcacttgaaaaacggttatttaaggaaaggcagaaatgactattacttcattagaaatgttctttctaagatatgtgtgtgaaggaggcaggaagggaggagaacccatagtcgccttcccattcatgagaataaggtcctgcctgctttacccaccatcagtagattgtggttagggagtgagttagcggccaggagatagtcagaaggtctaaagaaattttgagaaaattgtctgtaatttatagacagacaatataaagggaagtgatagtggttcaagtgaaggtagttaactctctaataaagttatagaacagtggttcaaaaggtggcttggaatgataattttagtaattcattcaaatatttatgagttgcttgtaatgagatatagaaaagtctttccagggaattgcttaaagcttagtcctgctgagaacctatgttacccaccttgtcttgcttcttgctatcagggaggaacgtctatttgcttaagtgctcctctaccccccactgattgacagcatcttatctcccatgtaggcctcacacagtccatctgcctatgcactcattgtccttctgtgtcagttacaattatgtgcatgtagcaggaaactcagaatattcatggctcaaacaggatagaaatgtttttctctctttctcctgaaggaagcctagcagccctgcaagaaggtaggcagtccagggcttccagaatagcactgtgaaatccatcagggatccctgctcgttctttcttgttgcttcacagttccttctagtccaaaatgaatgaatgagctccagccttcatacccatgttccaagaagcagtggggatgaagggaagaaagcatgtctcttttaagttcctagaaatcccacataacattttcacatgtatcttgttagccagacttggtcacattgtcctgtctacctgagcaagaaaggctgggaaatgtagtctttcgactggtggcagtgtgcctggctaatacttggggatctggtaattgtgtgagaaagggcgaatgggtaagtagtaagcagctaagcaggaggtgttgggcccataagaagtattgaaggggttctgtgcctgacattcagcttttactcttttacttttggctttatgcaggtatctatttggcttttaatgaagatttttttcctccttagaaatcttgtagaatttttgtttgtttgttcatctgtacaaattatctgtaatcttgtacagtgttacaagaaaaagaatcaggaaagaattggttagaggcagatgtccaaggggatagaaagtatctgactctaacattgcttttccttcagaaagctgtctggtttctttgatcattgttacaggcatctggattcatcaaagagagaaattgtaggtagaatagttgagattttgtattattcatacacttactttgttctttactgtctttgctaatcaggctcttccctctttttttgtttttttgagaaggagtcttgctctgttgcctgggctggagtgcagtggcacgatcttggctcactgcaacctctgcctcccgggttcaagcgattctcctgcctcagccacctgagtagctgggattataggtgcccaccaccatgctcggctaagttttgcattttagtagagacggggtttcaccatgttgtccaggctggtctcgaactcctgacctcaggtgatccttctgcctcggcctcccagagtgctgggattataggcatgagctgccatgcctggccggctttttcctctttttatagtaatatggtttctttagaaacacccatatttttctgattatgaaaaaaaaatgcatctttactgcataaacttggaaaatctaagaaagaacaaagaagaaaatttaaaattgcttataatcctatcaagagataaaatattaatttttcattaattttatccatctatgtgtttatacatgtatatgaaattaacatgtatttttctacattattaaaaattctaaaaatgttaatctttttccctttatccaacatttactctgcttctgatttttctgataataaataacagtgatgaatagctttctgataaatctcttttttagagaacttttttaaggctttcgataaatttgccaacctgtcttcaagagagattaatttgtttgtactcttcaccaacagcatttgagtgtgcctatgacctgcatactgggtgtaaactccatacaatactaaaataagaatacgctagatagagcttttgatacactgtgctagttttacacagttaataatgataatgctattttttggtatctaaactggttaatactgagcatgtatatttttattgaaaaactatattgagtatttctttttttcttgcatttgactttgatggctacagattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtgattgccaagatagaaattatgctgtactaaaattgggtttttaagtcgctagttcagattaggtttaagttgctcatcaacttaaaaaaataattgtgatttcagtgcagtagatttaacccaatgtgaaaactgtttcccactgtagacgccagtgagagacgacatcttagggcaagaaaatgggatgttaaggagtaggggtgatttcatgcagttcatgtctcagacttcttagtgataaagagctgtttctgtcagagattcttagttctgactacgcagtagaatcatcttgggcctggagatgcttgggcttcacacctagccatttaagaagtatctctgggatgaagcagctgtgtttgtttgttttgagaggatctcactctgtcacccaggctggactgttgtggcatgatcatggctcactgcagcctggacctatcgagctcaagtgatactcccacctcagcctcccgagtagctgcagctacaggcacaaaccattatgcccagcaaatttttgtatttttcgtagagacaggggtcttgctatgttgctcaggctggtttccaactgctgggctcaagtgatcctcccaccttggcctcccaaagtgctgggcctgcaaactttttctgcaagaggccagatagtaaatattttagtttcgtaggttatatggtctttgtctcaactacacagctctgcagaagcaaccatagataatatataaatgaatgagcgtggccgtgagctgataaaatttcatttacaaaaaccagcagcatgccagatttggccaaaagtaaaaatccagacatccaggcatcccacagataaagcaagagctattccatggcagctgaaatcttacactaccttgtaattaaattttcagtttttaaaaaacaagttcctgaggtgttaatattgggaaattgctaacctgaaacttgatacaatttttttcttatattttctattctaaattatcaagcctgagcaacaaagtgagaccctgtctctacaaaaataaaatcggttgggtgtggtgacttgcgcctgtaatcccagcgctttggaaggctgaggcagaaggattgcttgagcccaggagttcgagaccagcctaagccacatagtgagacccccatctctacaaaaatttttttaaaaattagccaggcatgtggcacgttcctgtggccccggctactcgggaggctgaggtaggaggattgcttgagcctgggagattgaggctgcaatgagctatgatcatgcgactgcactccagccttggtgacagagcaagaccctgtctcaaaaagttctaacttcttggtaggctgagacaaggggattgctggagcccaggagctcaaggttgcagtgaactgtgataaagtcgctgcactacaacctgggcaacagagcaaaaccctgaccacccccccacccgcccctgcagaaaaaaaaaaacaaaaaacacccagaacaacagcaatgatcaaacccacctcccagattgagtccatcagataaattttaaaaatatttatcaagagactacactgtgaggggcactagcctctctaccctctctaccttagaaacataacagtctttaccctttgcgagccagaactgggactccccacacattaaggtgactgttcagggcagtaaatatccaaataagtgggcccaaatgacagtgagcgatgggtccagaggtgggaaactcagatgagagtatggttgttcctggggcttcctaggagagctggaactcagcctgggccttgacaactgatgggatttgcacaaacagaggggaaaagttccatgctactaagtacacagtgtgaggtgcccctgcagttgtgcaatccagtggttctggggaagggacaggctctaggagtgtattccaggtagaggacaggcaggaatgagtatggcatgctgtgggccagggaggagacaagctggaaagcagaggtggtggtctcattaggaagaatgaaaaataaagtggatcattccattaggcagagctctgaagccaactaggtgagttggagttcagtctcaaaagcaggctgaagattttgaacggaggagaaacttgatgaaaacggtaggaaaaacctggtaaaggtttgcgtaggttaccagctttctttctagggctgcgtgtggacctaatggaagagctgtctccatcagggcctgactaatagacatcttatcatgtcagatggactcaggagccaacttaaactggcttccactggccataaatgggatgatgtaaacatcaagaaagggaatcacagctgggcacagtggcttacacctgtaatcccaacaccttgggaggccaaggtgggcagatcacctgaggtcaggagttcaagactagcctggccaacatggtgaaacctcatctctactaaagatacaaaaattagccaggaatggtggcacctgcctgtaatcctagctacttggtaggctgaagcagtagaattgcttgaacctgggaggtggaggttgcagtgagacaagatcgcaccactgcacttcagcctgggcgagagtgagactcagtctcaaaaaaaaaaagaaaaaagggaatcactgcacaatacaacaaaatatgtttaaatccatgagttcataattatacttaaaaaaaaaacttcattggccatttttggaggccactagagaagctactcatattgaaaatggatgagtaaaggggaagagacacacatttgtcctgcttttcatagacaaactgtacctcagggtaaccaaatagttggtaaaggagagtttcccttttggaattattccagattataaatgacgaaggaatcattgagttagagtgtcagcattttgcatctcctaatggaataatggatcttggcaatgatcatcaacagatgctaacatcacaaaaagaaagataaccaggcattatgtatccccttgatgaacatgtacaccacaacttataaagacttgttggggaaaaaaaaaaaagccttcataccaaacagcagtttatagggtatacaaagagcagtattaataccataaggacacaattgggaaaatgtaggctgggaaatcctaaagaataaacaactcagtttaacaaaaaattacaagggggaaaactgatggagaagggaacccatgaatgaaagagacttgagagacacttcaattaatttgtaatgcagggtttaatttgcatctcaatttgagcaaggtaaaaaaaaattggaaaaatatgaacactggctatttgatatgaaggaaatcattgaaatattccagataatggatttgtggagagagaaagacatataattatatattatatataatatatatgattatcttttagcagttattactgagctatttacagatgaaataacatgtctgttgcctggaatttgtattaaaacaatggtgagggtatagaggggttattggagagtgggaagttggccatgagagatagttggtgaaactgggtggtatgtacatggggatttataatactattctcagcactttggttaagtattaaattttctttttctttttctttttatttattttagagagagggtcttgctctgtcacctagactggaatgcagtggtgtaatcatagttcactgcagccctgaactccagggctcagttgggatccttcttcagcctcctgagtagctgggactacaggcacatgctacttggctattattttttttaatttttcatagatatggggtcttactattttgctcaggctggtttcgaattcctggcctcaagcagtcgtcccacctcagccagctgaaactttctgtgataaaatattattgtcggggccaggcacagtggctcacacctgtaatcccagcactttgggaagccaaggtggctactcaaggggctgaggtcagggggttgcttgagtcctggaggtcagggctacagtgagccatgattgtgccactgtcctccagcatgggtgacaaagcaagactgtgtttcaaaaaaaaaaaagttattattgttttaaatcatggtttatcatagctgtttgttaaacagctggaccagttaaaaggtttcagacatcagaaggaaaggacagtttaggaatattgactttattacatcttgagtctttaattttttcatgtaggtctgcttaaggtaggaaacaaagtgaccgcatttggtcttgggcagacagagcagaacaaggtcagcatgtgcccctggtgtaggcagaggcaacccataggattagacatgccaccagaacagcctcctttacccgggttaagccttagaacctgagaagccatctactgagtctgcgttgcatttcctacctgcggacttttattctgggcttcatttcttggaggaactaggccttctgcattacacactccctgcaaatattaggttggcacaaaagtaattgtggtttttgccattactgtcaatggtaaaactgcaattacttttgcaccaacctaatacagtcaagtcctatagatgtcaaacttggctacacaccagaatttcctcattaaaaatgtcttacttaggccaggcatggtggctcatgtctgtaatcccaatgctttgggaggccgtggcaggaggatggattaagaccagaagtttgaggccagcctgggcaacatagtgagactctgtttctacaaaaatgtgttaaaaaagaaaaattagctgggcatggtggcatgagcctgtagttccagctacttgtgaggctgaggcaggaggatcacttgagcctaggcagccaaggctgcagtgagccacattcatgccacggcactccagcctgggcgacagagcaagactctgccttaaaaaaatttttttcttagggtgttgttgttgttgttgttgttgttgttgttgttgttgttgtttttgagacagcatctctctcattctattgcccaggttggagtgtggtggtgcgatcatgggttactgcagtcttaacctccctgagctcaggtgatcctcctacctcagcctcccaagtagctggcatgcactaccatgcctggctaaattttgtactttttgtagagattgggtcttgccatgttgcctgggtggtcttgaacctcctgggctcaggcattgtgcctgccttggcctcccaaagtgctgggattacaggcatgagccaccatgcccagccaattgttttaattaaaaaataaattaaaatgtctgatttttgtctgccacctgctaaatagaaatttgagacaggatgtaggaatctgtgtttttaccaatctggctgattcttccagagccagccacatgctggttcataaaccagcatttgggatctactcgatagcccaccctacctccatcccttgtgaagagatgaaagagacagtacggtaacttacagtcccctttcctttctcaatgcccaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggtgagtgctgcttccccacacattgaaatggatcttcaggtcttcttccctcattccctaccacaccttgtctcattggtatattacaggcaattccagtcttagaggcacgagcctgtgcagctgccggacagagtgggctgatggccttgtatgaggctatgtttacccagtacagcatctgtgctgcccaggtgagaggctgggctttgaaatgggtgtgggacctgtgagggtggttgttgtggaacaaaggggtctggagccagactattggaatatggtgtcagcttcatcacttgctacttgagatctgaagaaagtttcttttcctttttgtgcctcagtttcctcatctgaaaatggggataatatcagtgcctatttcagataatttttggaagggctcagtgagaaaatatatgaaaagcatttagtatagtgtttggtacataatacattgtcagtaaatatcagttcttgttacactaataacttaggattccaagtgctaacacttctgaagacagagaagttaaatgtctttatttcactggcttctttgatttcaggtggcttgcttctctttgcacctggttggttgccttttatagcagatatttattaagctttgaagggaaagaggaatgctggtgattggttggtttttcactcattcagcaaatatttattgagcacctatggtgtacctagcagtcttgggcattggggatactgtggtgaacaaatcagacatgattccagtcctcatgggacttacgaatttttggtggctacccctaaatgttctagaaccttctttctacattgtttcatttttacctaaatctcctgaatttttttgaattatattcttaatcaactgtacaactacacactagagacatctcaataacagtcacttcaggaaacaactgaaaaaaaaatctaactcccaaattattttattttgaaattcctttacctgtaaagatgtaaaatagctgttattttatattatggatattattttacatgtacactacatgcacagatgttattttacacaggtgatattgttatatatacatatattgtttcaggttttgcttcttcatttcctgttacttttttttgtttctccatcatttgcctgtttgtacccacagtgatgttctggtattacaccagagtgtcctcaagtcagtgaggtaaaacagaaaggcacggacttgtcccattgcctatggctggggaccccactttctgtagtcttagctttttttctgttagtataaatacagtataaatctctatttatatcactcttctttattatttggtttctcttcacagtccaatgacaactttggtctttaatttttttaaagtgcctggagccaggtgaggaagctcaagtcagggagctatggttttgctttggtttggtttttcccagggatgaaaccttttgagagtttgtttttgttttattttgttttgaatgatggtagcattaagagtccatgcagcatcagccattgtttccatttacattgagtgaaagaagagccctgccccctccagttcccaacaagcttcaacccctgggctctttcctctcacacctgtgtcttcccccaaggccatcatatctacagaaaatatttgccctttgtaccttttcctgtggttccttattttcttcagtaatcctatatagaagaccattgtcagtggcttttgaaaatttccagtaggtggtttgccaggttaaagacttaaacacttaaaacagcttgttttttcttcatagaagggaaactgattttccctcaacagattgcgcttgtctaaacacgtacttttccctcttgggactctttatctcctaccttcatgctgagatccccaggccatgtttgtgaagctattttggtgacaggtatttttcctggacctttagatctcctgcttgtctctcctacacacgggtttatattaattgtttgatctttcaccatcgtgactagaatctatatgttcagtttggacctagtcctgtgtccaacagcactaagcttttctgaaaaggagttcatgatcttccctttcaaaaatatgctccattttatttttccccaagacatcaacattcttattctccattccagcagctagactctggcatttcagaggtactcaacaaattttttatcgagtgagtgaattatttttctatatgtatgtttcctgtgttttatataccattaaggctactgttttattgctatattcttctcagttaccatagccagacccttaaccatcctcactttgactgtttcagtgcctgctttctttactatttgcttccagctttccctacctcatcctgccctacacagcaagaacgctcttccgtaaacattagagagattgcattatttattgttgagcctcaaggtttgttgccatttagtttcttgctatctccattcacccatttatctttttctcctaaacattgcataaaattctgatttaagctagaaagcagagctgtttaccagcccacacaccagctctccattctacctttgagcaccttatgctcatctcctcccttgaaccaagttgtgttctgcccccctttcagcttgtgaccaaagactaacttccataaatttctcagactaaccccacatgctcacacacaatcttagttaactccagtaatagtctgctttagagcaagagcagtgacaacacagccctattccattttgtctaatacactttcactcactcaccaaatatttaagggcctactatggccaggccctgaatcagatcctagaatacagagatattttagaaattgctggggcacagcggtgtgcatctttagtcccagttactcaggaggctgaggtgggaggatcacttgagagtaggagttcaagtccagcgtggacaacagagtaagaccctctctataaaaaaagaaaagaaattaatggataatcactgattcccccagtatccctctaaaatagatacattaattttcttaattttgtaaatggatgagattttggaatttggtagctctttgaggattaaagtacttttgcaagaagtcttgaacattcttaaataaatctttcagattattgtaattttttttatctctacaaaaattggggccaggtgcagtggatcacacctgtaatcccatcacttgaggccaggagtttgagaccagcctggccaacatggcgaaaccctgtctctactaaaaatacaaaaattagctgcgtgtgcctgtaatcctagctacttggaaagctgaggcatgagaactgcttgaacccaggaggtggaggttgcagtgagcagacattatgccactgcattacggcctgagcgacagaatgagaccctgtctcaaaaaaaaaaaaaaaaaaaaaagaattggatagcacccagatatgtgtatttcattctaatcttctaatctgtgtggggccccagaaacctaaagtttaactcccctgctcttagcgtcttttgtatactgggaagtttagcgtttttctccctcatgcattttccatctatttaatccttttagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgtgggtaaagtatttctaagggtttagcatgctggagacactaacaccatgctatgctgcatgcactaacaccagaagtttggcataaacaagatggaaaagttgtgagagaaacttgtcatggagcagtgactgcataagctcttctgaactcgtggttgcattcaacagggtgaggtgctatagtcactgaagatggtgcgatgagcatggcttgtatatttcagtggctagaagactgcatgtttggaaaaaggattgccagtagacagtgtgttctgcagacagaaggggcctgcaagagccgtcatctacatatttgggttcattggttttgcctgatcctagcttggttttgcctgagcttggctgtgttcttccatgaatttctttttggactgcttagctcactcacttatgactttttaatctgcattctaggttattagtgttaaagataatgatagcctggctgcccgactggctgtggaaatgaaaactgatctcttgattgttctttcagatgtagaaggtacaaagtaatgcttttttcctttatctgccctttgttttaaatgctacatatgtgagcacatgagtttccctctttctttgagtccctctgatgtttttttgctatagatcattagccatatgttctgacaaagggcttttatgactcaaaacagggtgggtgagtctaagagatgtcatttgaatcctgaaatgttacttccaggtgctttcagttgttttccttaaataacagctttatggagatgtaattcacataccatacaattcacttatttgaagtttacaattctgtcctggcgtggtggctcacacctataatcccaacactttgggaggccaaagcgggaggatcacttgagcccaggaattcaagatcaacctgggtaatatagtgagtccctgtttctacaaaaaatagaaaagtcagctggacatggtggtatgcgcctgcggttccagctactcggggctgaagcagaaggttcacttggagctgggagttccaggctgcagtgagctgttatcgtgccactgcactccagcctgggtgacagagcgagaccctatctcaaaaataaataaataaataaaagtttacaattcagtgatttttagtatattcacataattgtgcaaccaaaaccacagtcatttgtagaacactttccctttcatcacccaaataagaaattccataaccattagcagtcactccccacttctacccaaactccccatccctaggcagtctccagtatattttctgtttctatggattaacctgttctggaaattttatttaaatggcatcatatactatggtggccctttgtgaccggcttttttcacttagcatgttttcaaggttcatccattttacagcatgtatcaatacttcatttgtttttattgctgaataatattccactctgtggatgtaccatgttttatttatcagttcatctattgatggacattagctgtgaacattcatgacacgtttttgtgtgaacatgtttttatttcatctaagagtggaattgcagggtcatatggtaactctgtttaaaagacttttgaggagctactagactgttttccaaagtaaggccccttgtaccatttcacattctcaccagcattgtatgaaggttctaatgtgtttacatcattgctgttattcagttgtttttttttttttttttttttttgaggcagagccttatcctgtcacccaggcaggagtgtagtggcacaatatcggctcaccgcaacctccacttcccaggttcaagcgattctcctgcctcagcctcccgagtaactgggattataggcacctgccaccacacctggctaatttttgtatatttagtagagatggggtttcaccatttgggccaggctggttttgaactcctgaccttgtgatccacctgcctcagcctcccaaagtgctgggattacaggtgtgagccaccgcgcccggcctattcagttgtttttatctgccttttttattatagccatcctaatgggtgtgaagtaatatcttactgtggttttgattactttcagtttttaatgtaaaccatgggacagattgtggattttttttgtttttgtttttcctttgttgggacagattgttttaagttggagccactgtagaagtctaggctatctgggtaccatattcttatatgttactctgttcttctctgctgttcccttcttcctggaggggccactcttggctctaatatgtctttccattcactcctctcaagctttcttaagctatttccatttcacagtctgacccataagaaatatagtagctgtgtccaaaatctaggattccaaaagtcccctgttaacactcccagaaggttagaaaacctctacttaattcccagcccacatcaaggcaggttaacatggcaggacctgttctctgttttacgctcaagcagttgtgaggtaagggcagggactacctagtggaggcaggggcagacatagatgaattgatctgtctctgcccatgtggaaagtcagagatacgacacctacatgtcaatatctttacctgtaagaagtcttagtcctgtgttatccactgtaatttgaagtcccaggataggaacaggtaagttggggtaagtgtgagccaccctggagaaaaaaggcattttggttcatcaacaggttttctatttattcattctccccacccccctgagatggagtcttgctctgtcacccaggctggagtgcagtggcatgatctcagctcactgcaacctccgcctcctgggttcaagcgattctcctgtctcaccctccctagtagctgggattacaggtgtgcgctatcacgcctggctaatttttgtatttttagtagagaaggggtttcaccatgttggccaggctggtcttgaactcctcacctcgtgatcctcctgccttggcctcccaaagcactgggattacaggcatgagccacggcgcctggccaatcagcaggtttttattgaatttctagcatgagcacatagtgtgctaggtgcttgataaatgtaatttattcaatctttatagcaaccctacaaagtaggtagtgggtaggctaacccagttttacagatgaagaaattaaaaattaggttcaagctgggcacggtggcacatgcctgtaatcccagctacttgggagggctgaggcagtaagatcacttgagcccaggaagttgacgctgcagtcaactgtgatcatgccaccgcactgcagcctgagtgacagaaacagagaccctgttgggagaggggggggaaagaagaagaaatattttttttagtttaatttaaaattaaattcagatctattaaatggtgtatctgaagtcacatagcaagtgcttgacagaggccagtttcaaatctgagtctgttcaattaaaaaagctacactcttccttctctcttatactgcttgacaaggtaaaaaaaaaaatgtaaggttttgagattaatttataaaacccagtttgaacaagactctagcaaatcgttttgatgcagcttcaagcaccaaaatcgggtcattggtagactggcattcttattgtgattatcctaattcattttctactgagtgttgattttttagaacagtatctgaattttaactatgctcttggtggggtaaggggaaaagaggagtaggcacattatcagaatgctaggaacccctcactgtctttggagaaggtttggctagaattgtccaatctttcctgtactaatatatgaaactgaaacagcttccaaatctaaatctgtgatctcatagcactgtatcttctgggaagatcctaaccctaaatcctggagagttgtggagtagtaggttgagactgacagattgtgaaaggttattttttcttttcctgtaataatttgcactgcttatagttgccactgctttgctctacaatgggcattgatttcctcacttccctgattcacttactcctgcagagaggtagtatgtagcaagattgtcttaaagatttggaataatagaggggagaggtatattatagcacaggaaaagcagtaacttgagaccagaaaaatcactgcccaaaatgtccttcagccagtccccagcctccccatctgtgtccactttaggtcttgatttaactctagtttctcagccctttcttacccccactttttcttgtccaagctcctacttactctttttcaaagtgaaattgtgagggtttttcatcttggattgtatgcatgtaacatttcaggtaactattttatgtcactccacttagttataaaagggacatacactttatggtaataaatccagactgaatgccaagagtcacgcactctcctgctgactgagcctaacctctacagtgactcactcataaaactgggagtgtaaattagtgactgtttcaaagggtactgtgagagttaatgagtacctctgttgcatttcatcctgcttggaaacagtcacattaaacagtatatggctgctatgctgtttctgcaatagccacccttctttttcagttctgtccttaaagcacagcatcataagtagcaatggcagaattaaggacaccttgccaggaatatgggcagggctaataaatgttgtgctgaggatatggccatgatctgatgttgggaaacatttatttattaagccaggttatagaaataatgtaaggtgagtcttcctggagatgtttgtcagtgtcgaatcccttgttctctttttctggttaaagcaggtggtagtgcagtggaattcatttggatgagtaaagtacagagtgattggcaggtgccctggggaggcctgtcttggagacacttccatcaaagcagtattactgactcttgtctattttttaggcctttttgacagccccccaggttcagatgatgcaaagcttattgatatattttatcccggagatcagcagtctgtgacatttggaaccaagtctagagtgggaatgggtggcatggaagccaaggtaagaatctggtgccttaactgcctataacaattttaaagcccaaactatattgtatcctttttacttttgtaattatttgggggttaatggttcagatagtaggcacatacacacttaaatatgtacatacctaaatacagatttaatgagtgttgcattccaacatttggttatgtctgtgtatgtgggttttctcattaatattgtatgaacagtgtgttcatgttgtaaactctgcaagggcagggcctatatatttttcataattcataaatctctcatttatcagttcaaatatttcttgatgaaatctttcaaaaattgtgtcccattaattgttcttagaagttatacccgtaaggtacagcatcacatgtatcaacagcacagatgaggacaagacccccacttagaaaagccagaagtactcaagatcagactctggtcaaactccagcctgttggtctacttaattgtttctaagttgaggcacagtaaatcaaatgtagaagttatgagtcccatactagagagactgaagagagaacagactggaaacaaaggataggttggtttacctttaagtaacacaggccaaggttgagctggaaagtgtgtgaactgttatgtgttttcagagcttctaagcttttaaaaacattctctcatatacttaagttgttcaatatcaacttgtattttatatctttttgcaagtttaaaatgtgggtgaataggtctgaatctcatctttactggatctaacctgtctcattaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggtaaatagttcttcataaggtcccaaggcctgtgatgggaactagtgacacctggcttagttagagatcacaaaattgatatgctaatattatgaaatatggcattgttttgaacgctatttgcaaaatcggattttgctttgcttttgtgaaattctatctaacctgcctatctagacctattctctgcaaaatcactcggttaaaatatataagcattgattttctcaagaaacatttgctaggcctatgttagatgccaagtgctaaataagcactagagatgcaaagatgcatatgatacagtatgtgctctcgagtgttcacaaaggacagaattgcctcataatctgcattcagaagtgtaaacacattaaaaaatatcgccaaagtggaattcagaagaattctagaaaacaaagtatattgtctgccccagaaatacaggcaagttcttatgtttatacctgagtgaatctggcacattcttttgctattttattggtcatggtgatcccctgtgtgaaacaagcataccaagacatcatgtgttccttctgtgggcgtgatgagcttgtgcatgtgctggtagttctctctctagtagtagaactagagagagaactaaggtgaccatgacctgatatttgcacatattcttgcaggccctactgttgagcagcagggagaaatggcgcgatctggaggaaggatgttggccaccttggaacctgagcaggtaataaccttaggtgataatattgttatagttttcagagtgagtcatgctgtgtagttacaggagtcaaacctgctgactccatctttattcctagtgagccacagagttatctgagttacaagtctgattcaaatttgctctgccttttttctttttcttaattttattttccgttttatcttttatagacagaggtccaagataacttttcatcactatgatgttttgatcaagagcatcataaaaatgatgagattagaaaggttacctaattctgccacatactgggcatggaaatgtgggaaaattacttatcccaccccattccaaatcccctgacttgcctagaagatgggaagctcgagagcctgctccatagttggtagccctgacctgtctggcttgaattagtctaagtagcagacatgatgaggctggaagtggtgaggaggtcaagtagaagctgggagctagtcccccaggggttatgttgtcaaggacggatttgagagtgaagatgtgtgtgggtttatactagtgaatcctttggcctgagaaaagaaaaagtaactccaatggcagagaaaggaaagcaaaggaggagcctagcttccctttcaaaccacttccctctgctcctccaataatcagcatactgatttgccacatttcctcatctagcagggtcaggtttggggtgtcttcaagtacctaggactgaattttttcactttgattaaatgcattaaataaataatttacaaggaagaaccagatgtaaaaacttacctggacataaactaactaatgatattaaatatgtaagactctatgtaacatgttaattcaaagtactggcccctgtacagttacataatctcctacagattatacagtctcctacagattgtatccatcatgccccttcccccccttttttttttcttatgactcctgattattactattagccatggtttgctaattataataatcaggagtcataagaaaaaaaaaggaggaaaagtaagaagtgacctagaggttggcagtgagagaggaaggaagaaataaggggagcagtggtgggaataagtgatgggaagtcaggagatttcaactggtgatgaccgtggatgtgggagcaaggcctggcactctcagaagagtaggtttaaaaactgtggtgtgcattcttcttggattaacatctctgtttttttaatggtgtacctttcttctagagagcagaaattatccatcatctggctgatctgttgacggaccagcgtgatgagatcctgttagccaacaaaaaagacttggaggaggcagagggtaaagaccaggcaatttaaagtcaatgttgtggaggggtgtgcattattttggtttttagttttactaataattcttatgtctgcctaaagataaggatttttataaaagaaattgtacattatgtatcatttctattgagggtaggtgggtggctggtattctccttccccaaatactttagtacaacccccagaggagcttttttcattccccacaggtcacaagctgtggctactatggcggtcaggacaaaaaagaacaagattgagaaccccactgcttaagacattcagctaatagctaacatttattgaggcctttctctattgacaggcactgtgctaatggctatgcagtcaggatgtcatttaatcttcataacatagtgcctctgagatagctactacttattatccccatttgacagagaaggaaactgaagctcagagaagttgtcacttgcccaaatccacatggtcagtgatggaccaggatttaaacacagatggactgtacatgtgaaagagttgtagaaatagtttgtgcagcctgtgaagaaagatagcttgtttcttagttaattaaccagtcttttgtcttccctgagttagcaccaggtgccatccagaaataccctagaggtgctaatggtaaagtaagatgttgaattcacattgtgaacacctagacatgtagagagtcagggccctgactctttctcctctttttcttaattctgtcttttcccccttaaaataatagggattgattttatggggttttgaatttcctttgcattatcttgaacatccatattaatggtgtttctttcaaagaaattttgcacggttcaacgttactttcattccttaaaacatttttgaaccattgttttagaacttcctctagaatttacatctcatttttatagtattacaaaacgtaaaatagattttcagaactggaagaaatctttgatactatccactcattaatttaaagtaaaagaattaagacccacagagggtaaacctgttgttgcccaaggttccacagcttgttgttggcagaagactcctgatcccagctatacctctctgaacatgcataaggacacatagtgggttaagaacaaagccgtgggtatacatgagcgtggcttagcaatcccagttcggggaatttatcctcaaaaactatttctaaagaaaataggtctttaggccaggcacagtggctcacgcccgtaatcccagcactttgagaggccaagctgggcagatcacctgaggtctgagttcaagaccagcctgaccaacatggtgaaaccttgtctctaataaaaatacaaaaattactgctgggcgcagtggctcatgcctgtaatcccagcactttgagaggccaaggtgggcggatcagctgaggtcatgagttcgagaccagcctggccaacatggtgaaaccttgtctctataaaaatacaaaaattacagctaggcgcagtggctcacgcctgtaatcccagcactttcggaggcctaggtgggcggatcacctgaggttgggagctcaagaccagcctgaccaacatggagaaacctcatctctactaaaaatacaaaattagccgggcttggtggcgcatgcctgtaatcctagctactcaggaggctgaggcaggagaatcgcttgaactcgggaggcagaggttgccatgagccgaggtggcaccactgcactccagtctggacaacaagagcaaaactccatctcaaaaaaaaaaagccggccgtggtagctcacatttgtaatcccagttactcaggcagctgaggcaggagaatcgcttgaacctaggaggcagaggttgcagtgagccgagattgcgctactgcactccagcctgagcggcagagcaagacttcatctcaaaaaaaaaagaaaaagaaagaaaagaaaatagctctttatctaaggattcttagagcaagatttatcacactgaaaaactggaaacaagctgagcatttaataacataggtgtggttaagtgcgttcagctgtatcaaattaatggaatatttagtagtaattaagataatttttgcaacatggaaaatatactcgcattgtgaggtgaaaagctaggatgtaacatttaacatatactataattaaaactttttttttagcatatggggaaaagtaaagaaaattaattaatttgtataattggttggtagaaagatggtttaatttttttttcttaatataaggtcagttgcttccccccaaggcagaaatctttttattattttatcttggtggctatgactgtaaaaaaaggaaagggaaaatttttgtaatctcaacattgaccacagtaatgatttgtgatatatgatttcaaatggtcttcctgagtatatacatgtatatatatgaagatgtacgtacatgtttgtgtgtggagagagggaatcacatcatgcatactactgttttttaaaaaaattctgggccgggtgcggtgtctcatgcctgtaatcccagcactttgggaggccgaggtgggcagatcacaaggtcaggagatggagaccatcctggctaacacagtgaaaccccgtctctactaaaaatacaaaaaattagccgggtgtggtggcgggcgcctgtagtcccagctactcagaaggctgaggcaggagaatggcttgaaccctggaggtggagcttgcagtgagccgagattgcgccactgcactccagcctgggcgacagagcgagactccgtctcaaaaaaatatagaaaattctgcgtatgagcttgccataatcctatttttttttcagccaagcatggtcgctcataccagtaatcccagcactttgggaagtggagacagaggaatcactttagcccaggagttcgagaccagcctgggcaacatagtgagaccccctatctctacaaaatatgttttaaaattagccagccatggtgatacgtgcctgtagtcctagctactctggagactgaagcaggaggatcacttgagccccggagttcaaggcttcagtgagctatgattgcaccactgcagtctagcctgggcggcacactgagaccctgtctctaaaagaaaaaaaggaaaaaagttttcttttttaaaattctgttctccttcccaaaatatttaacattttattttagaagaaaacatctttgttggttctgattataaaaataattcactcattataaaaaaaatagaaagatagattattactattctggatgcgttccagatttcttcccgtgcacacatatatgtgcagtgtttgataaataagatcatatcatacatgctgttttatagtttgcctttttcgtagactatatcctagacagctctccatgtcagtgaacctagatatattatttataataactgaattataaaccattgtctgaatatttaggtagaattcaatttctcagcattacaaaaatgccatgctaagtatccttattacatgcctttctgttcatacaaatgataaatttctggaactgaaattgctgggacaaagggtatcagggtacacagctttacatgatgctatgtactaccaaatggacccccaagaaagacagtttaagtggcatgtcattgtcttcccaagtctgttcctaatgcagtcccacatgttcagtaaaacatcaagacacatcagttgggccaggcacggtggctcgcacttgtaatcccagcactttgggaggtcgaggcaggtggatcacttgagttgaggagttcgagatcaacctggccaacctggtgaaacccccatctctacaaaaataagccaggcctggtggtgcatgcctgtagtcccagctactaaggaggctgaggtgggagaatcgcttgaacccaggaggcagaggttgcattgggcctagatcatgccactgcactccagcctgggcgtcagagtgagaccctgtctcaaaaaaaaaaaaaaaaagacacatcggttggtagctgtagcctgccaggtctgctactttatcatatcctcttaatggcttttcagggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtgtgtatataccccgggagaataaataccctgccattgggggctggtgtggatattggaggaagaatatattttcttttctttttttttttttttaatttaagttctagggtacatgtgcacaacgtgcaggtttgttacataggtatacatgtgccatattggtttgctgcacccatcaactcgtcatttacattagttatttctcctaatgctatccctcccccagtcccccaccccccgacaggccccagtgtgtgatgttccccaccctgtgtccaagtgttctcattgttcagttcccacctacgagtgagaacatgcattgtttggttttctgtgcttgtgagagtttgctgagattctctcaagagaatcatgcagcttcatccatgtccctgcaaaggacatgaacttacccttttttatggctgcatagtattccatggtgtatatgtgccacgttttcttaatccagtctatcattgatggacgtttgggttggttccaagtctttgctattgtgaatagtgccacaataaacatacgtgtgcatgtgtctttacagtagcatgatttataatcctttgggtatatacccagtaatgggatggctgggtcaaatcgtatttctagttctagatccttgaggaattgccacactgtcttccacaatggttgaactagtttacactcccaccaacagtgtaaaagtgttcctgtttctccacatcctctccagcatcttgtttcctgactttttaatgaatgccattctaacaggcatgagatggtatctcattgtggttttgatttgcatttctctgatgaccagtgacgatgaacattttttcatgtgtctgttggctgcataaatgtcttcttttgagaagtgtctgttcatatcctttgcacactttttgatggggttgtttttttctcgtaaatttgtttgagttatttgaagattctggatattagccctttgtcaaataggtagattgcaaaaattttctccattctgtaggttgcctgttcactctcatggtagtttcttttgccatgcagaagctctttagtttaattagatcccatttgtctattttggcttttgctgtcattgcttttggtgttttagtcatgaagtccttgcccatgcctatgtcctgaatgatattgcctaggttttcttctagggtttttatggttttaggtctaacatttaagtttttaatccatcttgaattaatttttgtataaggtgtaaggaagggatccagtttcagctctctacatatggctagccagttttcccagcaccatttattaaatagggaatcctttccccatttcttgtttttgtcaggtttgtcaaaaatcagatggttgtagatgtgtggtgttatttcttaggcctctgttctgttccattggtctatctctctgttttggtaccagtaccatgctgttttggttactgtagccttgtagtgtagtttgaagtcaggtagcatgatgcctccagctttgttctttttgcttaggattgtcttggcaatgcgggctcttttttggttctgtatgaactttaaagtagtttttccaattctgtgaagaaagtcattggtagcttgatggggatggcatcgaatctataaattaccttgggcagtatggccattttcatgatattgattcttcctatccatgagcatggaatgttcttccatttgtttgtgtcctcttttatttcgtggagcagtggtttgtagttctccttgaagaggtccttcacattccttgtaagttggattcctaggtattttattctctttgtagcaattgtgaatgggagttcactcatgatttggctgtttgtctgttactgatgtataggaatgcttgtgatttttgcacattgattttgtatcctgaagaatatattttcaatactggagataggtttcccaaagacaattgtgtgtgtgtgaaggtcttttaaccaaaaaaaagataatttttgagactttattctcaggttgttcttgaggtaatatacgttcttgattcctccagtatcctaaagtagttgttcatatgtccattttagacctggagaaactgaacctcatagaaggtaatattcctgtcacacctgtaaggtgcaactgggactggaacccaaatcaacctaccataccacagtgcaggagcaaatttccaaatatcttagcctgtggttcactttgttctctgaccacaagtctctgttagcctgctgctgtcattcatgaataactggcttggcccatgtgaaaaggacccctttattgtcagtatcactgatggcttcctataagtacatctgttaggaaaaagaactttcagtagttaatggaaattagaatgcaactgtcggccaggcacagtggctgacacctgtaatcccagcactttgggaggcccaggcaggtgaatcacgaggtcaagagattgagaccatcctggccaacatggtgaaaccttgtctctactaaaaaatacaaaattagttggcatggtgggacctgtagtcccagctactcaggaggctgagacaggggaatcacttgaacccaggaggcagaggttgcagtgagtcgagatcgtgccactgcattccagccttgcaacagggcgagataccatctcaaaaaagagaaaagaatgcaaccctctttaagcaagttgacatatcacagcctctggttgagaaagcatgcgttaaagttcttgccaagcagccatgctgggaaatacaaggtgtcattagagagtggccccactttattaccctaaactgcctcccagaattctgggagcatttcccccactggactgtcctataggataccagctcttcctttgcactagccccaaagtctcaaagggaaattctactgtaaaaacaaaaaactagcacctctttactataagacatagttgactgtggaatctggaatgctctgtgaagggtactctctgacatcccctaaaaccagtgtgttcaccaagggactcccataccactgaggcctatcctcagtccctggctgatgctggcacactacctctctggccacatacctgtcttgcagaaatgccccagtgatgactgccagactcacctctgctagtagaaatgggcctaagtctctctgtggactgtatccgtgaaatttctttgctaccactcatccataccagctgatacctcacaaggagctgatacctcattagctaactacagctaaggctcctcatctggactcagccctggatggtttcacagaatccatgaatcctaaaaattgtgtgcaatattctgtgtgtttatgtctggagaaagtttacttaacttttgtaagaggtaggatgatcaggtcagtgtcactcactctttgctctaacaaggcaactagccctcctcctggatggtttacgttttcctccccagacaggcatgtgggaaaaagactctgttctcagcagtctctaccacagctgcccaggggctggcaggagctctggtcttctccaggttcttagcaccaagcacttagagctctcagaacaattccaaggccagagtaggatgtggccagaggagctgcccagcctcagcctgatcagatgaagcaagtgcttccttacagaggtggctgaagaccctgttctccacggtggggggtgccatgtggccctggccacttaactcagttctctttgctttatttgtttgtttgcgacggagtctcactctgttgcccaggctggagtgaagtggtgcaatctcggctgactgcagcctccgcctcccaggctcaagaaagtctcttgcctcagcctcctgggtagctgggactacaggcacctgccaccatgcccggctaatttttgtatttatagtagagatggggtttcaccatgttggtcaggctggtatcgaactcctgacctcaggtgatccacccacctcagcctcccaaattgctgagattacaggcgtgagccaccatacctggccaactcagttctctttgctaatggtgctaaggaagccatatagtttagttgctaaaatccagtggtttgttctggagtcaaaccacctcagtctggctcccatccctgttatttataagctgtgtgacttcggggagtcatcagcctctctgggcttcagtgcccttatctgtaaagtaggggataaaacaggcacttaattcactgcagtgttgtgaagatgaaacagcataggccttctaaaatgatgaacacagtgcttagcacagaaggagtgcttgtgaatgctaacatcactgttgctattactgtttgtctcctttgatccactgctctccctttgatctgcaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtaggtccctgggaatgcaccaagtcaggcccagaggggccagatcaggtgtttgggaatttaaagcaaaacttaggccacacagagccaagacactactacaagcagacttgacactccagcaggcctgtgagccttcagactttaggccattctgcagagccagatgggtcctcagtggcttaggaaggcccctcccttacagctgcgtcttggcactatttatttacaagaatgtcaattagaccttcattctttgggtcacaaggcagcaggagtaccagaactagagtgtgaggcctaggttcctgtcattggcagagtgatctagggtaagtcagatgagaaactttacaaaagtttgtcataaactgtcatgcggtgtgttgagtatgagatcatgctgttatcactattattattaaggtcatcactttaactgaccatttctcattctcctcaactgtcaaatgaagtttgataataatagctactacttgttgagtacctactatgtgcaaggctcattttatccgttaactcatttgatcgtcacagcagtcccataaggaaaatatcattaattattagactcattttctacattgggaaaaaacagattcagaggtaaagtaattccccaagagtcacatggtgtgtgatagagtttagatttggacctaggctgactccagatccttttttttctttggctcatttgctccaacattccaggattctgttggctactgggaggatgtctacaaacctgctcattacacactcagtgaccagaatctggtttttttcttatgcccacatagtggttggaaagagcgcagattttagggattcaaatcccagccccaccacttcctagcttacacaggtgccctccctccttttcttcctattgatgtgtaacatacgtacagtaaagtatacagatcctgtgaaccactctgcgactgttcacacacacacatgtataaccaccagccgtatcaagatacagaacagtccaacatcctggagggcccccttgtgcccttcccagtcaatatgtagcccccttccccacaaactacttttttgacttctgtcacattaaattacttttgcctttttttttttttttgagacatggtcttgctctgttgcccagactggaattcagtggcacaatcttggctctcggctcactgcagcctcagcctcctaggctcaagcagtccacccacctcagctttcctagtagttgggactacaggtgtgtgcctccagacctgactaacttttgtggattttttgttttttgtagagacagggtttcaccatgttgcccaggctgctctcaaactcctgagctcaggcaatctgcctgcctcagcctcccaaagtgctgggaatgtgccaccacgccctgccttttgcctattcttgaaatttatataaatgagatcaaacaaaacacacgtttatgttgcctgtcatttgttcgttatgtctgtggcattcattcccattgttgcatctagcagtagttttctcatttaattgctgggtagtgttccatttacctgcatatactacagttcatcttttcttctcttgatgaatatttagattgtttccagttttgggctatgtggaataaagttgctgtgaacattctggcacacatatatatttgttataaaagtaatatgaccatgtggagaaaaattaaaaatcaagagaaaacaaaatgcccataatctcagtatcctctcacaggctctttaagtcattctaatccacatcccagggtagaagttgccatcagaagtcatgagaaccatgactccctagcaagaccaacccaacatttcctcaatgctgtgaatagaaaaccaacagagaagccactcccttttgtgatcttcatggcctggagtagtgtactgcatttaacctccatagatacccctttgtgctgcttctggcattttaaaaattgtctgccctgtattatggctagcagtaccctagtgctgccttccctacttgatgctgagctctttgacggcatgcagtgtcctgcgtgatatgtgatgtggagcacagcaccgagtatatagtgtttgataagcatttgctggacaactttttgattcccatgatcgggaacttaattttgtttttagaataagttttcacagtgtctcacttagttctcagagtgtacagatgtttatctgtaaaagggaagctgctgtttttatattttgtgtggtcagatgtcatctttatctttttcttctttccttctaaaggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctaggtgagctggatggggtcttctctttcacaacggagaaatattacatcctctgcagctctggatcatgtcaatggaaacaattctttgctcatcttctttcagtcagagactctaaatgtgaatatccagctgcctgtaatgctttggagactttgttaatccaccgggatctgctcaggacaccattatttgaccagatcattgatatgctgagagtggaacaggtaagagttccataggactagtacattacttcctgtcttagaagcctgtggaattagaccaggcacagccataccatataaggcagtttaagaaacaatattttttaatatcttctgtgtacaaagttccatgctaagtaaagtgtgagtaaaacacaacccctgccctctagtagtcgaaccaaaccaatacacaaatagctttattacaaagtggaatgtgttgtgtgctaaagagggttcaaaggtaagacagaccacatggcactatgctgactgaactgtttctggcaaccttatatatgcaaggtgttcccaagcatatattattttttggatttgatttgaaaagatggtgcagaaacgtttcaaaccaaaaacttatgtacattcactgcctccccccagtgtctttggttaccaatattagtgtacttaatgcagtgatatttgggattcagtaatttgtagaatgtctccctggattatgtttttactatattgttaaggttgtaaacaaaccaaaagccagtaagtttcaaatataaagttgtgctgtgtcctaaattcatgcctgcaagaaaatataatagatgccctcaaggcaaaaatggacaatctgttaaactctctgcatggatgcattttaagctttaatttctgatgtcatagtacactttcagagttatataaaccagcatggcagtagagaaggtgcttgttggccttggttgctttgactctgaacatatgtctcttcccttccatcctttgactggaaaggaaggctccagttagcttataaatgtggcatggtcccagtgagaactggaaagaattgttttaaaaatgaaactgtactccatggattacaaggaagttagatcacatggtcattcatgttcggggaccttactttactttggtaaggaagcctgttgattgggcacctgtgtttgccaagcaccacagtgaactggattagacaggaggaaagctctcctttagccaggactaaatccctccccagacctaatttgaacacacaagtggtatcctcagtcattaaaatgaggatggccttgaaattccaaatcaaaatgagtcactgtgtgtacttcatacagcacttttggatggcagaaagtaaagctagaaggatgacttgcacagggatggggttccagtccccaaggaacacagaagaagtgagatcccagataagaaacaatggcagggcctcgggaatcatgaggataaggcagacaccacttataacttgagccaaggcaaaagcttgatcccaaagaatcaaggcatgaaccctgtcctggggatgtctcagaaaacaaggtttaagtgggatccagcttgtgattgggatcctcggtgaccagcctcagaatccttaaattcctctaaccagcagcaggattagagccagagcctggggctgagctgaacctagaggtggggccagactgacgcagttggaaatcaaatgagtagccacagtttcaggtgctgaaagcacctgaccaagtactgcttacctctaaagcaaacctgggacttcgctagggtacagggagtagcaatgtatatgtggcacctccctttttccacacgagtctagtgcctaggtaccatatgcaggaactgggatctttattgtcaagtattcattttaggaaaatgccagaagtcaagcccttgtgttgataacccactaaacgccttgcacattcttttttattcttttttttttctttgagacggagtcttgctctgtgccccaggctggagtgcagtggcacaatcttggctcactgcaacctctgccttccaggttcaagcagttctcctcctgcttgaacctcccaagtagctgagattacaggcacctgccaccatgccctgctaatttttttagtaaagacggggtttcaccatgttggccaggttggtttttgaactcctgacctcaagttatccacccgtctcagcctcccaaagtactgggattacaggcgtgagccaccatgcccggcccaccttgcacatccttaacgttcaaggcttcctgcttcaatccctgttccaactgtcttgagggcccattgctggcaagtggccagtcagatcatgctggagggaggaaagtaggactagttcagttgttgaggctacaggagccactttgggctgtggttttacaggctcacctttctgttctatcctagaacttgcttatttcagttgtttttatgttgttgcccctggacttcctctgttccaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacggtcagtgtccagatgcttcccgcatacagtgtctgcctttgctgctttctgatcctgctcctcttagccccccttgggctgcagaaaaacatcatttgagtaggcttatggtaatgtttagtagtggttgcatttggtactttgatgagtgctttcacatcactttattatattgtcacagctggaggaggaggggcagggatgattagctctgcttcgaagatgactaaccctgtcagaggcactatcatttaatgcgtgcagcaaatcttacaaggtagttaaaataaacccattttacagctgaggaaaccaaggcagaaccaactctgcacattcattcattcattcatttattccacaaatatgtatgcagggacactcctgggtgtcagatactggagcctcaatggtggaggatgccagtagggccccaatgaggaatttacagtcagctaattagggcaccagagcagtaccacccgtattaacagccaacatttaccaagcactcactgtgtgctaggcactagcatgagtactccccaggtgtttcatcctctctacaaccctatcagctaggtcatgttgtaagtcccttttgacccagacacagagagttttgtacacctgcagaaggtcacaaagctagcaggtgtacagctggagttcaggcctaggaagtctggctctggagcccataagtaggaagtttaggcaggtcacctgcatgggagatctggattccaactcagtctttccacaacaccgtgattgatgaagctaacttgtcttcttcctgttgagatttttcataagcctgagtatttaatacgtgagaacacatggagaggccccagtggggacccagaccctgccctgatctgtcaccagtcaatggctggaaacagggatgttctctgggtatcatcctaacttggtttctccttcttcaccctgcagaaaacacagcggagttcttcctgcagcacgtagacagtgcctgtgtgttctggaatgccagcactcgcttttctgatggttaccgctttggactgggtaagaaagactctggttgggaagaaagaagttccttgtgaagcactgtgtggtctaggggtatgttgaggtgggaaagacacctccccttgactgtcacatgcttggtcaagataagagagaaacaggctgggtgccgtggctcacgcctgtaatcccagcactttgggaggccgaggtgggtggatcacctgaggtcaggagttcgagaccagcgtggccaacatggtgaaaccctgtctctactaaaaatgcaaaaaattagccaggtgtggtggtgcatgcctgtaatcccagctactcaggaggctgaggcaggagaattgcttgaacccgggaggcagaggttgcggtgagcccgagattacgctacagcactccagcctggaggacagagtgagacaccatctcaaaaaaaaaaaaaaaatagagacagacttctggcaaggtaggattatcagggagaataattaatgaaacctcccatgagttggtggaaggcctatcttctaagcatttcacatgctaagaaggcaggtacttgtattcatttttcaaagagggagaatgagattcagagaagtatagtaacttgcccaaagtcccacagctggcattcagacccaaacttgagcaagtccaaagcctgggttctcccgctacagcgtgggcaaccacagcctgcctttttacacaggctgcgccagaggtacatgctgtgtcccttgagagcactccttttacagacttatttcgtcaaaatggcacagccaggttgcctcggagataggaaaccccacaatggtaggacaaaagaaggtgccgtgggcctaagtaccagcatcaaaacaaacaggccagccagaagtacaaggttaccttctacagcagaccttgaaataaaaagcttcagaagggcacttctgtccctttccattaggtataaaatttccagccctctgtcgtgttggggttatttggacagtctctcgttttcaggggtaccagtatataaaactccagaacgggcgcagtggctcacgcctataattccagcactttgggaggccaaggcgggcagatcacctgaggccgggagttggagatcagcgtgaccaacatagagaaaccccatctctactaaaaatacaaaattagctgagcatggtggcacttgcctgtaatcccagctactcgggaggctgaggcaggagaatcgcttgaacctgggaggcagaggttgcagtgagccgagaccgcaccattgcgctctagcctgggcaacaagagctaaactccatctcaaaaaacaaaacagacaaaaaacctccaataatacatttatgacacgttttctgaatatttgagaattatttcaaccactcaaaacattttaggccacgggcagtggctcacacctgtaatcccggcactttgagaggctgaagcaggaggatctcatgagtcggggagttcgagaccagcctgggcaacgcagcgagacctcctctctacagagatgaaaaaattatccaggtgtggtggcgtgagcctgtagtcccagttactcaggaggctgaggcaagaggatcccttgagcccaggagttcgaggctgcagtgagctaagatgatgccattgtactccagcctgggagagagtgaggccctatctgtataacaaaacaaaacagaaagacacacattttaatccttctgaactttttgagtagatgatctgcctggagaaataattctcaccaaattgttaaaaggttatgaaagggaatttaactcagttattcttaatcatgatactctttatttttagttccccatttgtattatgttgggattttgatgtaattatcacatcacttgcattgatctttatactctccatgtacttgaaaaagaaatagcaacatatttttaagggctggggcacccagcattcaaatgaaaatccaggatgaaggaagaacaaaagatcatttcattgtccttccaacaccagctcagagtgaaagctggttgagttaaattccttgtgaaatgcattaatgacagtaacagattttactgagcatttactacattcccagcactgtgctaaatgtgtcgcaagcatgctctcacttcattctacaagatgaattctcattttccagatgaagaaactgaggcatgagacataaagttaggtagtatgtccaaagtcatgtggtctgtatgctattgaaccagaatttgaatcctgctggtttcactctccttgccaaccactaccccaagcacatcccgcccctactgtgtctcgtacttgctcttctctctgcctgcagcacctctgtctggttttctccagccagctccttctcactgttcaggtcccaaccaaaaggcacttccttagggaggctttccctgaccatcctacccagcgtgtccccagctccaccacacagcctctgtcatagcacccatcactgcacttgagcaccacaggagactatttactcacctgtcctttggctgcctcgcctgctataatatcagcgccacaaaaacagggccttgtatctattattcaccactttatccccagggctcaacacagtgcctagtacatagtacatgctcagtaaagttgtgatgattgagggaaccctgcctccactgtatacagtgcagaacaccaagccagggccaggaaaacccctgacgttccctaggtctgagctgggagcaagagaaaagggaatgaacagtaaccctttgatgtattcagtaactgtctaatgagtcccttgtgctaagacttctaggggataccacaaacatgtccctttctttctaagatttaaagagtatttgaggaggtgaaaccatcatggtaaacattgtcgtacccctcaaaacatgcccaaatgtcaaaatatggtatgcaattcagatgctaaactgataaaagagacagcacttgtattaatagcattgtcaaaatgcactggggataaaatacagaagaagagtccacacactgtttcacgagaaggagtgtatcatgatttgtagtaatcgaagaacatgtttatgggaacagggtgactcagctcttctggggaggatggatgaggagttagcaggaagagagggtaccaagtgaggggaaagcagcagggtgggtctggggcatggacaggaagcagaggctgggaaaagctacatcttttattcatgctttttcacaggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatg

SEQ ID NO: 38214 - DNA, 27247 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggtgaggtcctcccagcctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcagacgagcctccactctttttcattggttctttaaatttgcctcggtagctttgcgatgcatggtttgcgagcaacctttcttgcagaatcgtcaacgtaagtttttctgaccgatgaaaaagaacctctaaaaatacaaggctctcttaaaatgtaatttggagccgtcttaacttacacatttcttgagaagttaaaggcacctccatagagaaacttgttcatctagtaagtaaataccagagtttcaaagcggctggattgttccaacaagggtatcattgcattaattattaaaatagagctttctatacaggagggtgttgtttagagtggttttttttttgaaagttctttattactaaaacaaagtggaaacttgagaccacgattctttgtaaaacattataaaggtacttttctccataaagggtagataatggattgggattttggtagcattttattttttctttctttctggtacattcttttagctgtcttgattcggagtcagctaggtaaaaggactcaattgcttcaccccactctctggtagtacagtatattgcagctggtttttaaaatgacttccaccaccctgatcctccagcaaaattggagaatggttatgaaggccatttcctgcctgttttagaggctacagaaactgtccgtatctgtagcgaagagagttacatgacattgttttcctttttacattacaggaataaagagacaataaaaataaataattaccctgacgcgtggctttatttttgttttctgatctctgctgatgctgataacctgctgtggtctggcctagatggtgttatggttaactgaaagggagtttggggcaagtatgaaataatgggaaactaagtcttgggcaactttttgccataatacaatttcggtagtcaactgaaatgttttgtgtgttacctgaaatgtgtgttacttaaattgtttaaatgccctcctgataatttactttggtttggaattctccctaaggatggagttaattaagactcactaaggtagggggacatacttgattcttcaggattttgaattctagcccaatactcattttggccaattcagcaaaactgaaagggaatactgtgtcagtcgtgtctggtagccagacactggcattttgttacattctttagccgagggtgttggggtttgccttcttcctcagaaaatagttcaggggaagagatgcatggttaatttggttcctaactggtcctctatttactggtttttgattttttttttttttttgagacggagtctcgctctgtcgtccaggctggagcgcaatggctcgatctcagctcactgcaacttccgctttctgggttcaagcgattctcctgcctcagcctctcaagtagctgggattacagtcgctcaccgccatgcccggctaatttttgtatttttgtggagaccgggtttcaccatgttggccaggctggtatttgaactcgaccttcgcagcctagtgctatttttaactagggggttctccttccttgacagtaacaacttggccttaacttactgcttggttacagggactttggtgaatgatatctgtcctcttacctactcaggagtgtttgtagactaagtactgctgctctggtttcgtgtttaactggtgtggaagctgcctctaggggtatttttgttctccattagctagaatggagtgcagttggttagtataggaacaatcctgaactttgaccaataccatagcaagtccaaacttacaaactttgtggactgaagctttatgctacccttgcaactattttctaagttgaggaagtatgacgtatcaagcttcccacgccttagttctagttcagtaacttgtactcggtgtcttaagatccccatttgtgaatactctaaaaggtcattatctgttcacattattttggccataggtagaaatggccaagaggcttttttttttttttttttgagacagggtctggctctgtcacccaggcgggagtgcagtgtcacgatcacaactcactgcagcctcgacctggggagctcaggtgatcacccccacctcagcctcctgagtagctggggctacaggcacacaccagcatgcccacctaatttttgtattttttggtagagatggggtttcaccatccagttcaacatgccgggattacaggcatgagccattgtgcttggccaaggctgttaagttttctagatttgtttctgagctgtaaactcctcattcggtgagacctagtggtcatctaaactagaggttgagtttaaaattcagtttctcaacctggggagcactgttgacattttagcctgatcacttttgttgaggagtgccctctgggttgtaggatgtgaagcaactgtttttggcctctgctaggacgcggcctcctcccctcccatggtgataagaagtcaaaattgcctgtttgagaatcactggtttaaacggacttccttctaaaatggtgtgatatgggtggggtcaggttgtgttacagaagctagtctttgtgtgcttgttgcgaatttttcaggttttctattaatcttgcctaaggaaataacatgccatgtaaaaattagcattgttggatatctttgtgagaataaagcttttccactaatactgaggaaccttaacaaaaggtggtgaaagatggttttcttcagcaggttctgggtacttgagggttgcaaagggagggcttcgtgtttgtgtttgtgagtgtaggctttggacactggaaacttacctgagtttcttgtgctgcagaggggaacttggtttaaaattctgctgtttcagcatttttctgtctttattatcagggtcttgatgctcgagcaaattaggtgagaacagatctataggttagtaccctgaatgtcttaaatagcccgtggtcacaacagtgtgtagtgaagttaaatagtatttaaggaaacagtctaacttttaatgatcccaatagtgagaaacggctattaaagtgtaaattaagtttctctgcatgatctaactttccaaaaagtggcttcttcacccttaatacctgttttctgattggccattgaggtactctgacaagatctcctaaaagagatcttcacaccttcacatgctgcctaaaggcaaaccatagtaccccaggaggagtaagttgcagtttgaggggcagccaacacttaagtttaaaaatgggggtccttggcttgactcttctttttacattttggcataacttttttaggcattcctatatggtctggagagaaaactaattttctgcctgaaaagctcagtttctgaagggcacactcctaagcattctagtcatggtaaatggtgaggaatacaaatccagatggctcccttgtcagggttttcactttttctttcaagagcaccgcagagctaggacattgtgctgttagatacttggtagctggtgggtgataaaatgttggacttcttccctcacccttcctatatctttcatgaattttgttttgaattcttgtatttattttgtttagaattctttttctcaagacagtcttgctgtgttgcccaagctggtatcgaactcctgagctcaggccatcttcctgcactcagcctcctgaatgggcccctggtctgagtattggaatatttacatctgaatgatttgggaaatttgctgtacctcaaactcaagagtgaaagaaatgtccaaccaaaaagcgggcagcctgctctccatgctgccatttgtatttcaaactgagatgaccaaggttaagttcaaacaggcagctctaccactgttgctgaatcgtctttcttggtaaaggtaaattgtcaaacctatttcctgtgcatcttggtttgatcatgaagtgagaccatgaaggaaggcagtaaatgtccttcaacaccctcatccacatgagtaatatggaccatcttagctttgttgaagagggcttgttccagccttggcaacagagtgagaccctgctacaaaaaagggggcttgctgacttgatatggtatgccagtgaacttttgggagggagccatgatgggattgggtagtaggtgaaggcttttagctctgagtaaaggaaactggcatttctgttttttactttttgagacagggtctcagggtctcggcctgctcccaggctcgagttcagtggtctgatcgtagttcactgcagactcaaaatcctgagctcaagtgatcttcccacctcagcctcccagagtgttaggagtaaaggcataggccaccgagcctaggtgattttttttaaggctttgctgtgttgcccaggcttgtctcaaactcctggccgcgggcgatcctcctgcctcagcctcccaaagtgctgggattacagacaagaacctctctgcctggctgggtttcttttattcatttgttggacctgctttcttggtagcagtggtgtattgattcccagtaggatttatctgccaggagatccttacagatcattagttcagctgttttgctttgtgaattcatttgaaagtattataatttcggtacttagtaattagatggatttcttgacatgcattagatatttaaggcagtaatttaactctggttccatgttgattccattagtacatgggcttgcagccttgtgaaatgatgattcagtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctataatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctcaaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaataggtgaggaaatgcacagggattccgtaactacttttctccttttagggaagtgccttggctctcttaccaaaagcactgcgattttttaaaacagttgaaaatgtgctttccaaatgaagccgtgcttgtttaccgtgaaggctgattataatccgtattgtaaggattgacctggtagggaagtacatcatgaactgaaactttacctaaaactttggatacgtgatccagtagtttcaagggaaatctacaaaagtcaggtttttaaaaattttttaaaaattctgaaatagagatgaggtctcaccgttttgctcaggctgggttgttgggtttgttttttatgtgtagtttttttttttttttttggagactcgctctgttgcccaggctgaagtgcagtggtgcgatcttggctcactgcaacctcctcctcccgagttcaagcagttcttctgcctcagcctcctgagtagctgggattacaggcgcacgccaccatgccaggctaatttgtgtgtgtttttttgtttgtttgtttttttaagacggagtttcgctctcatcgcccaggctggagtgcagtcgcgtgatgtcggctcactgcaacctctgcctcctgggttcaagcgattctcctacctcagcctcctgagtagctgggattacagatgtgcgccaccatgcccagctaatttttgtatttttggtagagacggggtttcaccgtgttggccaagatgttctcgatctcctgaccttgtgatctagctgcctccacctcccaaagtgctgggattacaggcgtgagccaccgtgcctggccactttttgtatttttagtagagacggggtttcaccatgttggtcaggctggtctcgatctcctgacctcaagtgatctgcctaccttggcatcccaaattgctgggattgcaggcgtgagccaccacacccagccagaagtcagttttaaaacttaaattatttgagagtaggtatattttcaatttgattcttacaagtgacctaagggatctggaaaagaggtaaaactttgcatggtaaaggtccggcatgcccaaggctggacttggttctaaagcctgctttgttaactgttgtaaacggccactgtaagcattgtaacatctgtggcctaagtcagagactcaagtgttggccagcagggctaaggagtactctgagcccttcaagcttaaggggggatggaggcagaggcaagtgagaggggaagagtggagcctggcaattatttagcaagttctgtagcactgtggagtgggtttgttgactaagcagaaggaatgctgaacttttggtcacacttgatgcttcccgagtgagagtacaaatgctgacttagaagctctagtcatttcacaagtttctacccatgtttgtctcatctggagggttatatgctataatatgagaaagttcatttaacttgcgcctgggggacattgagttaatgatggcctggatgctgaggggttttgccaatactctcttttagacagttctttaaggcccaaatacaacattgcattatttgcttatttggtggttaggactgtcatgtcaagtgattggagttttgcttgaatcccttcctagggcgaaatgtctgggcaaaatggctgctagtgaacctcggatgtttgatatgctgtggttgcagtcactcataacctagtggttttcttctttttgtcttcatcacattctgaaacaaaaaatatgtttctatactaaccagaaaggaagacaggtatagtcgggggtattacctctacatggggaaagggacgaaaagagaagataattattcagaggaacgaaaagcagctaaagcagctggtagcatccattgcagctttaactgtggtgcacaaatgagctccatttacttgattacatcccccttgggtcctcctattcgaattccaagggtatcccatgtggagttcacaggctcactgagtttgctgggcttgtgagcgaaaatggaactgtcagcatattcatttgagcagtgctagaagtcagggtttgtgactttaggaaatggaatcttaggaaatgtggcagtttttgagctctgggaaaggcaccttagacctgtcctgtgagctgtcctatgtctcctccagagaccatggctacttcttaggcctggctctgtttattcctgttcttgggcctgcctgaccttgacagataagcctaagatcagtagagtcgttggtatagcctctgcaatcacattcagttaatgatttgaggtatttttaaaggctgtatttgccagtgttaacttagcagaaggaaggaagctcttatcagaaaatacgccaaagctggagtcagttatgatcaaatgaagtcgcagaccttgaagctttatctttgtttgcagagatctcacaaatggacatgtgaaaattaagccagacaagcagatatttcataggagttatcaagaattcatgtggaagaaaaatacttaggttgagatgtgaggactcaaaagtatctgttttgatcttactaatagttgatgttaaaatcaacttctggtgactacttgagcttaattttttggaggaaagccattgtaataggctccctctggctttcagaattataaatatacagtgcttaaggaaaaagggagtacttgaaacttaagtaatccatgtgcttttagtgaatatatttagtctttttatagctgattgaccagattttcaagttttagaggttaagtacataagtttttagtcttgaactttttattttgaagaaagggacccaaagggaaatttggagtgaaatacctcatcttcttaattgtaatcttcacttggcattccgtgctttgggtaatccagtgttatgacaactttactttagcactccttacagtaaaaggaatggggcaatgagatgcttacgctatgagttcctcgtgccttgtgtgtcaggttttcagattgaccaccaccttgtctgctttaatgtacttttatttaagtcacttttccctaatagcccagttcctattagtgctgccactgttctctcctctcttttttttttttttttttttgacgggcagaaatggagttaggtagtttttttcctctcaatttccagctcagaaaatcagttaattgagtattcagagtgatgctcacacttgttgctcatgtgtaaccacagtgggattgtgctaattaagtaaggccttggttggtttttctaattcacccctcctgtctagattccttggctatttgaaacagtcccaggtttactctgaactctccacccaggatcctattccacatgactgttctctgtgccatctccccaggttttcctttcagatatttgtgtggcctggttaatgcctcttgaatgttcattgtactttggcatttatgtaagaattcaagattttgttctatttagttcaggccttagtgtacagtcaggtatttggccaaatgtattgtacatgacattattgtagctgttgtttacattacaggaatacttcggatataccaatgcatgtgaagaatgggtttcccctcagtttcacataaacttagaaatgtctcaactgacatttctttttcttttttttaatttttaattctttttttttttttttgagacagtttcgctctgtcgcccaggctagagtgcagtggtgtgatctcagctcactgcaagctccgcctccagtgttcaggccattctcctgcctcagcctcccaagtagctgggactacaggtgcccgccaccacgcttagctaattttttgtatttttagtagagacggggtttcaccatgttagccaggatggtctccatctcctgaccctgtgaaccacccgccttggcctcccaaagtgctgggattacaggggtgagccgccgcgcccagctcaactgacatttctaaatgatctatgtataaactgctttttagtaactactcatttttggaataattttttagggccaaatgagtttgaaactaatacgcaaaaaatgtatttcagctgagatctgtatctgtggacctgaatgttgatccctcgcttcagattgacatacctgatgcgctcagtgagagagacaaagtcaaatttacagtgcacacaaaggtaagtaacatgcagtggtaatacatacagtgctaggttgcagccttgttattcacagtggatgtgagaagagattccctgagcttgaaacagttgctattcgtagggtagcactattaagtgagaacctccctaatctatctcacagtaagcatcaggtgagtgccattgtggcggcagcagcattctgctgtggcagagccctgggctgtgggcattgtttttttgtttttttttttttttttttttttttttttttggagacagtctcattgtgttgcccaggctggaatgaagtggcaccatcttggctcactgcagcccctgcctcccgggttcaagcaattctcctgcctcagccaccagagtagctgggattacaggcctgagccaccacactcggctcaaactcctgacctcaggtgatgcacgtgcctcagcttcccaaagtgctgggattcaaggcgtgagccagagccaccacaccgggccccagctttgtttttaatttgcatccaagggaagtttgtctctgtagcttgctttttttcagcatttactaaattgggaaagacctttcccatgtggttttttcttaacgcctgggcggcttgaatagcacacttcagttattccggaggtagtgtaaaaagactggtgacataattctctgcctgagcttaccagatcaaaggaggtaaaatcagcattcactggagtgaaaaggaaggaagccagggacaatttttagaaccatagtaagttacagctaagaggtttttttaaaatttatttttcttctttgtcataagttgggggtggggggtaaattcagacttacaaaaatagaatttggggctgggttgggtggctcacacctgtaatcctagcacttcgggaggacaagatgggcagatcgtttgagcctgggcaacatggcaaaaacctgtctcttccaaaaatataaaaattagccggatgtggtagcacacacctgtagttccagctactcaggaggctgaggtgggaggatggcttaagagcctggaaggcagaggttgcagtgagccaagaagccaagatcattccactgcactccagcctgggtgacagccagaccctgtcccaaaaatgtatataaacaaaaaaaagtacacagaaacaaaaaaatagaattagggttgtggcttatttcttagaactgaacttctaccagtagattctgatgggatattcattacaagcttcagaaaggtggagtttggggagaaatcgttagagttcaggttgaatcttagctatgactttcatgacaggagatcatgtataactgctttgttctttactggatcatattatgatgtattatgcagaattttcccactgtgtagcctaggaaacccagatcacttatctaaaagtcgtggttaccagttaacttctttctttctttacagaccacactgcccacgtttcagagcccagagttttctgttacaaggcaacatgaagactttgtgtggctacatgacactcttattgaaacaacagactatgctgggcttattgtgagtcttttagaaaatcaaataagctagttctttctgccttgctatgcattagtttaaaagagacttatatccactttttttaatggattgtgaaaagttagatttcatctacctactggagtatttgctgactgtcaagtggaaagtatgtgaaggaatagtgttacagctttgaggtggtgcatacaggcttacattatttacattgtaaaggggtgtgaacagtgtaatgactttagtcttacctacctttaggtttggtttttctctggtatgttttttcctatgtcagtagaattgatttctaggaaacactgctattggtaatagtttgtgataagatttctcaaaagttgctgaaggaggccatgcctttaatcctagcactttgggaggccaaggtgggtggatcacctgagctcagaattttaagacgtgcctgggcaacatgatgagaccctgtctctactaaaaatacaaaaaatttgctgggcgtggtggtgcgtacctgtagtcccagccactggggaggctgaggcatgagaatcgcttgaacttgagaggcagaggttgcagtaagccgaggccgtgccacgtcactccagcctgggtgacagagcgagactctttctcccaaaaacaaaaaaagtgctcaaggaggcagttttcagcccttgattgttatttcttggcggcaggaacagacttaactgattttaaaggagatttccacgcgttttgtcctgccaggcagactgaagaagctctccaaatgatgattgcttaatcattaaacaaaattaataccgaagcttatatttagatatgtctttcattcaaaattagagtccttgattatcctttgggattaggaaaaaattcctttggaatactgaacactttataatcttgatggctcatctttggtgcttagcattcgttgtactagttttaggcgaacactgaagcagtatagacactgttgtgctctgaacaattgtctataatggataaactgaacaaatgattgccatcaaagtgaatatgcaactctcaggaagacacctcattttaaatgtccagaagagttaaggaaggttaagaaaaaacaggagttgacttttaaatagccccacaggagtggagtggttgtctcctgtggaccagcaagagtagaatgaggcaccaactagaaaacatcgctgctgggacaagaggctcatgagttcctgcctctgctgcagattccacctgctcctacgaagcccgactttgatggtcctcgagagaagatgcagaaactgggagaaggtgaagggtctatgaccaaagaagaatttgccaagatgaaacaagaactggaagcgtaagtggattttcctggtgggctctgtcttttgagaagtagaaaagtggtgctgtgtacaaaaataagtagaagaacctgacttaattttgttttaagtgcagctgtttaattaggtccctagcgtcgttttctaaaactagtaatacatcttgcatagtgtgggacatggtctttgtacttcacacattgattcattggaggccattgacactaatacccgatagagtagttgtcttttcccatatgtagggcatacttattaaggatgctggtctggcacagtgaggaaataaacttttgtgcctttataaattgctcataatgtacaaagcttttctttcggaagcttggttactagacgttgagaagaaactagagagttgggggtttcgtcatgtgttgccccggctggtctcgaactcctgagttcaagtgatcagcttgcttttgcctcccatagtgctgagattatagtgagctgcccctgggccaggccaaatagtgctgttatagagtagcattctcagtaaccatcacatagataatttgaaagaggaagtccaggtctacaggcagcaagtatattttaatctggttgtcatttaattttttcaaacaaaaatagatttttggaaagtttcttatgaatccatccttgcatttcctcatcttagctgaaaagtactcattcctcccctcttcaaccatcagctccccctctccaaacccctgtgtcatctagggcagcactcaaacctccaggccctgaaagcatttagcacacacttgagtggctctcgggaccagctctggggaatgaggcactgaacacaacagatccaagtttctaccgttaggaattttaaggtgacttttaatgtctaggttgagataaagctgctttgtaatttttgttaacttttagcttcattagactcatgctgtatacttaggctgcagttaaagggttctcattgctttaaagaaacaaatgttctgtggctactaagtaacagtaattgcatgtagatttaggagctcatggacttgacccatcaaatccagttacaacattgctttcctccatagtcttattccacagattcaaaaatggcaactgccttagtatctaactagacaccagtttatactgaaatactgtttggtccagttgcagtgttttatgtggtggcatgagcagggccatagaattaatcaggagtggtattggtcaggtagttgagctgtgtcaactgaatgccatgtgcacatctcttttcagtgagtatctcgctgtgtttaagaagactgtgtcctcccatgaagtctttcttcagcggctttcttctcaccctgttctcagtaaagatcgcaactttcatgttttcctggaatatgatcaggatgtaaggcatttttattccattttgataatccacttcaaatgtttatactttcaaaatgtacttgatagtttctactgctttaaagttttgaatttcttacacaatggaaacctttttagatgctgcttttccttcattgtaagtcattttttgtaaaactctgcttaaagaaaattttgacttctttccccttccaaaacctaggtttctttttaagaaattaacagtcccaaacatcccttagttaatttcttaacaattccaaacttaactaagttcattttaaggaaattaaaatttgtgtaatttattttcttcccacctacgctttttgttgaattatgacttttttcttttcttttttgaggcagaatctcgctctgtcatccaggctggagtgcagtggcgcgatctcggcttactgcaagctccaccttctgggttcacgccattctcctgcctcagcctcccgagtagctaggattacaggtgcccaccaccacacccggcttattttttgtatttttagtagagatggggtttcaccgcgttagccaagatggtctcgatctcctgacctcgtgatccgcccgccttggcctcccaaagtgctgggattacaggcgtgagccactgcgcccggccgcgaattatgacttttatgctatttttctttttaacatgttttggtttttgctacttaatatggatagaagagaacagtaattttcccaaggatttcagagccactaagacttagcttctagtcagtctttcaaaatctgtcaagccttttagaatgagatgacctacctatgtttgggtttagccattaggtgttttaagcttggaggttaaggcagaattaaagatactttatgcatttgcctgtactgataaagaggattacttaaaatgttactcagaacttctttaagagaatctagaaaaatccataccatataaactctttggaattttcttcttttagctaagtgttaggcggaaaaatactaaagagatgtttggtggcttcttcaaaagtgtggtgaaaagtgctgatgaagtcctttttactggagttaaggtaagtgacctttggctgttggagaaaattttttacttcatcgggaataggtgaccttttgtttctttgaaagagatacttgtgaaacaaatggttaacttttaagacatgtaagtgttcttcagattttggtaattttcatctacttattcaattttcacttatttcccagagcaccttgttctgtcccaggagaagcaacttgaacctttccacacttggcttcattttctccttttctgtaaggagggagattactcagttaatttctaaaataaagtacaagatcagtattttatcccactctcagaactacactgtccagtttggtcaccaactacaggtgatagagaagcacttgacatgcaacctagctggcacaactaaggaaccaaactttagattttatttacatactggatttcaaggcgttagcacaaagacaagaatacaaaataacgtttccgttaccgttagaggtatgatttactttactacttctcgggccttctcattcctttgtaactgagttacccttacaattactgtctggtatctggctttgccactccagggagcccagaatacaggtgctaagtagagagggcatcatcagaaattaggaaactcggacttggtccagtttaaggtgtatgggactgtcctgtatccatgcattatgggatatttggcattggcatccttggccaatgcctaccagataccaggatttcctcccagtctgaaaccaatcgagaaaaaaaaacctcattcacacacagataggtatccaaggctaagtggccatgttccacctggtagaaccattgtactagcgtaaaattgctgtgtcttagggtgccagttttactggtggttgttaagtgattcttctgtagacattttctgccagcccttgatttttcccagccttggttaagaaatagtatcgtaaatttgtaattccctgatctgtagaggttaaactttactcacgtttatatgccatgttctaagcaatatatttttatattgataaatgtaaaaggctgcagggatagtatatttcatgaaatgtctggttctttttttcttccttctaggaggtagatgacttctttgagcaagagaagaacttccttattaactattacaataggatcaaagattcttgtgtgaaagctgacaaaatgaccagatctcataaaagtaaatatcatttaccgctagtcagagctttgctgatgagcctggctgtgtttggataaaaagacttgtccttgtttctgcagatgttgccgatgactatatccacaccgcagcctgcttacatagcctggctttagaagagcccacagtcatcaaaaagtaagtttttttggaaaagcatttcccctaacccaattgaagagtgccgagtggtgtaattaaaagcataaatgagtagtgactacatggtcctgctctggagttacaagctcagtaagacaagtctctagcactcatcttacatgttctctggacataagacacttgtaagacaattgtaggggacttgggctcttctatatgtaaacaaatacagtaaatgttgtcaaagcagtagtttctgtcacacttaaaagcctgttttctttagttttggagtttgtaagagtttatcttgcatcttcccctggcaattggtgcttgcaattttgcctggtaatgccctagaccttctttttttttggcctgtgatgcagcctcaggagatcctgagaacatgtgcccctgccctggaccttgaagagatttggttatagtggtcatgagaataatttaatgaccccagtctaacacacagctgttttgatgtacaattttctgaaattaccttcattcattaattaaaaacccttccattttcactctgcacttatgtatgtgtttcagtttctccatcctgggcatttctggtgtaagacaatattttacttaacatccaggcttggcaaaacaggtgatactacttctgactcgaaattgaaaggctaatggcagaaccatgacgaattaaatagcatatttactgctttgtgatgcccatagcatagctcattagaaaccaaccttggtttacacagcattggcatttaataagaatatttgggcgcatggcaggatgaccgaagggtcaccaagaggctgagtgtggtgctgtacatgtgtgtaattttgtgaccattttctctactatttggggtcagttgaagtgagagcactacttttaaattaatgctaaagtaccaaaggctaggactcctgagttgacccattcctgtcttgcacactggtaagatcatgttttatagatgatttaagaccttaaaccaaaattatatgtacatttccaggtacctattgaaggttgctgagctatttgaaaaactaagggtaaggatttctgtgttggtcttcataatatatattttataatctatagctttctgccttgatggtgacctttccttttctatatagaaagtagagggtcgagtttcatcagatgaagatttgaagctaacagagctcctccgatactacatgctcaacattgaagctgctaaggtaggaagagagttgctcagcttctcagagcagtgcaggaccagaagtctgtttaaaaagtttctttatacaaaggagcagaataagaatttatcagacttgtttttataaatgacatgcctttctggcattgtatccataaagcttgtgtatctgacagcactgtatgggttgtgtgaagtagacaggtaatagtttgggggattataggtcattgatgtgggacataacatgcagaaagggctgtttctggggcaaagaagatttgggagtttttattgaattgcaagtatccctgcagcctttgagccgtgaagcgttatatgtatatgtggacaaaatggtaagcagaataacctttgggaatgaaacatgctttgtctgcattgccctgaacaaatatgttttaattttatgtgaaatgtattaaatcaggcaaaataaaattagataggattgtatgccctctaaggctgaaatgtcatcagaaagtaaaagagtaaaaaaaatttttccccccatcatgcaattttattttagttaatttgccctttggcatgttttctgaatcttgggagtttttaaaaacatacttttttaatagcctattttctactttcatggaattaagagctcacttacgattatttgagtatatacaaaaataggcctagtagtttcacccatcagttattatttcacctagttttaaatgtgtaatctatacatcataattgctcatttcagatactaaagtaacttctactctgttgtaagattgcaaagaatctttatatctgactaagtggatctccaaggtagattaccagaagcaggatttgcagggtagggttatgtttcttactacttcattgcccagttgtattttagcagcgctcaacttgacttacccagcagtgactgtatatttcaagttatctctgatacacaatatttaatttttaaagttaactttatttactgaattactggaaaacaaaagtccttctgttttcactcttgagtaatcacttgattcatataaggaattctaaaaaaagctctcaacaaagctatcagcattgctcatccctgcgaagctggagatttaaaaatactctgggagagggaaggtgtagaggtagattattgccactaacatctcaggtggtacattggcacttgggctattttttagactggtttagatacttagtatgtatacctgttaatttttttcccaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggttgagcaggacattcttctttctgtactgtaatttgaaaataatttcaaacttagaaaagttctacaaatagtgcaaaaaacacccatgtatccttcacccagtgtcagcacttcacccctctgccttatcacttgcacatgcacagtcatcctcatggctttgcgtgcttacaaacgttacacacctggtttttctgtaccattggagattaagttgcatatgtcatgcttcttttagccctaaaaacgttgtggtttatttcctaagactgaagacattctcttgtatggttacagtatggttgtttgctgtgataaacttaactttgggtctacaatctgctctctgtattttcatgtttgtcttgatgtcctctacaagatccagtctaggattgcatctggttgtcttagctattagtctcctttactctggaatagttcttagtttttaacagtatcagtctttttagagaatctctttacaaatcctgtatttctgacttttggtaggtttcctcatgtttagatctggttatgggctcctggcagaatagaagtaatatgcccttattggggtgtcacttctgattggacagtgtgtctctccttcattcgtggtggtaattttgattactcaattagatagtatccaaatccagtttctccactgtgtagttactattttaacccccatcaatctgtggtgaggcaatttaagaccatgcaaataccttggtcttcatcaaacttcctccctaggtttagcatgtattaatgattcttgcctaaaccagctgttactctgacgattgcagaaagacgatttccctcatctctagctctagctttcctacccaagttggcacttgtcatcctactacaaaaaagccttcccttttctcagaaatttcctttatctttattagagtcatggactcccagtttttaaaatggtttagaattcattattgtattaccaagttatttttgatgcctgtccagactttgccaataggagcacctttaagctggcatgtggttgtaacagcctaacccgtcttttttagagtgataggccatgctaatcttactctctgctccagccttgaaactggccattttttcaaggagccagggttctttttctttgggaacagttaccagcatctgagtatgctcatcgtttcggggtatctctgcttctgtgcccttcagtggactgagctaggaaatgtatgtgtgtgtgcacacatatgccgttgcacacacatgcaggtttcagggatcacaagtccggtccatgtccacatccatagggttctttcttgccttatccatttcacctcttagagcagaggactttcaccatttctattgaacatgagtataatatgtagtccttacctaagaggattctgtggatcttctctggggttctcaggggccatggaacatgtcagagcaaatgttggaatggattacccagaatgtgagtagttgtagtggggcactgttggactcaatcccaaccccctaacgcgtgtttccatgaaaaattcatatcttacttagttttttcctaactttcttgtttcccagtggtagggtaatctagacatagggaaatgatgtgttcatcaacatgtttgaagctacctgggggaaacctagactttatagatttctaatcatttgtctgtctattcaggattataatacaatgccttaactgtaaggcacaaaggcacagagcttcctggcaaatgtcatgtagacaggctctgaggctgtgttgggttcttccaaagtaaccttcatgctaccctgtttctgaaacaattacagctttttttttttttttaaaactaaaattttcaaggaaacgtacacacttcaaaactactgagttgaaatcttataggccagtttcatggctctggaaattttagaggagattgaagaaaaaacataaaactttaaaaaatgatgccaattcaggtctacctttactgcctaaagttttcgcccacattgattatatcctatattcaaaatgccagataggtacactatctaaaaatacagtattctgtggaatgctgagattggtgggtcttaacctgtttgcctttggtataagtgctttctgagacttgcagctgagctgacgactagagttgagtcagtgggtaagggctggtttcacaggaggtgaatagttaagtgtatggagccctggtactgtgtgtaggtctagaggaaggcagggagcttatcttcacccaggatatccaagggactgataaacatcaccttgtagtgcaagcactatagacttgacatatcactatgaaatttgtgactttttaacttggatgtggctgcttgtattgtagttcttttgcacagcactgtagagacaggaaggagggtgagtctgctctgaacacttgagcaccagcagaaggttgggtgatggtcaaagttttagtcaagtaaaactgcaagacagaacttgatgtcacaaattcaatgaaggaattagggcggacatgcatattcttggtttgttccaatttccaatgggtcattaatgccgaattctgatggcaataggagtagatgaaatgaaaaagggctgggtgcagtggctcacgcctgtaatcccagcactttgggaggctgaggcgggcggatcacgaggtcaggagatcgagaccatcctggctaacacagggaaaccccgtctctactaaaaatacaaaaaattagccgggtgtggtggcgggcgcctgtagtcccagctactcgggaggctgaggcaggagaatggcgtgaacccaggagtcagagcttgcagtgagccgagatcccgccactgcactccagcctgggcaacagagcaagattccgtctcaagaaaaaaaaagaaaaaggagtagatgaaaaggaagcatgccctaaagatcatcaagtaaacctgtcttgaatacgtgtagcagtttttcactgttttggatttaaaaatgttttaagttttatttttaatcgacaagtcattgtattgcatttgtggaatacagtgtgatgctttgcaggtacataatgtgaaattattagatcaagctaattaacatctttcatttttttcagtggtaatacatttgaaatttgctgtttcaatatatattattgactgtagtcaccctgttgtgcagtagatctcaaaatttattccttgagtttagctgcagccttctacccattctctttcccaccttccccagcaccccaccctcatcctctgataaccatcattctgttctctacttctaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtatctatactacattgtcttcatccactgatggataattctcaattgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccagggtaagtgttttctacagatgaagccaacatcttttatggttttttccaagttatttcccagtttactaacccattgtcatcaggcagttggggtggccttgtggtattaatcgtctgtagtacttagttgatgggagccactcattgtttatttgtagtcttgtttataatgtcacccatgactaatttttagcaactttttttttttttttttaatagagatggggtttcaccattttggccaggctggacttgaacccctgacctcaggtgatccacctgccttggcctcccaaagtgctgggattacaggtgtgagctaaagctcccagccctaatttctagcaacttttattcaatctttccaaggcccttgccttcatggaacaacgcactgatagtgtcttaagaagttacagtaagcaggatcacatttaggagcaagcaggtgagggcagaggtgctggagtgaacgtcggctctttggctggtagccttacccactgagggagaggagctgaaacatgaaatggggatgcgtggtacgttgcagttcacctgggatttgatgaagagaagggccagcttgctctggctgactttaaacctcccgtgaaaagccgtgttggtgtacttgagtcattccaggtatatggcaagttttaataattcactggtctgccttgccttttttccccacagaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 38215 - DNA, 18635 bp, Homo sapiens
ggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaatgtgagtatccccgggccagccgggccacacccaggcttccccgtcgccctggggcttttccccggggtcctctaggtccatttcgccgcctggagctcctccgtgcggctaggcccgcatctccctctgctcgccgtgtctgtgccttcgccagctcatccctctgctcatctcgcggcctgtccaggcttcttttgtccgtgttccttggctcgcctcgtcctcggcgttcgtgcggaggcggactcggaggtgttgctcccgtactgggatctgcttgtacgcctctccgcggcccctccttgcattcccagttccctcctgtaccttggggccctgaaacttgcgcattatgagagctggacgcgacctcagagagggcgccagtcccttgggagggaggaaggcgatccagcccaagtggagctgtccagcaatggacagacagggctgtccaggcgggcagagagctctccgccctagggagtctctgtaaaccgagtctgtgatgctccaaaaagcttaggctgggctgggagcgaaggagttgggggagagggagcatttctctactgtcggggcccctcctccccctagcaaggatttggttggaggaggcctggctgagggctgttccctcaaggcctcttctccctgcaactagcctttctcgggaaactatttaagcccaacattcattcaacaagcagcgcctcctaccagggcgctgggtgtgggagaagctggtgactcacctctcccctcctctgtgaaagtgcttctagggcccgcttaggagcccagccagccccagacacaccctccctcctgctttggtagagtgtcctagcagctctccccttgcctgtcacaccctatttccagacaccgcctctgtccccaagcgtcctctctgcctcccacaccccttgagaggccagggtgtgcatcacccacagccctagtacactttgtctcgggttagtatcatccacactcccaggacatttcgggcccacaggagggttagaagccttgaatgttgtacctagaaaagcctcagaggtattcggagagactcaggctcggccaggcgagagggcagtcaggagaccagcctgtctgtagtatgtggactctttgtctgctcccatcactaccaccaccatattttacagatggggaacttccctagcaggggaaggcacttgcccaagctctcgtggccggcttggcatgctgtgacacggaaatatgctgaaaagggcaggctttggagttagggagacctgggggcaatccagattcttccacccagtagctgtgtggctttcatctctccaggtttatgtagcctcatggatcagttactgtgatatttaagggagactgcttagcacagtgcctgatgtgtggtaggtacttaatacttgaaaacaagcctgtccttgcagggtagcacaaatggtcccagtggatagagatcatcttgggtacattgagacctgacccctcaccaaggaatatacatgcatttgagtattctctgctgccaagcattttttgattcatccagtagctgagtacacatttacagcagccactaggctgggtgaggaagaagatagcgggatggagcagggaggcaacaaaattctcaatcagtacagcagcagcagtacctgtggtgaaggtactattcccctctccactttataagtgagtaaacagaatcagagaggtagagcaatttacccaggcttacacagcaagcgattggtgaacctaggcatcaaatccagttctgtccatttccagggcctatgtgtcagcctctgttcccaccactcattgctcatttcttctaagtcctgagtgctaggactgggaggggatgtgtcactggggatgtccgtctgtgtgtgcgtgtgtgtgtgtgtttatataatgtgtgtatacatgtaatacatactatatgtatatataaatatgtgtggatatatagatcctttatgatcctccatgtttactgggaattttggttcagaatgtgggctgggtttgtcatgtcactgcccacctcacccctcccctagcctgaggggcaccctcctgtacctctcttccttccctccaaggccgtctttgagccccttatcttgatgctggctgaggggaggcccaagaggaagacacgccttattttcctattgctgcctgcagctggctcccaacattcagctcacattgtagcccaagagatggggagcacagactggaatgagtaatgggagagtagcctccagtctgcccggatttgaatcctaactcttcctcttagaagctgtgtgatctgggaagatgacgtaaccctgagcccgattttcttatcggtgaaatggggtcgttatgacatcccgctctttgggcttgcctgtgggctggcctgtgatagacccggtgtgtttgccattgtcatcattgtgatggtcacctgcccctatgtggtgattcactcacctaatgtttccaaatggcatggaaagtcaagacgacttctggattcatggacatctggtcactggaggccttggctggtggtactcaaagacaatcagaatgcgacatcagctttgttcaagcagagattctgagtcaaatcactcctctggcccccaataccaggatggggcctgtcttagctgggccccactttacatctttgtgacttttgtcagctcacccccagcctggtgccagcccagtatcagttgtagggaaatctggtaacatttctactagctaacacgtgtccagtgcttaccacgccctaggccctgagctacccaataactgtgttctttggttctcaccacaaccctatgcacagaggaaatggaaggcacaaagtggtgaagttgcttgcccaagaccccgtagctggtatgtggcagagcataaatgcaaacccagttcttctggctccagaatcctgccctagacgatgacacttttgatcagcagtggatgcaccccaaatcatgcctctgttattgaccaaagcctgatccactcacccttgagtttgaggcccactgtgaacctgcccagaaatgcctacctccaagccctttcttcctccactgctcccacccagccaaagcagacaggcagctgctcccccagaaccacttcctacttcctcatcactgctgatacggttctccctttagggatgctcttcccctaagatctgcctctaagattccactcaagggagcctccttgataccccaggtggaaggggtcactccttgagcaccaagtccacccccatcacaggaccctctgtgtgaccttctagtattgtttatggttgtgacctcactgccctaagactgtctacttctgaccccacaagggctagcactgccctcagaaagctcagccactgtttgctgaatttaattaaaaatacatctctaataacctctttgtaaaatagcttggcagtttcataaaaagttaaacgtacatcttcttcacgagccagcagttgtactcctaggtatattcctacgggaaatgaaagcacatgtctgcataaaggttcatgtatgaatattcacagcagcattattcataacagccaaaacctggaagctgtcaagatacccatccactgacgaatgattcagcacactgtggtatagtcataaatggaatactactcagccatgaaaaggaacaaattcctgataaacaccacaacatgaatgaattgcaaaagcagtgctctgagtccaagaagctgggcagaaaggagttggtgccctgattccatttttctcaagttgtagaagaaacaaactaatctacggtaggagaaattcaaattcagattctccccatccccaccagttacctctggttggtggagagggggagaattggcaggaaaggggcacaaagaaactttttggggtgatggaaatattttgtaccttgctttagatgttggtcagatggaatatacgtttgtggaaacctgccaaactgtacattgaatatctgtgtgtttttaccacatacagttaaaactaaaaaaaaaaaaaaaaaaaaaaaaaaattgagtataaataaatagcaaatttaatttatttttaaaaactagttttcattctgttactgtttctttttcttcagtattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgaggtaaaatgtctggggtcttcctgtgcagagtgagagtccccaccatgtcagagagcaaaggcgatgaacccggaggctggatttggtaatcaagggcctagattttaaaaagagaaaggaggatactgagttaatcacagttctttccattgtgatccatcccacagctgatgtgagcaggaaggggagtagatcagttcacacacctgaatatccaggggttagcacctgcctcaggcgtagttggatccaggtgttcatgctgggtcaccaggaatctccatttcttcatcttttgcctgtttttctctattatggtgtttttcttgggcaggcacttcatctgtgatggcaaatgtggccccagcaactggcctacatccaaccacttagcccagggaagagaaaaaccatctgtttctcttcctttctttcttttcctttctttcccctccctccctccctcccttcctttgttcctttcttccttccttcctttgtctctctctttctctctttcttgtttgtttgtttctttctttctctccctctctctttctttttctccttttttttaatagggcctcatgatgcaacagtatatttctaaatcaatttagcagcagttacagggccatctctcagtgtcctggcttggctctccgtcctctgaatcagtctccgtgtccagggcgcactcacatgttctgactggcaaggtctgggtcccataatctgaccagggttcagatagactcaggtaaaccacatgggctgagtaggagagaggagagccaggcatggaggctcaagcctgtaaccccagcactttgggaggccaaggaggcaggatcgcttgaggtcagaagttcgaaagcagcctgggcaacatagcaagaccccatttctacaaaaaacttaaacataaaaataaaattaaaaaaaagaaggcagagaaaaatggggagaaagggacaggcaggcagaaacatcagctgttcccaccactggggcagtgctaagattggtgggggctagtgggaaccaatggggcagtaggaagaagtctccctgggaaagcaggaatctgggttccagtccttactctccacttgctagacctcagttttccaactgtacggtggggagatgggtctcagcgctcccggaggccccatcctaccctaatactttgcaacaagcacagtcatgctgagccacccctgagctgttgaaatccccactcccctttgctcccagggccgcgcattgaagacggcaacctcattggctgaggggctctcgcttgtggtgtctcccgacagcatccacagtgtggctccggagaatgaaggaaggctggtgcacatcattggcgccttacggacatccaaggtaggtttggcaggggatgctgacctgccagtggctcggggctcatcctggatgttgtctggctgaggatttgaaagcatgggccttggagatggtcacacatgggagtgattcccgactttaccactcagcagctgtgtggacttgtctatcctgagtctcagtgtcttcgtgtataaaatggggacggtaatggttacaagcttgtggccagccttgaggatttggtgagattaggtaactaacgccttggtacagtggctggcactcagggaggtgctctcatgactctgatgaccatgtgtgtccagtgcaaggccacaaaactaccctgggcaccagagctttcctgttatttgaacaccctgtacgctgttggcaccatgccattgggccatgcagcccaggcctgtactgtgagggtcacagtcacaggcactgtgtgtaaagaacctgggacagggagtgtcctcgattctcccctgcaaagcagtgtagggctctccacccttgtccccttctctatttcttcctcttccagtccagcttcccctgagccaggctttctgggctgacgtgaatgttatcctttatttttttggtttctttgattctgtttgaagcttttgtctgatccaaactatggggtccatcttccggctgtgaaactgcggaggcacgtggagatgtaccaatgggtagaaactgaggagtccaggtgagctgttggggtgaaaactctgttggggtaaaggaggagtgaagtgtaggtgtcaggataacatgcagatgtctttcattttgatacctttgaaactcaagtataacatcttcctatcagaaaagtgtgaaatgatccccaaattaatagccagtgatttggaagtggcaaaaatccagtgaagagtggctccaggaggaaagggggattgagttgctcccacatctgggaagttccagagatgcacaagcttgaagcatgacttggagcaggcctgaaacactgtcattaggatcagcatgtcaaccccgagaccccactgcatctctctgtgttcagccttcccatcagctgtgttggtcccatctttgctctacttacagcttatcgtttctgacaggagtcccagggcaggttctcattgatcagggctggggtcacctggagctgggggtgggttcagccccacctgaatcatatggactgtgaccgacaggtggggaggtggtgggaggagcaggagaagggcagcttcaagaggccccccgcagggctgtcctggagcagaggatgcagccagatctctgagcccaaagggcagggctgggccccttggtgtaaggccagtgcgggcagatttcagctcaggatgggagagcgctttcctccaggtagcgccttggagggcaggagctggctgtctgtcaggagtgagtgccctgtcttggggctggtgtagagaaggcatctgccgtatctggggagtctgatctggtagccctgaggttgcttcctgctcagatgcttagagattagactgcctggggcgacgaggctaacccccgtggctgctttgctttccctgcagggagtacaccgaggatgggcaggtgaagaaggagacgaggtattcctacagtgagtgctgggccccttacgtggtctctgcccatggtgggggcccacagtggtggctggacagcagggctgttggtggggccatgggaaggattcagcaccaggcatcaggatccctgggtgcaagtcttcagagccctgctttcccacccatccattgaggctccctgacccacccctttggctgtgagataggaggagctgggctggtgggtctcagccgcgtgccactcctacccgggctctgagttgattcctctccctgagcagacactgaatggaggtcagaaatcatcaacagcaaaaacttcgaccgagagattggccacaaaaaccccaggtgagagccaggcccaaggcctgagtgcagctttgtctacactggcaggtctccagcctcagtttcttcatctgaataacaggattgagttaatcctgcctcgtgggttgaaaatgtgggacatgggtttgagaccaagccctgtgctgggcaccaggaacacagagacttgtctcccctgaccccagacaagctccccgcaaacaagtcacaaatataaggcctgcactaagcgtctaaggggatttgcacacacggggccggggaagcattttgttaatggtttgccatgggtgggaggacaatcaggacaggctttccagaggcagcggcatttgttcaggcttctcaggatttcagcagagggaggttagctccacggcatgccagtggtgaggcgggcataacacttgggtgtggctagagagcaggccttgttcagcaatggtctgggctgtgccagtaagatggttgggatggaatgctctgggaggggctagtgaggggtgtaaagtccatgcaagatacatctgacagcagtgggtggggcaggacaggctggcaggggtctaggcaagagggtaggaagctccggggaacaggagacagagtgagggtgctcagcccaggggagggggcacagggcccctgggggtggacaggacaagatgtctgctgcgcctgggctaatctggacttgcaggaacccccgggtggggaccctgcccagcacaaacaacccaaagggacccgggcagctcccacaccggtgcccatctctgacagcttcctctctcccacagtgccatggcagtggagtcattcatggcaacagccccctttgtccaaattggcaggtttttcctctcgtcaggtaagtctcaggcctctccagaggagctcgtgccagaagcacaaggcccccctagggccggagctcccagtactcagccttcagagggctaaaggcacaggatcagtctgcacctttcccagcaccatgctttgggggccaggggaaggcgaatccccaggaagcaagggctgacgtagaaacccccaccccactccatcctaccaggttcctctgaaatctgggttgttccagagaatgactcaggcatgcatcctcaccctgctgcgtgccggtgtctgctgagtagactctgctgagacagtccttcctcaagcagactccggctagtagtagacatgtggtggctcagtgctctcagcctagggctccccctctctgagttccacctgtcccaggaaggcactagcttatcacaggcatcccccattgactccaaagagaagcttgcaagggataaggtggcaccatgggccagagtaaccctggggctctgttcctgggcctgacccatgaaggtgggagaggataccaagggcccagatagtcctggggaggctggatgatcctgggcctggcctggccgctttctgtgtgctttgttgctggatggtgcctgtgtgccagctgggcctgccctcaagtagctctcaacccaggaggtgagtcaggcttggacgtggatggccgtaaccttgatggaagggaaaagggctaaggccactcccagtgctgtggtcactctgacttggtgggagagggcacagggaaagcttcctggaggagatggtctaacccaggggaagccgtggacgagacagagtcagaaagaggcactgcaggtgggagtgccacgtgtgcaggctccaggggtgcagtggaagggggtcaggccagggactttgcagattgaggttttcacctggtcccctgggtttctaaccactctggtcccctcaggcctcatcgacaaagtcgacaacttcaagtccctgagcctatccaagctggaggaccctcatgtggacatcattcgccgtggagactttttctaccacagcgaaaatcccaagtatccagaggtgtgcggagaggcctgggctctccaaataggagggtcagggcgctaggatcaggttcctgcgccaggcagattcagttcagtcgcatgcacagctgcacttggccaagtgcagctgagtgggagaggccctctgggtgacggcacagcctgggcacgggtgtggaggtgggagaagagcctgaggggcgtagccgaggcatcctggacctgggcctgggccagctactccgttcctcactctccctgcttctcttccacccccaggtgggagacttgcgtgtctccttttcctatgctggactgagcggcgatgaccctgacctgggcccagctcacgtggtaacctggcttcccaggggcagacactaagtcagagcctcacgactttcctggacacagacaccttggtcaatgtcaggagcgcttggacccccttttccctggggaaaggcacactctcgcacacactctcagccaggcacgcttctgagcagtttcagagctcccatgtccccacagccatccatggaccccacgttaagaagggcagctcaaaaggggtctcatagtcgcaccttatgacaggtgttccagtcacacacagaccctctccccaagcccgttttgatctgtcaataattggtcttgcgttcctggcctatgtgcagtcctgccccatcccctgctctgcgcactgcccaagagctttgaatgcctggagctttgaatggagcagctcagccagagctgcagaggtggatgcatcccagatggatgtatagagagagaagccccagggtttctgtgctcacttccccagccggcacccagtcccgggagggtgggccatggctctcgtgggcgtgtctcccgctggtcacccctcagctctaacaccaggtcctctgaccaggtcactgtgattgcccggcagcggggtgaccagctagtcccattctccaccaagtctggggataccttactgctcctgcaccacggggacttctcagcagaggtgagtgctgtgccctactcgtacggtggaggaacaagcatgtccttccttccttccagtggttatttaataagatcacactaccaggggtcatagccagtgaatgaggcaagaagaagaaatagcggaatgttgagtatgcctcatcaaagtgtttgaccaggagtgtttcagattccagatttttttggatttgcaggtatttgtatatacataatgagatctcttggggatgagaaccaagtctaaacacagaatctatttatgtttcatgtatactttgtacacatcgcctgaaggtgattttatacaatgcaacccgtcacatggggtcaagtgtgggatttccactagtggcgtcatgttggcattcagaaagttttggattttggagcacttcagcatttgggtttttggattgtggatgctgagtctgtcatgaaccctcagtgtgcaggactgtgctaggcactaaactcactgtgcctcacagactgtccggtagaggagtgagagtgacagaaactcgtaagtactgatgcatcgtgccgagtgttggaaagaggagaacaggtgctctgataccagtggacgtcagagtagaacatccgtttctgcagtgatcaagcagggcctctgacaagtgagttttgctgacgagaaggggttaaccctagaagaatcagtgatcagtcagttccagcaagaacagcccagtctgggcacgaaagggttcaccttctaagggggcacccggagtgctgtggccacagcccagagcggggagagggagtgggtgggggggctccaccaaagtctgtgtccttccagaacattaggagggcggggaagggttttgggcctcagctacctgagtatccctctcccattgtaaatagggagggctatgcctaccccgggtcccaaggagaaggggtgccaagatgtgctgattagttcagttctgtgccttaaaagttagcctgtcttctctaggcaggcaatccttctctgcagcagaagaattgagtctttagtttttctgttgttgatgaacacaggtatccctggtggggcactctatacctgccctaaccaggactgctggggttttcattccagagtggccagaaagggtcaaggcagcagacaggcatcaggggttagctgtgaccttttgttcctattattagatcctcagcagccatctgtcccattagcctccagcttgtggtggtgcttgggcctcaccaactcctggtacctggccagggctagggtgtggtcaggctgttgcccaggagcccagttaccaacctcagggtagggctgccacctcccagcctagaaggccatgagtcacccttccaccagcagctgagggtccccagcgagtttctaaaattaggaggcccagtccaggccttgctctctctcccagggctgaggcccagctcacgcagccgcccctccagagaggagtggatggggcccatggcttaggtaatgccccagaaaggaaggccctgcagtgcagatgctcaggcggcctccttaccccctgggtctcctgctgcttagcagccccaaagccctgtcttcccccagcccagcccccacccccacacaaggtctggggtctctgccaagtagaaaaaaggcccagagccaggcaggcagctcagggcaaaagtcaggatgccccgattccagtcccaggggcaggagagtacagctgcccaagcaggcacactgcagacggccctggcactgcctcccacctgctacaggaccttgagctggtgctgatctctcagcctgtttcctcatttgtgaaggggaagatgtttaagtactattagtaatagtcacatcatccctaactggtttggtcattgaggattattcattcattcagcaagttttcattgaacaccaggtacttcacagacatgctccctgctcttggaaatgtagcgtttagttaactgcttgaggtgagaccttgggcacatgacttattctctcagagcctcagtttcatcatctgtaaagtggaggtaagtattcctacctcactgagtgaatttgagaattaaataatacttgtaaaacacttaggacagtatcaaataaatggtgagtgataaatgtgacctgtttttgttgttacggactctgagagagggcccgattcagatcagagggtcagggaaagccctctgaagaaatggggttcaagcaaagctcaaaagaatatgtaggaagctggccaggcatgactgcaggcaatcgttgtaggcagagcaaacccacgcgcagatacacaggcgagaggacacttgacctggactggggacagcagccagcagggtcagggcactggcagcagggtcggtgtccggggggtgtggcagggctctggcaggtgactgtgtggagaacacagagtgggtgatagaagcagggccagtgaggctcctgcgggcagacagtggtaagagactcgggaatatgtggcctggactggatggggtggtaggggaggagcgagccatgtctttcccatagatgtgagtgggtgggtgggtgtgccatgtgctgagatggagaaggcgccagtgtcagcactagacaggctgagatgtcaagtggaaatgtcaaggaggtggtggaggtggtgggagctgcagggctgtgaggcccgggagagggccagagctgcagctttaaattggagggtcacggcatgtggaggccaaggaagcagatgggatgtccggggagagagtatggactgaagcagctaaagaattgcagcatctaatggacaggaagaggggcagcgacagcgatggagcctgagaaggagggtgcagtgtccccaagccatgtggagaggttctgagattaaacagatcacacacatagcgcagagcatgctgcccagcagacatcctccaacctgctcaggggtggtgggcagggtcctgctcattccaggtgagaccgtgggctgagggctccaggtgctggcaggctctgagctgaggaaggcccgtacgttccacagagatctcatgccttgccctgtgctctgccagatgggcagaaggacttagccctataggaggcttgcccccactccgtctggcctgttcagaaatggccaacagctcccgagttggtacagccccctcaggacctgccctgccgactgggtacgccactggccctcagcatcctgacctgcccccaccttgtcctgcaggaggtgtttcatagagaactaaggagcaactccatgaagacctggggcctgcgggcagctggctggatggccatgttcatgggcctcaaccttatgacacggatcctctacaccttgggtaggtgttggggtgggtcactgccctccctcctgcaccctgaaagggcctcctctgcctgtcgcatcatctcagcccttccagcctgatgggatggcccttgtgcagataccaggcatttggctcatctctgtgtccccgctccatagccttgggatgagggagcagaggaaggcaggcttgagggcaggagctgccaggggccaggctgggtggggccaactctggggcactggtctcactccacagcctgaaggttcgtccatctgctggctcgatcatttgctcattcctttgatccacaattgaataccacatgggagcctgccagacctgcatttgaaatctgtcacgtccaagctctggatgcttggccgttcccttcccatctcagcttcagtcacctcaccccttacatgcagagttttatgaaatgtggcaaataggaaacacccaaaactctcatgcttccttcctcactccaaaacctgggctagatttgggcagccagcaagtctggagcatgaaggagagttctgggccactccttgacctgaggttggcaccagtgagcccagtaggagacctgtggcccagcgtggttcgggatctgagtgcccagggtgactaagtgcgttctgggcccaggaggatggggttcctcggaggactctccatccaagcctttccctggtgtgtgtcccttccagtcacatgattgcatcagtcttctctgggtgccaacagaaacctcttccccactcagcatgcacaagtcagaagaggtctggctgcacatcttgggctgtctgagctggggggaccacctcctttgtttacagttgggaaaacaggcccgggaagggaaggactctccctgagcctttctttggacagctgaattgtgctcagaaagaccagtgacgtggtgggcacattagcgagagatgagcatttaaacggaatcctctttcttgcctgtgtgaccctggggagaccagttcccttctggagccttggtttcctcgtgtctgtctcagtgggcccttctttggatctctgatgtctgtgatcccaattcactctacgtctggaatgcgccagactcaggacagacttagagtgtggagggacccccagggtgggtggggagagttgggagcgcagcagggaagcacacagttccccatgcgtttgataaataccaacgtgtgtaagactccacagctagagacagacaagacttagagcaacagctcagagcccaggctctgggcccatacggtcttgagttcaaatcctggttctggcactttctaacaggaggactggtggtgagtttcttaattccctgagtctcagtgaccctgtgggtaaaatggagttaagaagagtacctaccttacagggtgggcatgagtgcttcatgagatggtgcacatggtgcctaacacaggcaacgttcagaaacatgaactttgcttattataagggctgagtagcagtgctgtatgggaacagatcaggatgaggccaggtagtggcttgcagggtgtgctgcaggcatggtggggcaccagggcttgctctgcaaacccagtgattccagaccattggtggcctcctgggaactgagcgaagattccctgagtggacatcagctatggaatgccaacctggagaggtcacacaaggcaagaatagggtaattcctcatgaatttagctggattctgggctttatcctattggaccaatagtctgtgagattcttgaggagaggccaatgcttaggctaatttatttcctctagcacctgctggttcagtgctgggcacataaatcattagtaacagcctgctgcatgaatgaaccaacacctctaggaatggctgagaggcccaaataggcaccttcaggaggctccacccacagcctcttgtatgagtgtgcaggacccaggttatttctagcattacaggcaaatgtctttatactggcctcagactactctccacataaagtattaaagtttacaaagcactgctacatcctctcccctggatcagggtagagtgggtggcttaggcaatgtgcccaaccacgcagctcatagcagaggctcctgtgctcccttagctttcagaacgaagctccttgccttccacccactgatcctctcccctcctcatgcatgtagcaacatgggcccatcctcatctagggacaggagagatctgctgagctggtgaggtgtagagcaggtggcacctcatcacctttctcctttccacagtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattat

SEQ ID NO: 38216 - DNA, 122213 bp, Homo sapiens
ggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctgtatccttcgtggaggggaattcgggctgtgtgtggggggcggtgtggggatgcccagggcacccccggaaccactgcaagggccctggggcactccaggccactgtccgagactcccctcctcccccagtgcctacggcggctccttggcacctcccaggggccgagagccttttcagctcgccttttctccgcagcaccccgaaatacgcgttgctgctcgctcttcctgtatccccagagcctgtgactttcctccgcgacgtttggactcccgagacggccttttttctttttgcacgaccagtcgcctcactctctaccaccgagcccattttcagggtttctctctcctgtttgctcgctttggatttagggaatcaaggcagaaattcccgagagggaagcctttctccgtttcttgagatgcccccatttcctccaaccacaatgctgcttgaactggggtcactcaagcgacctcttttatccctaattcctttctatattaggaagagagtctcctgctcagggccccctcttctaagaaagagctctgtgtgttttcagtcagtccctcctgttaagctttctggtccccgggagaaccctactgttttcctttccactgacaaagcctgtcccacccatagttgtatgtgatgaagacccccgggccctccagcaagccaccctccatattgtgggtatgacagctggggaaagaggagctcctggacaaaataaatagtccctggactggccacttgggcaaaacttcctctgtgagggtcaggttcttgggggaatacttgccctgatgtcgccaagtgacaccctttattttctgccccctccccccaactttatgcactctggaggttgcagtgggaaagctataactgataagagcccttcaggcagtggttttggttggagtccagactgattatttcaggaccagctagagaaattcgcgaaggttcctgtgacaaatcgagaattttttttttttgaagggtagtttagagggtagggggagcccagagttctgaacagctagtccttggggaggggggcaagtgggggcttagagggtggtagtgtggaacacagtttaaaagtcctgtctcctgtttctctccctcctccccatccccccaccgtttccccctgttgcagggttttgtttatataactcaagttgtttggctaaattcttcaggtgaataccttttttcttccttttatttgttgctgtttttgattgagtgttttacctctttgtagagatcagtggttattgtcaaaaaattcagttagggaatttgctgaagttttaaaaaagtagtttttgcatatggtttggcagtgggggatgggagggaagttgtctgggcaagagatttttaaaaaataatcttttcagaaataaggtgtttttctccttgctcagggaaaacttggttagaaattaggagcagtagatagacttctaagtttgtggtttggagtttagaatttttgggggagtgggagattagagcggagcaactaataaagtatagtgtacccaatatatgttcaggcgcaagtgaaatcaactctttatgagctgtttgtggctgtgattgttttgtaaatgtgtgaatgataccagtaatgttggcttttcataaggctgcaggaaaacttgtaactatgactgtgtgtacattttacacaaagcagtttcgggttttatttttgtttagaaactaggaaatgacatagtggcagcatctgagttatttttatcttgaattgagagttactgtcacacctaatgcgaatttctacctaatgtttaattgggatggagtggggagacaattccagctgtttgtgatcgttgtcagagtctcaaattatgtacatagacatatttttaaaagattgaggataaagaggggggcctaacttgacctgatgccttttccatacagtgccttttgttcatttagtagttgtggcatctagaatgattaccgcatttaggagtcggggtgtggggggtggagagggagaggaaaacagacaaagaacagcagggtgtcttttttttctccccctaagtggcttatttcatagcttatttttagtagaagatgaagaaaggcaaagatgcattggccttctgttctttccccaccttccttcctttctgacaaaagaaagcagaggcgctttaaaattgtagatctgagataggaggataacagtttcgagatttaaaagccagaggttatctttgtttcgtgtttattttctggtataatggagtttggaagttaaaatgtttcggatttccttttgtgtgtgttgtgtaggtgagagattttgtgtcctcctttctctgttgaattcacagatcagtaggcccaaatggagccaacaatttttgagtaaggtatatttagcagaaaatttaaggaaaaattccccagccctctactaaaatgagtacaattgtgtgaaaaggctgggggttgagaaagatggtggagaggaagtaggaagaaaaggtctgaaggaatgcacttcttgccccccatgccccttgatgatttctttggtgtggggggcgatagctggtttccttgcagtctcctgtttcagcccatttttggatgtctcctgagcgtaattataccaccacgatttacagcctggcagggaacctatatagtaggaaagtagcagtgtgggggtagggagagaagaggatgtgtaactaattggccgctgccttccaccacctcgctcggttcttttggagacaccgtctctggttgttgtttggagtcagtgatatttcttttgtgacgggttggtaggagagctgactcccaagttatgcagggagtgagtgttttgcaccaatgcacttaataatctgctgggtgattatgttctgaaactctgactcattcattgtttctcttctgatcctttgctaagggttgtgcaaacctccccaggagcctagaaactgatttacatgacttttggatcctttaggaatgtgtcccagtaaaaaaaccttgcagttagcccagatcctatggaatagtctcgaatagtgcggccatttgtttgcaaagtcaggtagattggtgatctgtgctgcccagagcctggcaacctttgaggtttccacctccaaccagctgattatttagattgtctgagagctggggctctggtgaccttaaagcgtgatttgccctaaaggaatatcggtttaagttctccctggtggaggaacaaacagctcagattacacgggtttccttgttggtgggggttactcgtctcaccctgttgcacagccctggtgatcctttcatctgtgaaccagtggcccctgctgaaggctagagctgcttgttttggaaaagcgtatgcaggcaaaaggccgcaggcaccgctcctcagcgctcattggccgccctgttactacccggaaaaggaggaggggaggagctaccaaacagctgatggagtatgtgacaagagagtgtgtttatatacaaaagaggtgggggctggggaggccctctgagtggtgttacaggaacaagtgtgttttcgaggggtaaaaagagaagaggaaaacctgacctgttagagtacaagaaatgtttagaaaaattaaggttaaatcagaaaagtagatcggataataatggggaccggcatacaccatatgtacaattttgtaacttacaataccaagagttttcaatgattcttcttttcagagggagttcagtaataggatcccccccttatttatttttacattttttgtagagaccgaggtctgactaggttaccaggctggcctcccaactcctggcctcaaatcttcctcctgccttggcctcccagagtgctggaattacaggtgtgagcccagtgcacctggcccagggcatgccactttaaatgcacttaactgactcatttgcagggattccaaagtatggcagaaatgtcagcttcccttaagaaagcgtcaagtgtgatagaaagggacggtgtcttacattaaaacggcctgagttaattttacagaatcgttggtgtctgctttagggtttcagaagctttctctaacaaattcaaaacctcagatgtggccaagtgtggtggctcacacctgtaatcccagcattttgggaggctgaggcgggaggatcacctaagtgtaggagtttgagggtccagtgagctaagatcatgccactgcactcatgcctgggcaacagagcaagactctcttaattaaaaaaaaaaaaaagctggcacagtggcttatgcctgtaatcccagcactttgggaggccaaggcgggcagatcacctgaggtcaggagttcgggacaagcctggccaacatggcaaaaccccgtatgtacttgtactaaaaatataaaaaattagccaggcgtgatggtgcgggcttgtagtcccagctacttgggaggctgagtcacgagaatagcttgaacccatgaggcggaggttgtggtgagcctaaattacaccattgcactccagcctggacgacagagcaagactcttatctcaaaaaaaaaaaatcctcatatgtttgggtacttgctttgtgccagcattgtgctgggagtttagtagtgaaaaattcagtatgggtggtcatggtgcttatgcaattagttaaaacttttttagtcggaaaggacaggctgtgttaggtcattgctgtgtgtagtgcctttttgagtaacttgtatttacttagagtggacttttcaaggaatagaaaggttaaaatgaattttgtgtgctaggatgtatatggggatctgtacacctgtttaaaaaaatttcaaaactaaaatattaaaatatgtagccatttgtctttgacttaactttggtattttgctgttaatcagtagttactctatccctaagttagtagtctttgttactctttaatttgtgttcaaagggtagacagttccctaaatcttttaactagttctagtgtcaattgggaacctgtggtttgcctctttatttccagtggactctgttttagtgagatgatgagatgaaagttggcacagctttatggtcttcaagctaaaagttaaagatttggcaactctcagtgttctgaatttgtcttccctgcctagattttggtgacaaatataacatactggtacttattttggttaggcaggaacctacatgagtaagcattcacagcttcagaacatctgattcctgcagtgcagttctagtaaattacacgcaagcctaaaaattcagctttttgggaaaaaatgtttcgcagatgtgacccataaacgtccctcctgtatttgtgtatgtatgttagaacaacctaagtttgttggttttctagtgttgcaattttcttagccccttgacctgcattttatagatatatttaaacattggtattcttttcagtcttaacagatttgatggttccaagaatcattggatttttaggcatgtaatccagaccttacattacgttataatgtttgcaacgtaatagctttttacctgtagacctacagagtgtacctgttagtaaaatacttaaaagaacttagttggatttcaaaagtaaaaagataattgagaaaaacataggttacaagaaggaaaaccagtcacctgtaatcctagttctttaaacagtagttctcaaactttagtttgagattgcaccactgcactccagcccgggggacagagcaagattccatctcaaaaaacaaaaaacaaataatcacctggagagtttgttaaaacaggttactgcataccactcctggagttttctaattcattgggtctagggtggggtctaagaagttcgcagatgatgcttctggtccaggaccactgtttaagaactgttggccttaaatgttaaccttatggcttttttcctatatcttttattctccccaggatgtattgttttcaacctgttgatcatactgtatgtgtctgccctgtttttgcttaatatttttgcaactgtttttcccagttaaaaataatgactaggggccgggcgcggtggctcacgcctgtaatcccaacactttgggaggttgaggcagacaaatcatgaggtcaggagattgagaccatcctggctaacatggtaaaaacccatctctactaaaaatacaaaaaaaaaaaaattagccgggcgtggtggcgggcgcctgtagtcccagctactcaggaggctgaggcaggagaatggtgtgaacccgggaggcggagcttgcagtgagcagagatagcgccactgtgctccagcctgggccacagagtgagacttcgtctcaaaaaaaaaaaaataataatgactaggctgggcacagtggctcatgcctatacatccagcactttgggaggctgaggtgggcagatcacctgaggtcaggagtttgagacctgcttgactaacgtgaagaaaccccatctctactaaaaaatacaaaattagctgggcgtggtggcgcatgcctgtaatcccagctacttgggaggttgaggcaggagaatcaattcgcttgaacctgggaggtggaggttgcggtgagctgagattgcgccattgcactccagcctaggcaacaagagcgaaactcagtctcaaaaaaaaaaaaagtagctcatgtaatatgccatcccatggctgtgccattgatttaattctttgccatttttctctgatgaataagattgaaattaacatctttgtgcataggcttttctttgggttatttctgttttcccgaaatgggattctagatcaaagaaggtaaacatttgaattaaaatatttaattaaaaatctcagagccctacactcagcgggctcttgttttgttgtgttgtgttttagttggtatcgttttggcactgaaatagcctggcatagtgattaaagatgaattctaatttcctcattgtttaaactttgatgttttttgtgataatggtgatcctcaatttaggcataattttgtattctcagagtgcatactgcaagtcggtaggttaaatatatttatgagcagatagatctaacaggaactgtagaattagttttggcatcttggattcttttttgttattgaggtataattgacatacagttaactgtacatatttaaagtgatacttttgataagttttaattttatgtatcacccatgaagcttatccttatcaagagaggagacatatttatcttcccccaaagtttcttgtggccctttgtaatctttccctccctcccttccaaccattgatctcatttctgtcactgtagattattttacattttctagaattgtatatataagcggaatcattcagtacatactctttttgtgtgggttctttcacttataattctgagattcacccatgttatttagttcattttttttttattgctgagtagtattctattatgtggatataccacaatttgtttatgcattcacctcttaatgcttggtggcatttgggttatttccagttttgggctattaccagtaaagttgctatgaacattgtatggatatacgcttttttttctcttggctaagctagatcatgtggtagggtttgcgcatgcgcgtgcgtgcgtgcgtgtgtgtgtgtgtgtgtgtgtgtgtgtgtgtgtgttttgagcgcatgcgcacgtgtgtgttttgagacaggatttcactctgttgcccagatgagagttcatggtgtgatctcagctcactgcagtcgtggccacttgcctggctaattttattttttttgtagagatgaggtctcactgttggccaggctggtctcaaattcctgggcttaagtgatcctctggccttggcctcccaaagtgctgggattacagatgtaagccgctgtgcccagccatgtttaacacgtagtttgaatttaatgtttactgatgatggtccatatttcacacccaaataaaattgtgacaacggttgtttcacttgtgtgttttgttttgttttgttttgttttgagacggagtcttcgctctgtcgcccaggctgagtgtagtggcgcgatctcggctcactgccagctccgcctcctgggttcacgccattctcctgcctcggcctcctgagtagctggaactacaggcacccgccaccaagcctggctaattttttgtatttttagtagcgacagggtttcaccatgttagcgaggatggtcttgatctcctgacctcatgatctgcccaccgtggcctcccaaagtgctgggattacaggcatgagccacagcgcctggcctcacttgtgtattttaaaggaatcatgttaaattacatgctcttaaagcactgatttattttttattattaaccttattttatagtatatgaattttgttaatttttttatcaataaaacaaattttaccacaatgattgtgatacctttcacttgaataatgatttaaacactttatcttccttttttaaagacagaatcagtctcgctctgtcgcccagactggctctctgcaacctctgcctcctgagttcaagcgattctcctgcctcaccctcccgagtagctgggattacaggggcctgccaccacacccagctaatttttgtatttttagttagagacagggttttgccatgttggccaggttggtcttgaactcttgacctcaggtgatccgcctgcctctgcctctcaagtactgggattacaggtgtgagccacgatgcctggccaatctggttttttgtttgtttttgtgtttgtgtttttagacggagtctggctgtgttgcccaggctagagtgcagtggtgcgatttcaactcactgcaacctctgcctcccggcgcttggcctaaagcattgatttctagctgaatttggttaaagctgatttggtagctactcttctctccccacccccatttgaaattagtaaattaaatttttattgtgaaatatttttgttagcctgagctacatggcaaaagcctatttctaccaaaacagataaaaaattagccaggtatggtggcatgcacttgtaatcccagctactctgggggctgaggcagaaggatcacttaagcccaggaggcagaggttgtggtgagttaagatcatgccactgcagtccagcctgggtgacagggcaaggccctgtctaaaaaaaatgttttgtggccctttgaaattacactttaggaatctggccggccatagtggctcatgcctgtaatcctggcactttgggaggctgaggtgggcagatcacctgaggtcaagagttcaagaccaacctggccaacatggcgaaaccccatctctactaaaaatgcaaaaactagctgggtgtggtggtgcacacctgtaatcccagctactcaggaggctgaggcaggagaattgcttgaacctgggagtcggaggttgtggtgagccgagattatgccactgcactccaaccccggggaacagagcaagactccatctcaaaaaacaaaaaaaaaaacacattacactttaggatcatagtcacaaacagcaattttatttttatatttgctagtaaggctctatatctttgtgaataggtaagcacactttttgttgatggtattattttctttgtaaagtattgataagattttttttaacatttctttagcatttctagtgaagtttacagcagttgataaatatttctggagcactctgttgaagtctgaataatatcttcaattttcacatggaataaactcaggtgaaaggaactaacagcagctcagtgacagaatgggaaacagactataagagttaggatatcctttgatatcatgctttcctggaatttttgtgtgtgtgagagacggagtttcactcttgttgcccaggctggagtgcaatggcatgatctcggctcactgcgacctctgcctcccaggttcaagcgattctcctgcctcagcctcctgagtagctgggattacaggcatgtgccaccacgcctggctaattttttatttttagtagagaggtgatccccctgccttggcctcccagagtgctgggattacaggtgtgagccaccgcgcccagcctggaattttttgaagcttttttttttttttttttttttttgagaccgagtctcacactgtcacctaggctggagtgcagtggtgtgatcacagctcactgcagcctcgaacttccggattctgaactcaatcctcctgcttcagcctcccgagtagctgggactacaggcgtgtgccaccacacctggcttacttttgtatttttcgtagaaacagggttgcgccatgttggccaaactggtctccaactcctgggctcaagcggtctggctgccttggcctcccaaagtgttgggattacaggggtagccactgtgcctggccttaagttaatttttagtgaaatggtgcttaaaatttttttttggcatcttaagagttatttgataggttattggacactgccataataaaattagacattgatttgtaatagttgttgttacattctttctgataaattataaacaatttatcttatggacatttacatgtgtgttgctaaaaaaaaattaaagctggattcagtggctcatgcttgtaatctcaccactttgggaggagtgcttgagctcaggagattgagggtgcagcaagccatcattatgccactgcactccagcctggacaacagagtgagaccctgtctcaaaaaaaattaatattactgacagctggaacttttagtttggctaacaaaaaggtgacctggcttgtacctgttttagtttggagcaatgatagtatgtttggtgagtagactgttttggtattcagacacaggaatggtgccctgagcatataaattccagtgtcttggccagacgcagtggctcatgcctgtaatcctagcactttgggaggctgaggtgggcagattgcttgaactcgggagttcgagaccaaccagcctgggcaacatagtgaaaccctgtctctactaaaatacaaaaaattagccgggcattgcttgaactcaggagttcgagaccaaccagcctgggcaacatggtgaaaccctgtctctactaaaatacaaaaaattagccgggcgttgcttgaactcaggagttcgagaccaaccagcctgggcaacatggtgaaaccctgtctctactaaaatacaaaaaattagccgggcgtggtggcttgcgcctgtagtcccggctacttgggaggctgaggcaggagaattgcttgaacccgggaggtggaggttgcagtgagctgagatggtgccattgtactacagcctgggcaacagactgtgactccgtctccaaaaaaaaagattccagtttgttattttctatgctgaagtgtaattcgagtgcattgtagaaacttttgaaaacacagtagtctgttgagaggctgttgttgcattagtgattctcaattgggtatcacattggagaagaattaagcttttgggggcccaggtactatggttattgtaatttcttctctgtacctcaccagatgcttggggaaggtgtctggttgtttataggctggtgctcaagggggtatctgcccatgaccagtagaacccaaatcctcaagagcctggggaagccctacatggcagccatatgcttaagagggaaggaggatcctttttgcctctccctgctttgtaggtatctaggacgttatgtaggcagtgtgaatagttgctgctgatcttctgacctgtccctgcagagaagtcagagagaggagtaggtagcccttgtgaagggagaggcttggctggactttgccattctctggaagactttgccattctctagaagataggcatggttggcgggtctgtcagtggactcaaaaaaggcacctgttctgtagcacttggaggatccatatttaggatatcaattaattgagaatgtaatctttgtctttggttcaatctcctggtttctaacttttaaaccatttttagggaagcattatatgtgaaggtaggagatactccctacatacaaaatcatgttattaatgttgtgaattatgcatttcctttttagtattaggcaactttttttcatatatcaagttatcatgtacacttttcaaggttttttggattataaaatcttagttgaggtaatataaatagaaaactagatacagagtgcgtgtctggtttgtgttacctcagaagcaattgggctgtcacttagcctagcaaaaagtaaatttagttgttttgtccaaagggtgccagtataactttggtaatctggattttgcttttctttctttctttctttctttttttttttgagatggagtctcatgttgtcgcccagtctggagtgcagtggctccatctcggctcactgcaatctccgcctctcaggttcaagcgattctcctgcctcaggctcccgagtagctgggattacaggcacgcgccaccatgcccggctaattttttgtatctttagtagagatggggtttcaccatgttggccaggctggtctcaaactcctgacctcgtgatccacctgctttggcctcccaaagtgctgggattacaggcatgagccaccgtgcccagcctggattttgcttttcaatttgatgactatgttgcatagacagttgctgataagttgattaatttaaaaattcagaatttggttggacatttccattgtagcatttgtatgtagaaggttgattggttaaagtcatatcagtaagagatcaccaagagtaatatatagatggatataatgttttcatggtcttactgctggatgtttactacccttttgctattcttgaatctaaacctgtaaataaattagtgattctccttggcagcaaagcttggaactatataactcttttaattgtattccgaaagaaggaaactgggtaacaaatgctcactttcgctggttgcagtggctcattccttcagtcccagctactgggaaggctgaagcaggaggattgcttgagtccaaggctgtagtgtacaatgactgtgcctgtgaatagtcactgcattctcccacctgagcactatagtgagaccctgtctctaaaaattaaaaaaacagtcacttttatatggcatttggttctcacagctgtgaattgtacttgatcagatcattaattcaaactagaggccgggcgtggtggctcatgcctgtaatcgtagcactttgggacgccaaggcggatagatcacctgaggtcaggagttcgagaccagcctggccaacatggtgaagccccatctctactaaaaatacaaaagttagttgggtgtggtggcaggcgcctgtaatcaaagctgctcgggaggctgaggcaggagaattgcttgaacctaggaggtggaggttgcagggagccgagatcgcatcactgcactccagcctggtgacagactgagactctgtctcaaaaaaaaacaaaaaaaacaaaaaaacaaaaacatcaaactaagcctacaagtacataatcttgtgaggggaatcttggacagtttgggtcggctttgtttttttttttttgagacgaagttttgctcttggcgcccaggctggagtgcaatggcgtaatctcgactcaccacaacctccgcctcccgggttcaaacaattctcagcctatcgagtagctgggattacaggcatgtgccaccatgcccagctaattttgtatttttagtagagacgggtttctccatattggtcagggtggttttgaactcctgacctcaggtgatccacccgcctcggcctttcaaagtgctgggattgcaagcatgagccagccttttttttttttttttttttttttttttgaatgaggcagtctctctctctgttgcccacgctggagtgcagtggtgccatcatggctcactgaagccttgacctcctgggtgcaaagcaatcccgcctcatccccctgagtagctggaactacagtcacacgccaccatgcccagctaatttttgtatatttttgtagagacagggttttgccatgttgcccaggctgttcttgaactcctgagttcaagcaatcctcttgccttggccttccaaagtgctgggattacagttgtgaaccattgtgcctggccatggatttttattacaaattatattcaaatagatgaaaacaggagggaaaagaattttcagtatgtgtagtagttttgacaggagttttagccttttatcttggtggctgatattagatattaacgttgctcttaagtgtacttaagcacactaaaacattgaacacaatatgtgtttgataacacaattatcaagggaactgaggataaaagcactcatctttgcatcacaatatgacattattagcatctgttaactttacaaacctgattcatttagttcttcatagccaccatcttgataatgaataaagaaaaaacaaatgatgtattttgtcactctattcatttttatctataaagatttaaaatacctttcttttgagttaggttggttttatggttggaagaaggaaaggaggtagacctttgaatgccttgattgctgcccatttctctaggcagtgaagaaaggcagctaaagtgctgtctctgattatcaaatgccatatatgtgagtatacctgtgttgtttgtcatgctgttgtgaatactcacttgcttttttatccactcatcttttttatccacgagctcctgcattaaagtagttagtaaccagttctttctcttggagtaattaatgtgacttttcccttgtttgagatttagttaagagttttatatataacatataaaccatgatatatctgaaaaactgtatttgtggttcataaagactgtaatttcatttcattttcataaattgtatgttttttcttttttcttttttttgttttgagatggagtctcactctgttgcccaggccgaagtgcagttgtgtgatctcggctcactgcaagctctgcctcctgggttcacgccattctcctgcctcagccttccgagtagctggggctacaggtgcctgccaccatgcccggctaatttttttgtatttttgtagagacggggtttcactgtgttggccaggatggtctcgatctcctgacctcgtgatccatccgcctcagcctcccagagtgctgggactacaggcgcgagccaccaccacacctggcccataaattgtatgttttcaagtctgtgtgttttttttgttgttgttgtttgtttgtttgttattttgatatggagcctcacacttgttgcccaggctggagtatagtggcgtgatctcggctcactgcaacctctgtctccccagttcaagcgattttcctgcctcagcctcctgggtagctgggattacaggcgcctgccaccacacctggctaactttttttttttttttttttttttcctagtagagacggggtttcaccatgttggccaggctctaggctggtctcgaactcctgacctcaggtgatccacctgccttggcctcccaaagtgctaggattacaggcacaagccactgcacgtggcctgaactggattatcttaatggacatatgtatctttttatttgcttaatgagaattagaaattctattttttttttttttttgagatggagtctggctgtgtcacccaggctggagtgcagtggcgcaatctcagctcactgcaagctccgcctcctgggttcatgccattctcctgcctcagcctcccgagtagctgggactacaggcgcccgccactacgcccggctaattttttgtatttttagtagagacggagtttcaccatgttagccaggatggtctcgatctcctgacctcgtgatctgcccgcctcggcctcccaaagtactgggattacaggcgtgagccaccgtgcccggcttagaaattctattttttgtagaatcagaaatcagtttgtgacttgtgtgcttttaaattgggcatattactcacttgaatgaattggataaaacatgatggttttagtctgccagttctggcagttttatttcttaaatgtcattcttaaagtgttttgtcagttctgatgaagttctgatggcatcttattatttaaagttaaattttaataggtattagagtcatagattttagcatgtttttatacttcgagaaaacctggactgcaaatactagtattacaaagcaatggtggctttccgaatataagggctcttagtgtggaaattaataatcatattctctctaggcaataatagcatttgttgccttaaatagtagcttaagaagtaataatgcttgactgtacacttcattaatgcttgactgtaccgcttcagattaggagagtaaactctggtaactttgttattattgatagaaaaaaacagatgaaagttgagaggatactacttttcaactgtgattaacatcagttttactagtagtcatgtttgttgtgtgaaaaatagaattaaaacaacagcctagtaatgtctgttaatcctgcttatcaatataagattcgtaaagaaaaataaaaatgacttagtagattttaatatcagtgttctggtacctctctacaacaatagattagatggcattgcatcttttcttaaggtgtcagaattgtatttaccctgttaatttaaagaatagaataagtgctgtaaaagtgcctgatttatggaagcttttgtcaggatagaatggcagcatgctgttttcatttcaaagttttatgtatttaattacctgagttatattttcttttctgttttttttttttttttctttgagacagtctcgctctgtcgcccaggctggagtgcagtggtgtgatgtcagctcactatgaccctcgcctctcgggttcaagcgattctcctgcctcagcctcctgagtagctgggattcaggcatgcactaccacgcccagcaaatttttgtatttttagtagatacagggtttcaccatgttggtcttgaactcctgacctcgtgatctgcccacctcagcctcccataatggtgggattacagatgtgagccaccatgcccagccttaaatttatttttaaaagttatatatttatctatatatatttctgcttctatgtatacctctatatatacatatgtttatttttacctttcacctctattttgtggtgcatatatatatatacacacacacacacacatatacacacacatatatatacacacacatatatacacatatatatacacacacacacatatatatatatatacacatatatatacacacacacatatatatactttttgtagaaatggggtcttgtcctgtctgtttttgaactcctgacctcaagtgatctggctaccttggcctcccaaagtgctgggattacagggtgagccaccctgactgttttttaaaatttttattttatttttttatatatattttccacttcagaattttctaagcagttgaaattactcctttaaatgagaaaaccttgatgatttttggtgtatgtgtttttatttcagcttttttttttttttttttttttttaaagacggagtcttgctctgtcgcccaggctggagtgcagtggcatgatcttggctcattgcaacctctacctcccaggttcaagcgattctcctgcctcagtctcctgagtagctgggattacaggtgcccacgaccatgcccgactaatttttgtagttttagtagagacagggtttcaccatattggccaggctggtcttgaactcctgacctcaggtgatccacccgccttggcctcccaaagtgctgagattataggtgtgagccaccactcctggcctcagctcatgtttttgttgttcttttttgtttttaaagcaaggtcggtctgtgttgcctaggctggagtgcagtggtgctttctcggctcactgcaacctccacctcccaggctcaagcggtcctcctgcctcagcctcctgagtagctaggagtacagtcgtgtgctataatgcccggataatttttgtaattttagtagagatagggtttcaccatgttgcccagggtggtctcaaactcctgagctcaagtgatctgcccaccttggcctcgcaaagtgctgggattacaggcatgagtgactgtgcctggcttgtcattgctctataatgtacttttcattctaatacatttcacgtttatccttgcagcatttttgctttgagatgttatggcccactttttgtgggttaaaaatctggaccacacaggtcagttaaaggtgctgagatcagagtaagtccttatcacagtggatctggggctaactatggtttcctaagcttttgtcccttatagctttgcctgtgtagtagatgctcagcaaacacctgttaaacggattagaataaattatatactactgggttttcaccaagtccttaggtcatttttagactaaactttggcacctgcaattgaaacgatatggaaatcttgcaggaaagtgttgaatcttcctccaatgatggggaattcaattcttttctgtgtggatgtcatttgcctttttatgtagtgttcattttcccacatgtaacgtgtgtttgttttcttaaatggtcctaaatgctaataccttataggttattcaatgccgttttcagatggttgagattgtttgattcctggtgtttaagataaaaggaaattaaggttgtgcattggggaaagaaacagctgaaacttgctttacttcatttgtaaaatagaataccttaaactcatccaaattatggagctttttagtaccctgttttataagttgcaaagtgtttccagttcctccttacaaatttagaagttctaaaaggggttttccttaatatttgatactgtcaacttcttagtttgctcaggacttcattaaggacctttatgttgtgtttatttttacctttcacctgtattctgtgacaaaagaggacttaagaactacttcagcagctcacaccttccataaaagtatgtggccttttcttagttattcagaataataggaaagatacttaaaccagatatttaaaatctcattttacagatgcaaaacctgaagtttagtgttatatttaaatgtatatacacataagtatagcttttgtttttctttgtttgtggacatgtgcttggtgaaagaggaacagaattttactctttaggtttttggtaagtaacagaggttctggcacaggtgatgtctggagccccctagggatccccaagatactttcaaggggaatgtgaggtcagaacttttcatagtaatattgattcattatgtgccctttttgcccagccaacagttttctgatgtagatagacagttctgacaggacttttttttttttttttttttttttgagacggagtctcgctctgtcgcccaggctggagtgcaatggcgtgatcttagctcactgcaacctccgccttccgggttcaggcaattcttctgcctcagcctcccgagtagctgggactacaggtgcccaccaccacgcccggctaattttttgtatttttagtagagacggggtttcactgtgttagccagcgtggtctcgatctcctctgacaggatttttgatgtatgatgaaatggtgtcaacatttggaagatctgtgtaagtcagtgaaaactgttttccaaatggccagtgcatgacagaaaaattatgcctggttaaaagatccattaaaaatgcaaagtaggctgggcgtggtgcctcacgcctataatcccagcactttgggaggccgaggtgggtggatcatgaggtcaggagattgagaccatcctggctaacacagtgaaaccccatctctactaaaaatacaaaaaattagccgggcgtggtggcgggcgcctgtagtcccagctactcagggggctgaggcaggagaatggtgtgaacccgggaggtggagcttgcagtgagccgagattgcgccactgcactccagcctgggcaacaagagcgagactccatctccaaaaaaaaaagcaaagtgggctgggcgcagtggctcacacttgtaatcccagcactttgggaggccgaggcaggcggatcacgtggtcaggagtttgagactagcttggccaacacagtgaaaccccatctctactaaaagtacaaaaattagctgggtgtggtggcgggcgcttgtaatccctgttactggggaggctgaggagtagaatcgcttaaacctgggaggcggagctgagattgtgccactgcactccagcctgggtgacagagctggactccgtctcaaaaaaaaaaaaaaaaagcaaagtagaacagtggattttaatataagaatatgaaaagttcgttggtacaatttaagattccacattgcagttagcctttacgagacaactgcttgtcaattttggcattatatcaacaaaaaatgtccagaattatctgaaaagtctgttaaagtactcttttccaattacattcaaaacataccagattcaatacagaagcacatatgaaaatccagctttcttttcttaagctggatattaaagagagttgcaaaatgattaaaaactgttcttactatgttattctttgttttggaaattagttttttttttcttaaagatgatttatatttatatgcataagatttacttttaaatgaattaatattttgtgtttctaaaatggtaaataacacacatagaaaagctctttgaggtcttcaggttttttttttctttccccaagacagagtcttactctgttgcccaggctggagtgccatggcgtgatctcagctcactgcaacctccgcctcctgggttcaggcaattctcctgcctcagcctctccagtagctgggattacaggcgcataccaccacgcgtggcaattttttttttttctttttgagacagggttttgctcttgttgcccaggctggagtgcagtggcacaatctcagctcactgctgcaacctgtgcctcctgggttcaagcgattctcctgcctcagcctcccaagtagctgggactacaggcatgcaccaccacgcccagctaattttttgtatttaatagagattgggtttcaccatgttggtcaggctggtcttgaactcctgacctcaggtgatccacctgcctcagcctcccaaagtgctgggattgcaggtgtgagccactgtgcccggccttgttttttttttttttttttttttttgtgagacggggtctcgctctctcacccaggctggagtgcagtggggcgatctcggctcactgcaacccctgcctcctggctttaagcaattttcctgcctcagcctccggagtagctgggactacaggcgcgtaccaccatgcccggctaattttttgtatttttagtagagatggggtttcaccgtgttagccaggatggtctcgatttcctaacctcgtgatccacccgcctcggcctcccaaagtgctgggattacaggtgtgagccactgtgcccagctgttaatttttttttatttttagtagagatgggttttcaccatgttggccaggctggtcttgaacacctgacctcgtgatccacccgccttggcctcccaaagtactgggattacaggcgtaagtcaccatgcccagccgaggtctttaatttttaagaatgtagaccgcatgaggtggctcacgcctgtaatcccaacactttgggaggccaaggtgggcaggtcacctgaggtcgtcgggagtttgagaccagcttgagcaacatggagaaacctcgtctctactaaaaatacaaaattagctggtcatggtggcgcatgcctgtaatcccagctactccggaggctgaggcaggagaattacttgaacccaggaggcagaggttgcagtgagccgagatcgtgccattacactgcagcgtgggcaacaagagcgaaaccccatcgcaaaaaaaaatacagagtgtaaagcgtgctgagaccagagtgtttgagagctactactcctaacaaatgtatattggaagagaagtcatattatgataaagtctaggatgtgctttaattgtaacctagcacagtttcttgtatatccgttttttttgttttgttttgttttttgagatggagtctttgtcgcccaggctggagtgcagcagtgcgatcttggctcgctgtaacctccacctcctgggttcaagtgactcttctgcctcagcctctcaagtagctgggattacaaggggcctgccaccacacctggctaattttgttgttttagtagagacagagtttcaccatgttggccaggctggtctcgaacgcctgacctcaagtgatcagcccgccttggcctcccaaagtgctgggattacaggcatcagccactgtgcctggcaatgtgttaatataatatttgaaccagactggatagaattattcagtaaaccatgtaaatacacatttagctaagaaggaatattggtggcgtgtgaagatggtaagtgtttttatgtcagtaaacagtgtctggtttatcttgtattttatagattctgagacctttttttcccacatcttaacatctttgaaattgagatgtcttaaaatggtgataagtcatagtctaatgggcagcttttttctttcttggtgtgtcataaaataatggtgtgtcatagatgtaatgaaatgtgctagtgtctctttttgtgtggagaggagaaggaaacatactggatagcagttcagttcttgagctacgggatatggtgcattaaatgttactcttctttttttttttttttttgagatggagtttcactcttgttgcccaggctggagtgcaatggcacgatcttggctcaccgcaacctctgcctcctggattcaagtgattctcctgcctcggccccccaagtagctgggattaccggcatgtgccaccacgccagctaattttgtatttttagtagagacggggtttctccatgttgttcaggctggtctcaaactcccgacctcaggtgatccgcctgcctcggcctcccaaagtgctgggattacaggcgtgagccaccgtgcctggcccctaaatgttactcttatcaggcacttaattgactctgggcaattgacagtgcactcattgttggaatattctattcataaagcagttatctttatttcaagcaagaaaactagatttcaatgctagaattcaagtcttttaaaacaaagtgtaaaactcatatttgtgtatcttttttaatatgcagagccttttttctgtttaaccatattgttgattttctcctctttatatatgtatatatatatttagttttaattgacatatttatggcatacagtgatacttctatagatgtattcaatgtgtaatgatcaaattgggcatatctgtcaccttatttatcacttctttgtgttgggaacatccaaaatccactcttctagttatttgaaaagacaaaatatttgtttttatttatttatttatttttgagacggagtctcgctttgtcgcgcaggctggagtgcattggtgcaatctcggctcactgcaacctccacctcccgagttcaagcaattcttctgcctcaggcttctgagtagctgggattacaggtgtgtgccaccacacccggctaatttttgtatttttagtagagacgaggtttcaccatgttggcgaggctggtcttgaactcctgacctcaaatgatccacctgccttggcctcccaaagtgctgggattacaggcatgagccaccgtgcctggccataagttgtgtttgttttttgtttttatttttgtttttttgagacagagacttgctctgtcgccaggctggagttgaagcacttctcctgcctcagcctcccaagtggactacaggcacgtgtcaccatgcctggctcttttttgtatttttagtaggcacagggtttcaccgtgttggccaggatggtcttgaaccccagacctcatgatccgcctgcctcagcctcccaaagtattgggattacaggcgtgagccactgagcccagccaaattttttttttttttttttttttaattttgagatggtatttcgccatgttgcccaggttggttttaaactcctgggctcaactgacccgcctcccaaagtgctggaattacaggtgtgagccactgcgctcagctacaataaattgttaattatggtcaccttcgaatgcacactaagacttatttctcttatctatctgtaatttggtatttgttaaccgatctctggctacctccccaccagactctagtaaccactattctgctccatttctatgaaattaacttttttagctcccacgtatgagtgagaatatgcgatacatgtctttgcgtgcctgctttattttacttaacgtaatgtcccctaaactcatccatgatgctgggaattataagatgtggttttaatttttttatggctgaatagtattcatatatagtgtattacataccacattttatccatttatttgttgcccacatttttttgttgtgtttttatttttgagacggagtctcgctctgtcagccaggctggagtgcagtggcgcaatctcggctcactgcaacctctgcctccagggttcaagcaattctctgcctcagcctccccaagtagctgggattacaggagtccaccaccacgcccggctaatttttgtatttttagtagagacggggtttcacgatcttggccaggctggtcttgaattcctgaccttgtgatccacccccctctgcctctcaaagtgctgggattacaggcatgagccaccgcacctggcgaagttgcccacatttttaaatttctaataggtttcttaaaaaagttactgaattctattattaacattttagtgtctctgttttattctgtataaaaataataggaccattacatggagttatgaagatagtgtatgaataaaaagcctaggcatccttagaagtacgttttaaaaaggagaatagggccttggaaaagcacagagttgagtctatcagagaaggcttcctggtggaagcagaatgtcatagagacaggagatagatgagcaagagggcactcatgaggtatgaggcggttggtaggttatcttgattaaagaatcaggttgtaaataagttactgttaagtacatatgtactagtatgtactagagcgtggcgtttgtgaccaagattatgtgggctgctgtatggagaaggggctgagctttttatgatctgacactctgcaaccagtagggccatacctgatacttttctggaggtgtgatcacttatcagtcagccagaggaggactcttggtaaagaatttactcacaggttgaaatccaatcatggttggcagggttttaatgaattagaagacagtgaatggatttgtggcacattatatgagaatgattgagataattttttgaaatgcctctgctttttcaggtggctcatgactgtaatttcagcgactcaggaggctgaggtgggagaatcactcgaggccaggagtttcttttttctttttttttttttgagacggagtttagctcttgttgcccaggcggagtgcaatggtgtgatctcagctcactgcagcctctgcctcctgggttcaagcgattctcctgcctcagcctcctgagtagctgggattacaggcatgtgccaccacactgggctaattttgtatttttagtagagaaggggtttctccatgttggtcaggctggtctcgaactcctgacctcaggtgatccacccacctcagcctcccaaagtgctgggattacaggcatgagccactgtgccgggccgaggccaggagtttcagaccagcctgggcaacagagcaagaccctttatcttgaaaagaaaaaatcatagactttttcagatgtgtgacatttgaagaagtaaaatacagtggaataactataggcttcagtcacagattggatttgttatctctttgccttggtttcctcaaccgaaaaaggaaggaaatacttataatttgttttgaggttattttatatgaaatgtatgtgaatgtatttagcatgtaattgcttactggacagatcagttaggaattgtagttggctggtagtaacagttctggaataatgtagttgtgatggtaagttagggaggcagataagggcgggcttcatgtcatcagggaatccagattgccgcagtgtgtattcccagccctcttcagtgcattacttaatcttaaaggcatcgcttctgccatcacgtcactgtttcatgcagtgggaggaagaaaggggtgaataggcagaaggctaagagctagctgagactattcccctcctccaatgaccaaaggaacttttctgagtgtccctccctacacattgccctgatcatcctgagctagaagtgtctcgttgcaagaaaggctgggaaacaaggctctttgactgccctgaatacaatcggggttttgatagtaagaaggagagaatggatactgggttggatcacgtacagtgtctttcacagtgaatgttgtttcgcttttttctttcatttacatatttgggagcattattgtataggcctagctcccatgaactgtcccacattgtggattttatttttttcttgttttttttccacctggagaacaccgtgaatttttgtttatgaatatcttttttttttcgagactgagtcttgctctgttgcccagtctggagtgcagtggcgtaatcttggctcactgcaacctctgcctcctggattcaagcaattctcttcgtcagcctcccgagtagctgggattacaggagctcgccactacgcccagctaatttttgtatttttagtagagacggggtttctccatcttggccaggctggtcttgaactcctgacctcgtgatccacccaccttggcctcccaaagtgctgggattataggcgtgaaccaccgtgcctggccatttgtgaatatcttatgtctttcgggttctgctttgctgggggactgggcttatgtgataaaattacttaccttgagcattaaaggaaaacaaaaagttaaacttttttttttttattcatagtttagcttgtaccctcaacctttaactcagaggacctgatttgggagttcagcggtggttgaaggttggtagaggagaggcagagtgttgggaggaaaggagactgcctggaggaccgtccagggctttcgtccttggctctgtgcggctcagagaccttggggctttcacttccttcttgggttatctgtgtccttatctatcaaataaggagttggtttagatgattttaagtctctccaacttgaatattctgattttatatgtagacattatacatgcaactcttattttctgtgtgtgtgtgtgtgtgtgtgtgtgtgtgtgaatgtaaaaggccttcacaaccatatgtatacctggtattgccttctagggaatacagaattgaagatagagttatgacataaaatctcattttgaatcttattctctttgcagagaaatatgcacagtaaaactagataaattctgcaatttattaccttcttggtatgaatttttactagggcttttttagaagttcaaagtagaaaaccttttaacaccttcatttggaattttaaaatgtggcagtgaaatatttcacattcagaaacctgtgttaatgttaactaggaaaagtctcagtcttacgccattagtaatgatgtgttgttatcctttcatttctagaaatggatccctggaattagatggagtattgtgaaagtataattttaaacaaatgtttttgtagagacagggtctcactatattgcccaggctgatctctaactcccaggctcaagtgatcctattactttggcctcctgaagtgctaggattgcaagtgtgaaccaccatgcccatcctgaaggtataattattaaaatgctatccagtgttcataatctgcttatctaataattcaaatgctttgtttgccctgctgaggtcagactttggcctactctgtgaatgaatcagtttttgctgttgttacggatggtagagttgagtcaagatgttaatggcccttgtccaatatggggagctagttaagaatgtcttctgattctatcctgtggagtgagagtatctatttgttcacttgatggaaacttacagttccctcgtgtcttgtttcagttttgtttttcatgtggaatacatctagagagacagtatggcttagtggatgggacaggcccttgtgagaattatttcaaataattttgtaatttcaacccagtaaatttctccatcactgttcctgatccctggcattatgaacaataggtttcagaaagcttccatgttttagaacctctcctacctgagattacaggtgtgagccaccacatctggccaaggtgttatagattctttaacctaaatttggcttattacttggaaatgttattgaggaaattggttatcagttttatgattttctaaattactatataacttctagtcacataaaaagtgtctaagcttgtccatagcaagagagggctgcttcaaattatgattaatgatattgcagaacaaactctgggttggtagtaatatttattggttaaaatatagtagtaggcctttaacatggatatgactgtagatctttattttagctgccacatagttgtgaataaaaccaaacttacgaaaagcaggtaaaactttattttattttggaagttagttgataagggtaattcagattgaattgcataataatggcaatattaagtttcttgtttaacagttatggactggaaatttttctttcagcacttgggaggccgaggcgggtggatcacgaggtcaggagattgagaacatcctggctaacacggtggaaccctgtctctactaaaaatacaaaaaattagctgggcttggtggcgggtgcctgtaatcccagctactctgaggctgaggcaggagaatagcatgaacctgggaggcggagcttgcagtgagccgagatcatgccactgcactccaacctgggcgacagagcgagactccttctcaaaaaaaagaaaaaaaagaaaaatctcagatacaagccaggcactgtgtgtgcacttgtagtcccagctacttgggaggctgaggctggaggatcgtttaagcccaggagttcaagtcagtctgggcaatatagcaagatccccatctctaaaacaaaataactcagatacatataattagaatagtataaataaatatctgtataccaccctactatgtagactcaatattttgctatatttgctatctcatatttttggctgagccatttataatttgcaaatactgtgagacttcagtgtaaatactttaacatgcatcttcaaagaataaggactgtttttctgggcacagtggctcatgcctgtaacctcaggattttgagaagccgaggcgggtggatcacttgaggtcaggagttcgagaccagcatggccaaaatgttgaaatcccatctctacaaaaattagccaggcgtgatggcgtctgcctgtaatcccagctactcagaaggttgaggcaggagaatcacttgagcccaagaggcagaggttacagtgagccgagatcatgccattgcattccagcctgggtgccagagcaagactccatctcaaaataaaaattaaaaggccaggcacggtggctcatgcctgtaatcctagcactctgggaggctgaggtgggtggatcacctgaggtcaggagttcaagaccagcctggccaacatggcagaaacccatctctactaaaaatacaaaaattagccaggcgtggtggctggtgcacacctgtagtctcagctactcaggaggctgaggcaggagaattgctccaacccaggaggcagaggttgcagtgagccgagatcgtgccactgcactccagcctgggtgacaaagtgagactgtctaaaaaaaaaaaattaaaaaagaataaggacttttcttacataaacacagtaccattatcacaccagaggatattaatagtaacttcaattatatcatgtaatatccatagaggaaatattgaaatggtgagatgttttgtctagccactttcaaagaaagaaagcctgtatttttacattttaaacaacagtaattagacaaagttagcgccaaaaagattggtttgaaacccatgcaatgttagtgggaaaaatgttctcattcattctaataatttatgaagtcagctttttttttttttttttttttgtgacagagtctcttgttgcccaggctagatgcagtggcgtgatctcagctcactacaacctctgcctcccaggttcaagtgattctcctgcctcagcctcccaagtagctgggaccacagacgtgtgccaccatgcctggctaattttttgtatttttagtagagacagggtttcactgtgttggccagcctggtcttgaacgcctgacctcaagtcatccgcccgcctcggcctcccaaagtgctgggattacaggcgtgagccaccatgcccggcaaaatcagcttttaaattagggtttaaatttgcttttgtagctgcatattttaaaaagtttgcttgagcccagcaggttgatcctgcagtgagctatgattgcaccaatgcactccagcctaggtgacagagtgagaccctgtctctaaatagatgagtccatttttctgcccttagaaaatatagaatgatgagtacaattggaccctcaagagtaaagatcagagacagtgacacagtctagcagaaaataatggtacctgctgcaaagggtcattgttaccaagtaagtgaaattgtgtagtagtggttagcacagtatctaacacataagcacaccaatgttagctttaaaaaaaaaaatcacgtgtaatatatattgatttggaactataaacaccaggactttttttttttagaggcagagagtcttgataggttgtccaggttgttctcaaactcctggcctcaagtgatcctcccactttgaccacctaaacagtgagccactgtgcccggccaacaccaggacattttaaagattgcttttttttttttttttttttttgactttttctagtcatttgtttattacattgttttcaatgacaaaatattttaagcaccacaacaaatatgtggaataaaataatgaacagcatccatttcccagttgtcagattttaacattgtcttcagaacttttttttgaggtaataacacctgaagttacactaaagcctcctgtgatgtctttcctgattccgcttccctccctgtcttcttgaattgtcatcataccattcatgtttattttctcatatatgtatgtatgtagtattttgtatgtttatataaatatacattttgattcaatattacttttaagatttattgatattattagaagtattctagtagctttacttcatttgtttccagttcatttatattgagttatatgtgtaccatattttttccattttgttaatgcacatttaggttatttccagtttttcaccgttatatacagtgtcataattaacatttatgagtgtctttttgagcacatatgtgtttttctgggatagtgtttttcaagccttttttgttcactagacacagtaagaaatgtattttacattgatacccaaaatatgtgtgtgtttatttgcataatgttcatatatatatgcataaatatttacatgtaatagaaattatagttttataaaatatttaccctgaaaaaatatttacgcatacaatgtgagagatgcatacttgagatatgaataaatatcccttcatttaaaaataagctgatcaggacaatatttgacaaataatagtctaatgtatgtaacctgaagcagaattgctgctttgacagtgctcattttcagcttggcgagagatgaaaaatatcactcttcaaagtaattttaccaaactcacattcccatcagcaacatatgagagttcctgtttattcatatccacaccatcatttatccagctttctaacattttgcctatctgatggatgtgaaatggtatcccagtgttttctcagtttattttctagtcaaatatttttggtgccttctttctgtcagaccctgtgcaaagcagtaaagatggtaacaagagaggtgagacatggctttcctattctagggagcttgcattctaggagagagatgaactttgtctcccagtgagtggcaaagggacacacaacggggtgcaatgtgcagcctgcctagggaaatggggctgttccaagagatgaagtttgaccttggtcttgaaagatgagtgggcattttcagagagctgtggagttgaggggcattccgggtggaggggaggcaaaggcatagagctgtaaaaccacattattcaagaaacttaatgagtgttcatgactgtagagtcccaggattggtgaggccaaggaataagcagaggagagcctgcagatatggaggcaggtggagttgtatgctgccggcaccagactcattgaaggttttaagtagggtgttaacaggagttttattttgtttttacaagtctaggaatggattctggtattaaacgtgatggtcaatcaagtttttgtcttaatttcagtttcaaacgcattagcttagctgtttactatagtctttttgaaacaggtagataatagaaattattatatttcctttgaactagagttggtcattttctattctttcctagcatatgacacatttcctttcatccatgtgccttgttttttggtgctttttttttttttttttttttactttgtttttgtttttgagacaaggtcttgctcagttacccaggcttgagtgcagtgacacaatcatagctcactgcagcctcgacctctcgggctcaagtgatccttctacctcagccacctcagtagctggtactataggcgtatactaccacacctggctaaattttgtatttttttgtagagatggggtttcaccatgttgcccaggctgatttcaaactcccgggctcaagtgatctacctgcctcaacctcccaaagtgctgggatcacaggcaagaaccacagtgcacagccttctttcttttctttcttacatgttaaacatatacatagagaaagggtctacattgtataggctggttgtgagctcctggcctcaagcatccagcccatgctccttagttttcagtgggacaacaaatggtcttcacaggtgttttttattgtcaaatatgaataggtatagctttgtacaggttggtaattttaagaatttggattttggggccgggcacttgagcctgaccaacatggcaaaaccctgtctctattttaataaaaatacaaaaattagctgggtgtggtggcacatgcctgtaatcccagctactcaggaggttgagcatgagaatcatttgaacccaggaggcagaggttgcagtgagtcttgattgtgttgctgcactccatcctgggtgacagagcaagactgtctcaaaaaaaaaaaaaaaagaatttggattttttggacaatgtctttcatgaggatactttcagtctttatctcttactcttgctacattgtatgtagcaagtatggatatagttaaaagaacttcctttagaaagctggagtgcctcctgttaatcaactgtatgtgcgtgcatgtatatataaaggtgatgatatgagagattgctttggacttcttgcagcttttggcattcctgggctgccagtccctttttaataggagcatttgtcttgctttaagacatgaaagtttgaggcctgccagtgtctaataaaagcagtttttggagagcaaattacagagagtcgtgttttgaaattctcagtgccttaaaagaatagatgtgaaccatagcatggaatagtaagcacttattcgcgtgtgcatacttgatactagcttttggtgagaagtctcacacttgtgctagtgttaaggagcgtattcaaaggtatgttggtatgttcattgagatgcaggggcaacactgagcattgtgtagatcctatttttaatttaggagaatcctatgcaggtaggttaacttttttaaaccttacagttcaaagttgttgtttttttacccctccttttcacctcccagttcaaagttttaattgtgtttcctagctccttgatatttaacaattacatacttccctgctctctctaaaataaaggctttttattagttcaggatttagtccagggagaccttttactgcgtgaaccatgcttgagatgaaaagaactagacagaagcatgtattgcccagtgtccctgcctgtgccctttcttctcagaaaaccctggctagttgattgtctcagcctcatggtcttttgttaccaccaacctccctgcaccccagactccagcaggcacacacacatctgcacacacacagtttagctgatggagaaggagtagggatgtgagggtgtgtcctcagggtaggggctgggactatttcattttctttctgtcttcagcaaatgtaatgcatgttaacaccttggcagtaaaagtgggctggatcagttggatacaaggtgactgttctaaaataaaatgaaaaacagcataatctcgaatttgtaggcaacatgtgagacccagcaaatggaactttttgtttgtttgtttgagacggagtctcgctttgttgccaggccggagtgcagtggcacgatctcggctcactgcaacttccacctcccaggttcaagcaattctcctgccagtagctgggactacaggcacctgccaccatgcccagctgtgtttttttttttttttttggagacggaatcttgctgtgtcgcccaggctgaagtgcagtggtgtgatctcggctcactgcaagctccgcctcccaggttcacgccattctcctgcctcagcctccagagtagctgggactacaggcgcccgccaccactcctggctaattttttgtatttttggtagagatggggtttcaccgtgttagccaggatggtcttgatctcttaacctcttgatcccccttcttggcctcccaaagtgctggaattacaggtgtgagccaccgctcccagccgcaaatggaacttttgcaggtggtttggccattagccgtgtacatgcttagagtgtgtttaggctagtggacaggatgttctctgtgtgtactgtgtaaccttgaggctttgcgtctatttctatttccctagaaatgaaatctaaaacaggctgctttccttccccctagctttccaaacaaaagtaaggcttgtagatgtgaactagactgttgcaaagttctggagaggatggctgtggtttgggatttgatttttggtaggcttttttttttttttttaattgttagaacttgagtgtgataaatggcttctttttttttttttaagtgggaagaaaatacaagatcattaaccacttgtgcatattctatttcaaatggcttagaaatttaaagcaaacttgttaaagtttgtagaagctgagttgttgatttctgtggtggataaaagccagtgctgtatctggaaactgttttcctgtttttcttagataccccttgaatcggatctgtttaatggaagaggatttttctgttaagctggttataatgccggttaaactttgtgtttaggatgttaaagtcctggaatgaatataattacctgcctatataaaaaaagctgaagtcatttgacgaaaagttaacaagtgcaggcatgtgagctatttgaaaatttaaaatgcatctgagagagctttctaagattcagagggttttatggattttttctggctttttaataattgaactttatatgaaatgtacattttagctagatggacttacgaggcagatagaggtcaaggaatttttaaattatagattgtctttgcattgcctttggtctgtttctgtattctgaactgatgattgaaagaacgatctgtggtactcaacatttttatggattttgagatacaaagggagctcaaaagcaactgcatgctggggatggtaggagttctcttgaaagacaggcagagttaggagggtctgggccacttagcccgtttgcttttgctttggccacaggtacgggcaggctgttttacaaggagttaaagttctgcttctaaacagatgcctttctgtttcagtgtttcttcctagtgctctgaaaaccatatgtggggaaaatagttcgttctgtttagaggttaagggtgttgcctgcctgaaagtaccagtagtagtatttagtatttatttatttttttgagacagagtctcgctctgtcacccaggctggagtgcagtggcgcaatctcggctcactgcaaactccgcctcccaggttcatgccattctcctgcctcagcctcccaagtagctgggactacaggtgcccgccaccacacccggctaattttttgtatttttagtggacggggttccactgtgttagccaggatggtctcgatctcctgacctcgtgatctgcccgtctcaacctctcaaagtgctgggattacaggtgtgagacaccgcgcccggctgtatttagtatttaaataaagtgtgaagaagcaggtgaagaaaccttcctaccatttaacaagagggagccaagcccgtggtttttgttgcaggaaatgtgcttctgccactcctttaaagctgtgaaagttaatttcacagcctcggggaaagacattgtttcccctaaagatcaggtcttgaagttggaagttgtcatttggtctataacttacactaatgaaaagcctcttagagtgcttactgtgtgccagacacattaatcatagtagtaacagctgacatttgagcgcatcctgggccggacattgtgttttttagcactttaaatatcttcctcagtcctcagaataactcaagaggtaggtactgttttctttttttctgttttaaagatgaaaccttaggcccctatctcatgccaagtaagttgcagagctgagagataagctcagtctgtataactcgggagctttgactctgaacaactaaattctctattatggtactgataattccctggactgtctggcagagagtgtggttctttatttcatcaagggagtgggctcagagaagataagtaatttactgtcataagccttgtgttgaaaccagaactcaaacctgggtcggtttgaagtgaaagcttatgttcttgccactgagtgtatcatatgacctcttagagtacattactgtaatatctgatttacaaaggtctttttatttcttgtgtcggcttccctctgtttctggaggggagttgtttaaaaggttgatttttggtcgggcatggtggctcacgcctgtaatcccagcacttcgggaggccaaggtgtgtgggtcacttgaggtcaggagtttgagaccaccctggccaacatggcaaaaccccatctctactaaaatacaaaagttagccaggcatggtggggcgctcctgtagtcccagctactgaggaggctgaggcaggagaatcgcttgaacctgggaggcggaggttgcagtgagccaaaattgcacctctgcactccagcctgggcaacagagcaagactctgtctcaaaaaaaaaaaaaattgatttttgaggtggctgttgggaacttgatacgttgtctgctggcagctatgttgcacctggttgtggttctgaggctgtctggccagagcccattggtacagtcaatacatgttaccttcttaagctgctgacaccaatctggcttccaagatatgcattgagttccaagtggggaagacaagcagatatgtgtttcctagtgtccagattccatttgttcttttataagtgttatctccttccatgtcggtaacaaaagtatggggtcgtagttaagtacagagcctctgaggtcagacttggttctgtcacccgctccctactagatgacttgaggcaaggctcttaaccattttctccccttgagagacagggtctggctcttgctcaggctggagtacagtggcgtaatcatagctcactgcagcctccaattcctgggctcaagcaatccttgtgcctcagcctctggagtaactgggactacagatgcatgccactgcacccagttaaaggctctttacccttctgaggctcagtttcctcatctgtaaaatggatggatgtcctcatgagttattgaggggctcgaatgaaacatacaggccttagatgcttggaatggcatctagacatggcgggtgttcagaaaatgatggcagtggtggtggagatagcaataacttctctgctgtgtggctcttctcttctattacaaaagatcaggaccttttgtaacaggtcaaggtgaatgctttctggagtagactgttgtgttaatgctctgaattggatataaagtaaaatttgggattccctttattttgtaggcacatgtaagtcaataaattgccttgtaatttaaatcctatatagtcaaattctgtgctgtactctttttttttttttttttttgagacggagtttcgctcttgctgcccaggctggagtgcagtggcatgatctcggctcactgcagcctctgcctccggggttcaagccattctcctgcctcagcctcccgagtagctgggattacaggcacccgccaccgtgcccagctaattttttgtatttttagtagagacgaggtttcactatgttggccaggctggtctcgaactcctgacctcaggcgacccacccgccttggcctccgaaagtgctgggattacaggcgtgaccaccgcacctggcccaatgttgtacatttttatattctttgaaaccttgacttttattggaaatgtacttggttgtgttgaacaaaatatttgaggaaaatttttagtgattaattattaaaaatgagccttttaagttcttgttgaacttgaacatagtgtacatttcatttctcaaatggaaaaactgaggtaggaaatagggataggctttgcctaaaggccgttgagtaaagtatgagtgagcgggctttataagggccaaaaacaggttgtgcatcccttatctgaaaatccaaaatctaaaatgctccaaaattcaaaactttttgagcacctacgtaacacaagtggaaaattccacacataaatacttaacacaaactttgtttcatgtacagaattatttaaaatattgtttaaaattaccttcagactatgtgtataagatgtatatgaaacataaatgagcccagtgtggtggctcatgatgtaatcccagcactttgggaggctgaggtgggaggatcgccaagcccaggagtttgagaccagcctggacagcattatgagaccccatctctttaaaaagaaagaaatgtaaatgaatttcatgtttagacttgagtctcatcgccaagatatgtcattatgtatatgcaaataaatccaaaacatttctggtcccatgcatttcagataaagaatactcagcctgtagtaaatattttaggctttgtgggctgtatggtcttttttgcaactattcaactctgctgttgcagcacagaagcagccatcaataatacgtaaatggatgggcatggcgtgttccagtaaaactttatttacaaaaacagggggtgggccctagttcgtggacccctaaactgaaggaacattttaaattctatctcataataaaggcctaccttggtcctgcatctctctgtgtacatgtattaaaggttgtttttcccttaggcttcattctcagtcatcttttcacataacacatcctttgctataaaatgattcatagacccggtatggtggctcatgtctgtaatcccagcactttgggaagccgaggcagaaggactgcttgaggccaggagtttgagattagcctgggcaacatatcaagacatcgtccctacaaagaaaaatttaagaattagccaggcatggtggcacacacctgtagtcccatagctactcgggaggctgaggcaggaggatcacttgaacccaggagttcaaggttacagtgagctatgatgatgccactgccttccagcctgggcaacagagtgagaccctgtctctaaaaaataattaaaaaaaacatatatgtgcatttttagttgagttgttgtttcctaaactctaggttagtgtaggtgcctgccttccaaatatctctccaagacgatcccaacaggcccctaaaaccttgcatgtccaatactgatgtcagtactatttcttccaaactcttactacaatctgtttttttgtttacttacctattgccgaagtgggaaacctgtgtgtcttaacaacctccctcatcctgtttgttctgtcctcatttttttttttttttaattgagacggagtctcactctgtcacccaggctggagtggtgcaatggtgtgatctcagctcactggaacctccacctcccaggttcaagcaattctcctgcctcagcctcctgagtagctgggactacaggtgtgtgccaccatgcctggctaactttttttttgtatttttagtagagacagggttccaccgtgttagccaggatggtctcattttcctgaccctgtgatctgcgcgccttggcctcccaaagtgctgggattacaggcatgagtcaccatgcctgacctgttctgcctctttattctctcccccaaccctgccctccattgcgaccaccactgtttgattcagggcctcgggaccttacctggactgttggagataatctcacaacttcagggctccctgcatctagtctgtctccttccagtctgcctttcatcttggctgccagagtgatcctgttttgtttttgtttttgttttttgagatggaatcttactctgtcacccaggctggagtacggtggtgtgctctctgctcactgcaacctccgcttcccgggttcaagtgattctcctgcctcagccttccgagtagctgggattataggtgcccaccaccacacctggctaatttttgtatttttagtagagacggggtttcaccgtgttgtccaggctggtcttgaactccagacctcagacaatcagccttcctcggccttccaaagtgctgggattacaggcatgatactgttttttgtacatctgattatgctacttcttgcctaaaactccttagttgctctttagcacccatggtttaaagcctaaccttggtataaaaatcggtttgatggagtcttggtttaaaagtcagtttgatagagaagtagtgccttcctaccatcggtcaaagatacaatgctgtgctgtatgcctctcccctcccctagccttctcaagggacacttcctaactcttctacagagtccctttctcttttggcctttttgtttttgtttttgttttttttttgagatagagtcttgctctgttgtccaggctggagtgcagtggtgcaatctccgttcactgtaaccttcacctccagggttcaagcgactctcctgcctcagcctcttgagtagctgggattacaggtgcctgccaccacactcggctaatttttgtatttttggtagagatggggtttcgccatgttggccagactggtctcgaactcccgacctcaggtgatatgcctgcttcagcctcccaaagtgctgggattataggcgagccaccgtgcctggcaacttttgtttattcttcaatattcacctcaagccttgcatcttactcaaagccttccttgaatcaccccccctctatatttgttttcaacccttttcgtgtcttctgtatgctttaattgacccctttgttttcccctcagaccactttatataatcagctgtttgcttgtggctccaactcccacctctttcaagctgctccttagaagatagattctgtgtcttatctctttgtccctagatcctagaactgtttgtattgcgtctgggcttaagcattgtgaagaatgagtggaaaatggtaaatatttattactaaagaggtggggccacatgtacatttatatattttttaatacagacagggtctcattatgttgtctaggcaggtcttgaactcctagggtcaagtgatcctcccacctcagcctcccaaagtgctaagattacaggcgtgagccaccactcccggcccatttttctctttttgaagggttcttatttctactcttccagggcaattagaagcaaaaggaaaagacccttggactggagtctggtagaaagaatgctcagtgagcaaacctggggctctgaaccgtccccttgtatgtttttcatggccttgcagctcactccttggagctgtggttctttgaggtgtaggtcagaaattcacggggtgcttcatcaaagtgtgcatgtctgatgaatacctaccccctgcctgcccctctctaggtatcagtggggcggggaatgtcactctcctggtgattcttgtacatgtttcttcttcccatttccggccatttttcccacctgacattttctccctgctccttatattacatagttctttatgatctttctcctgtgttttgtattccttctctgagagagaggggctccagttgcaatgaggttcaaatgatggttttagtgtctcaattaaaactctgaatgcacttactttttttagtaaaagcattggtatagatgatggctaatattccagagttaaatagtgtacttcagataaaagtgagttaaattggcttttgtgtgtaggaagttacattctgagttctacgcaatggacttaagaacttttgaaacaaaacttaaggctgttagttaaggactcatggagtcagatctgcagtagagaacatcattctatacctcctgccttattcccctcttgtgaccccccatttcttccctttactggtaagaaacccaggagcaggcagtctttgttggggataatcatagattggcccttggaaagtggattggaaaatttgaaggtggtgctcatttgtgtttaaacaattatttgctatcatatttagcagtatgctttgctggtttttagattgaacctatgcagacagttagctggagcctctaaagaagaaactttttattcttaagtgactgactgcttagtaatctacataacaaatgaaccattttgcttcagagacgtgaaataggcatctataaatgaatagtttttgaaactaaagttgttaagacaaagttcatcttttcacagtagggtttctccagaaaaccctctttactctattgaaatgcagctagttgaactaggaaagcatattccaataataggcccatgcaattagcctttagtataatggaatgaatggtggaattttttgtgcattgtcatcatcagttggtgttagtcccaaaccacataatagctagaaaccttgattgggagacacaaaggtttcttattcatgggcatgctttaattcttgaaactagtaaaatgttagactcttaaatcttaacacttttttgataactgtctactgctggtaagattaagatatggtgcttcggaattatgtcattattttgagtgagaagaaatgtcgaggaactcttcatttagcaccatatccaagccaaacctcgtatagaaattacacagtggtgtgctggtgaatattgaacaaccaccctggggagggggataaagccctgatttgtaatgtttgctgatttctgaggtataaatactctatcatggctggtttcaggctactagtgttatgttgctgaagttgggaaaaaatgtgtataatcagctggcttgaattaatctcagctatcaaatattcaggattttacagcctgactttttttccagcctgtattttaataatctgcttattcttgtctttatctttgtcctttgttttgaaaaaattggtcttcctgaggtataatttatatgcagtaaaattcagcaattttaagtgtatacatttgatgagttttgacacatgtatacctcgtcacaatgatgatattccattaacctttctatacacagttgccagattaattttcctaaaattgtgctttgcatccgtcatctacctcggcataaaaccttcactggctatgtactgttcataggataaagtacaaaatgctgtggtctggctctctaccgtcttgctttttgtctacttatctgcttttatctaccacaacccggctacatgaacctcttattgcaataaaactgatcaactggttctaggcacagttgctgcatctgtgcctttgctgtcagctgtaccctgcctatgatattccttggacatcatattccttcttgactgcttggcctttccttaaagtctggctcaagccccattttcttacacgatccaggctttactgattacttctgcatcccgacagctgtcataccgcttgttttggcacttaactatcgcaacttgtattgaaattccagaggtgttttttggagtcatttgatcttacccaacaaagttgtaaactatgatggggtaggaaacgtacaacggagtttttagcactttgctcaaaaaaaaacaagaacaccccctaataaatggcttttgatgatgataaacctttaagcagctcttccaactcagtgagtcgcaaattcagtaacactactggggagaatagtactctgttgtaccattgacgtagagactgaaggtttggtctgtcccagagcatagatgtgtagtaatgtctctcaaaactagtattagtcattaaagtgcacattggagattttatctctgccttgaaaattcatccaaaggtagttagcttcatggactttggacttttggcacggattaagcgtttaaagtaggtctccaaagaaacttctttgtttctctcaaccagctttattgcactttttgaagtactggtaagaggtcaggagggtgtatctcattggtttccttcctgtcccaggaagccatgttacggtattctgaaagaactttttctttttcagtaactttactataagcaaatttttttttctttttaaaacttgaattttctctgtaagacattgcatacttgttgaaagcagacattaaatgataacctaacaaatacttaacttaattctagatgcctatctgtttctcaggataccttgtaggttcctcttctcttaaatactggctttactcagggctgggcgcgtgactcacaactgtaatcccagcactttgggaggctgatgtgggtggatcacatgaggccaggagttcgagaccagcctggccaacatggtgaaaccctgcctctactaaaaatacaaaaattagccgcatgtggtggcacacacctgtaatcccagctactcaggaggctgaggcacaagaatcgcttgaaccgggaggtggaggttgcagtgagccaaggtggcgccactgcactccagcctgggcaacagagcaagactgtctcaaaaaaaaaaaaagaaagaaaaaaaaatggctttactcggggtttcacagttcatccttatctcttggtagttagtaccctattcttgagtgatttcatctattattgcctgaatgtgtttttagaataaaaattccatatctcttgagctctggtcttggatggccaaatgcctactggacatcttctctttgctgcttttcagagaccccagattcaacatgtcctaaatggaacatctgtataagtcttttttttttggagacagtgtctcgctcagtggcccaggctggagtacagtggcactgtcatagctcattgtaacctctaactcctggctcctgggctcaaaccatccttctgctttggccttctgagtagctgggactgcaggcgtgagccgctgtgcctggcctctctgtaagtcttaggccctctcttattcctcgattgctgaatggtattaccatcagcaataccaggataactcaacttgagataactcaagccagaaacattggaatcatccttggcttgtccctcttccttctctttctgtgtctgtgaggttcacctcaaacatttcttacaaaaatccttttcctcctctgttttgagttctggccaaccttatcctttgttgggaaggggactcccctgccttccaagcatctaatttgtgtactaagagcagatctacttccatggcatcagatgaaccaagctcataagtctgaaaggtacaactggaaaaccagcatataattttaattgtgtaccagtgtttctggtctctataggtaaacatagctgggatcccatactatcattggaaagaaggttattcgagaaggcattagaacaaaaacaatgagatgaatcaaatgtataatggtctgacacaatctgatgataccaccatctcatcgtagatctgttgtgaccagaaacctcatgtctatgaacaaagactccttttctcccctatctagttgcttcagtggcccctgccagtctttctttttcattcttcttctgagcttgcaggggtgacccttttatgagataccttaatcctttgcatgtctgaatacattgattctggctgtacttgaatcttgctatgtggaaaaccagattttctctttcaaatggcttgtactcccctcagtcattgtgtgttgatctcgagttgaactctgaggggccatcttacttcatgtccttggaaaaaacttcactgtagctgccatataagagcaaaatgctaatctcccattgcatttagccagcatcaccacctcttgaaaacacctttggcttccccacctcctggattaggacaggagcaccttcagtgtgcctcttcagcactgctgagtaaccctcatatcactcttaactgcctctttggtagtttattgattgttcatttccccactaaacttggagctttcagagggcagatgctctcttatttccagatcctactgtctagcgtagtgcctggcacctactcacactattcatttaaccagtttctgttgagcatccactgacacgtagccgaggctagtcactcagctacatgtcaggaataaaggcaaataaggttcttgccctcttggaagtcgaatttcgttcgaggtgagggaggatataaaaagacaaaatagtactcatgataaaacctacaaggaaatagacaatagaatgaggtagagaataattgggatggtctgttgggcatgtacttcaggtgatcggaaaggtctctaaggaagtgccatttagacacaccataaaggcctggtgcagtggctcacactgttaatcccagcactttggaaggccaaggcaagaggatcgcttaaggccaggagtttgagaccagcctcgccaacacagcgagatccccatctctatttaaaaaaaaaaaagacacaccttaaaggataagaatcagcaagctatctgtcaaaacagggaaatcagggctgggcagaagaaatagccattgcaaaggccctggggaggaagagagcttattgtgtttgaggaaatgaaagaagaccagtgtatctagaaaggtaagagaggaagaatgtggcagactgagaccgtgtcaggcatattgtgggcttggatgagtgaaattagacagctgtcgatacagtgagtgattcacatactttagatttgtttggaactagcactgttataaattgggattctaaatgttaattttgcacattcttttctggaatgttaatactcaaaaaataacgattgaaagataacctagaacttattattttttaagagacagggtgtcactctattgccgaggctggagtacagatgccagcatagctacctgtagccttgaactcctgggctcaagggatcctcccatttcagccttctcagtagcttggataacaggtgtgtaacactgtgctcagctagttttgttttgttttttaaataatagagatggcgtcttgctttgttgcgtaggctagtctcaaactcctgggctcaagcagtcctcctgccttggcttcccaaagtgctgggattacagacgtgagccaccacatgcagccatagttttaaaatttttgtagatatggcgtcttgctgtgttgcccaggctggtctcaaactcctggcctcaagtggttctcccacctgggtctcctaaagtgttgggattacaggcatgagccactatgcctggccgagaatttcagtctttatgtgaaatatatcctacaattacagacactcttaggatgttccttttcttgtctgaattcctatccctcaggagcctggaataaagctatattgagagttttctgtgtcttattgagaattttcacatagtcttattaaccgtcgttgcattctgctggttgatctattttagcacaactgttgaaataaatactgttcatttaatgccacatccttatctgaaaatcagttcaaggataagcacagctgagtcatttaagcttatatgagtacagtttttgaactttgtggattgtgctttaaactagtgtttagattctctgtaggtgcaaggcttctttcctcccttgctctcacacattctgtgcccttggctgcactaggttgcatatgcattattgaggttaatgggaagccaaatgcagagcagggagccacagtgagtagcagctctacgactcaatagcagtccgaccttggacggggttgcagcccgacagtgtattcattttttataatggaaacaatacttgcatgatagggttgttgagaggattaaacgatgtaacatatgtaagacactaacacctcttgatagaggcttggtaaatatttggcacctgttaatcctcagtttccccgtagggtaaatatgcttatccccacttttgtaaatggtggggggaggcaaggcttagagatcatttcacttgccttaggctggtgcttctcagttactggggactcttgttaaaatggagattttgattcagttagtctgaaactggggtccagtgtgttcatttctaacaagctcctccaccttaaataggaggctgtaggctacttcctaggaaatgggggagatgggcctcaaacccaggtttgctctactccaaagccttcccccgtcccatggagcctcccttattctcacttgtgcaacaggttttttgtttgtttgagatggagtctcgctctgtcgcccaggctggagtgcaatggtgcatctcggctcactgcaacctccgcctcccaggtccaagcgattctcctgcctcagcctcccaagtagctaggattgcagctgcctgccaccatgcccagctaatttttttgtatttttagtagagacggggttttgccatattggccaggctggtcttgaactcctgacctcaggtgatccatccgcctcggcctcccaaagtgctgagattacagctgtgagccaccgtgcccggccatgtaatggttttgttaagagacttatatgtagtttaatgattccttagattactaagatctaaagttacatttttttattcatttgctcagccttttcttagaactctttgtatgctgagttcccgttttaaagatctactttgaaagaagtaggactaagtgaaaacgggttaataacacttaatgttgtctgttggacaattacttgttgtctcatcatgttaaatactccacattgttcttctctctcccccgctcccccaccaaacttgcttctgctactcctgcctgccttttatttttgttagaacagtgtcatcagccgggtgcagtggctcacacctgtaatcctagcattttgggaggctgaggtgggtggattacttgaggtcaagagttgagaccagcctggccaacatggtgaaacctcatctctactaaaaatacaaaaaattagccagacatggtggcgggcacctgtaatcccagctattcaggaggctgaggcaggagaatcgcttgaacccgggaggcagaggttgcagtgagctgagatcacacattgcactccagcctgggtaagaagatctcaaaaaaagaaagtgtcatcatctactagattggaaatatcagatattcttgagtctttcttctccctcatatacagttagtcatccagttcttcaaaatctcgttgaaatgtggcttcccctccagccagtctactgcctatcagtacttacctgtctgtgcattagcccccaccgacctctatcccaccagcatctccctgtggcgctgtgcagtctcgctgttggtcaccttcctcatcagaacaagcctgagtgtgccacactcctctccagaagccctgtggtcttgatagagagaggcaaatagggtggctcaaagaacagacttgaactagactgcctgggctcctgtcctccctccacaactcaccagccacaaataatgagaaaggtacatttgctagggaaaacatttaaatacaaatactcatcttgatgtgtttaaacatgttgagacagttctgtctgaggtgaggaacaaattaaggatagatacattggtttcttattaatttagtgtttaagacagtgcttatttccttggggaaaaatactgtaaagaaaaagaaaacacctggtacggtgagtcacgcctgttaatcccagcactttgggaggccaaggcgagtggatcatgaggtcaggagatggagaccatcctggctaacacggtgaaaccccttctctactaaaaatacaaaaaattagccgggcgtggtggtgggcacctgtagtcccagctactcaggaggctgaggcaggagaatggtgtgaacctgggaggtggagcttgcagtgagtggagatggtgccactgcactccagcctgggtgacagagtgagactctgtctcaaaaaaaaaaaaaaaaaggaaaaagaaatcttaatcatacgatgctatatggctcagaagtgaataatatttacatgtatacgtatgtaactaacctgcacaatgtgcacatgtaccctaaaacttaaagtataataaaaaaaaatttacatggtcataatataatctctaaatagtgatttggccaacaatggtgatgtgattgtattccatggagaggaagaagaaacatgggggtgaggttgaaaatcctgatactccaatgtgagaaagtcatttgataatattcgaaactataaaatcaaatagtatatacaaatgttatatagatacaatgaattatcttccatgtgtttgaattatcttctatgggatctcacatttaagtagtcaagggtaaactctatggcttttagcaaattggagagtaacatatgtgttacattaatgttggatgttgagataattaaatccatgtcattcttttgtgagaacacattattttgcatgctgtaatagcacagtagtttggaataaggagctatttgacgtatcaggtccacctaagaaataagaagttaacttcatatcctattttgggcatagatttattttattattttaatttttttttttttttgagatgggtcttactctgtagcccaggctggagtgcagtgatgtgatctcgggtcactgcagtctccacttcccatgttcaagcgattctcctgcctcagcctctcgagtagctggggttacagttgtgtgccaccacacctggctagtttttgtatttttagtagagagacggggttttgccatattggctaggctggtctcgtactcctcacctcaagtgatctgcctgcctcggcctcccaaagtgctggatttacaggtgtgagccatggtgtccagccctgtgggggcacagatttagaagtacaaatactttttaagtgtttgagatgtaggtaaaatactactccttgttgtttgattaagtgatgccgtatcagactaaactctgtccttgtttttgtttttttctgatcaggttctggagttaacctgtctcacacgttaggtgagatttaattgattagccttctctttgagatagttgatgaaaggtgcttcatatcttagtaagtttttgttcgtgaatcctgagcacatgcacgtgttgtgttaaagaggcaagaaggaacagtagagcgaatccctgtgaaaagcatgcttttccccatgggtcacctagccagggctctgttggattggtgaacagcatgagagaaaaaaaagcactggacaatttgagctgcgtttggcaattgaggtggtgtttaaaggtgaactttattttactataaaagctttaatactggtattggtgagagcatgagggaaacaggtctgcttaggtgatggtagttagaaagtaactggatgcaacctttttgaaggatatttaagcattatatgtcaaaattaggtatacagccctttgaatagaagttccacttctagaaattgcaaacagatacttgaaaaagtataccaacagacatgtactgggatgtttattgtaactaatagcaaaacaaaacaaaacaaacagcagacaacagccttcctattcactaatggatatgaaattacggataggtaaattatggtatattgacattatacaagcactaaaaaaaggagcttagatctatatgtcctcaaacatatcctccctagatgcatgggcagaggtatttacagaacagtttgtacctacatgtctttgtgtatgtgatgacgtggatgtgtgtgtatataaacatctctatggaaagtgcataagcaatggtagtatctaggcagtgggactagaagttgcggggtggaaaggctattttaagccccagtcatgtttttaaaagacaagaaaaaaaaaaaaaggcctgcaactcaacacttgatctgatgaggttatttggttgtattgagggtgctcttgtgtctttcaggagggattctcctctgcactgtgccctctgattgcaccagcacatctcacatggtggcacctgagcctatcagttctacttgtctccgtggtgcaaacacgagagaaggaaactcaatagttttttcaccttttcaatgtcaagttttcttactatatatacatccactgttgtgtctaggtttgttttctgttgttttgctaaatagcttgatttttttcatattattcagttcttcaggaagtactactccttgtgagaaacttgatttttaatttccttctcatacttcataacaatacagccttcattcttattgttgatgcatatttaaatctaaacttctacttaagtgattaggttggtttcttttatactgtttatcacttcatatgtcctaattgtacctgacagatcatttcttaactgtatgttaatcatttctgttggtcttgagctagcagttttgctaatatggcagggtggctttttctctgagatctatcacctgttagtagtatgatgctgaaaatagctctaccactcttgttgtatcacattgcacacctagatacagtctactttcacctcccttgactttccagggttttcttgcttatttactcatattggtgtgattttcttatggtagggtgtttctttaacagcaatttttttccataaaataattcatttcttttgcttattttcactatgggtttttttaaaaagcagcattccagtttttgttgaaagttttttatcccacttctttcatcctaaatgttgataaagataataaatacaggcagcttataatagctatttgaacgtattatcaaataaggtattttcctgttaactacacttctgtatagtttttaagcagaatttcaatcaagaagacactatttttctatatctctttagattactttttgatttttttaaacactgtttatacaagtttttatcaaacttccaacagataatgggtactgcctctcataaatcttccaaagggacaatggaaactgggcccagttgaataaagccatattcatttgttttggaacgcagagttctctgcatgtagattgcatttagcattctgtctagtgtatccatctgtagttttgcttttttcagaataaaaccttgacagtaattttgaacctgttactttatttctttttgcatgtattgctttaaaaaggccgaagtctagtattctcttcccctttttaagttttatgaaatcaaggttaaattgatattagtgccacttaatatttgacacctgctatgcctaatgaacttgaagtagtaaagggagcagcaggggtcagccattcatattatgcaagataactggagaacgagcagactatgattagagctttagactagtgggttctaacctctttataagagcaaattcattatttatatgtgcatatgtgttaccttttcctttttcctctggatttataggtatttgagtttcaagaattttcttgagattatattatagaagtcattaagatggggaatcaatctctagagacataaactggtaattatccagtgtagggaaggaaaggaagatgaggcatggtctggtttgtggacctgggtcttcgagtaagtggctccatgactttggggtgcgctgaatgtaatgtaagaggaaggggatgatggcatatctggcatctcttcctgcacattttttatgatccattattcacactttgatcatctttatctgctgaatgggtaccgcagcttggtatttattaattatcacccaccactctacagaggtaactatttgtcactatgaagaatgccaaagaaaatatttcctcgtaaaatttaactgcttactgtgaatgattcataaatgcctgattaaaaggtctgtgaatagagatttttgtgcactgacttagctaaatgctatcttcattgagtggcattgcagtctatatgtcaagttagagtaaaaactgtatttaaaatggaaaaacagaaaagggccaggcaaggtgactcacacctataatcccagcactttgggagcctgaggtagaaggatcactcgagaccagtagattgagactagtctgggcaacataaggagacctcatctatacaaaaaataaaaaatgagccggatgtgctgatgcatgcctgtaatccaagctactggggtgggtgaggtgggaggatcatttgaacctgggagggtcgaggctgccgtgagctgagccgggatctcgccactggactccagcctgggcaacagagtgagaccctgtttcaatcaatcagtaaataaataaatacaatgaaaataaaatgaaaaatggaagcagtgttcttaaagattttgttttttttttgagacggagtctcactctgttacccaggctggtgtgcagtggtgtgatctcggctcactgcaacgtctgcctcctagattcaagcgattctcctgcctcagcctctagagtagctgggattacagatgcccgccaccacgtccagctaattttttgtgttttttagtagagacggggtttcgccacattggaggctggtcttgaactcctaacctcagatgatctacctgccttgaatcccgaagtgctgggattacaggcatgagccacgacgcccagccaagatttttcaaagaacactggaaacttgaataccaaaggcactacatagatactccataaagtcatattaaatttagctttttattgagaagttgctttgtgttgagcactttgagtggtatagcaaagacacataccgcccaaaaggggaagtaggattttttctgttgtttttttctgagacagagtcttgctttgttgcccaggctggagtgcagtggcgcgatctcaactcactgcaagctccacgccattctcctgcctcagcctcccaagtagttgggactacaggcacccggctaatttttttgtatttttagtagagacggggtttcactgtgttagccaggatggtctcgatctcctgacctcgtgatccacccgccttgacctcccaaagtgctgcgattacaggtgtgagccaccgtgcctggcctagtaggatgtttttaaatagatattttggggagagggagttggggggaagaaataaatagatgttttcattaggattttgcagagggccacctgattatttgtatgtctttgtatcatttacggggaaattatatgttgcctatgacttggaagttttcaaggtgagttgctattgtcatttttaaggttgtgatttgttttccttgtcttgccagcctcctgtgattaggtaggttctgcctttggaatgacaaggttcttcctgcatgtttttctcatgtgcgcaatggtttcgtctcccctccacccttagaatttgcaggtctaggtcttccgcctgtgcttcccttcatgccatagcccccatgtgacaggtgctagagactgtgtgacagccataactaaatgccacttgggacttctgcacagcatgtcagatgcacagctcattgtttgcctccaggcctacagttaaccaggaaagatttttgttgtctaattattttataatttcctgagagcagaaaaagtggattttaattaagtaccagatgtcttttaaggtcctaccttctaaaagttttccaaaaagtttttaaaacaatttttctagatttggaatttcattgtggacttgttaatatctctgaagtgtctcatgtcttgagaatcttgcaggactttattctctgcggttcagtccaagtttgcagattttaaactgaatgcttgactagctgatggttatttgacagtgagtgtcaatctttccatagaagtaggatgtactttgagaaaagaagttaaaaaaaaaaaatgatgggtatgggccgggcgcggtggctcaggcctgtaatgccagcactttgggaggctgaggccagtggatcacctgaggtcaggagtttgagaccagcctggccaacatggtgaaaccccatctctactaaaaatacaaaaaattagccgggtatggtggtgtgtgcctgtaatcccagctactcgggaggctgaggcaggagaatcacttgaacccgggaggtggaggttgcagtgggccaagatcatgccattgcactccagcttgggcaacaagagcaaaaactccgtctcaaaaaaaaaaaaaaaaaaaagatgggattagatatgaaacaaaagcacatcatttatttatttagagacaaggtcttgttctgttgctcaggctggagtgcagtggcgtgacatggttcactgcaaccttgacctcctgggctcaagcgatcctcccgagtagctgggactacaggcgcatgccaccatgcccagctaatttttttattttttgtagagatggtgtttcaccatattgcccaagctggtatcagagttctaagctcaaaagatctgcctgctttcacctcctaaaatgttggaattacaggcgtgagccactgcacctggtcccatttattattttatttttttgagacagagtctctgttgccagactggagtgcagtggcacgatctcagctcaccacaacctctgcctcccaggctcaagcagttctcctgcctcagcctcccaagtagctgggattataggtgtgtgcctccatgccctgctcatttttgtatttttagtagagacagggttttgccatgtcaggctagtcttgaactcctgacctcaggtgatccacctgcctcggcctcccaaagtgccgggagtacaggtgtgaactactgtgccaggcccaaaagtaggcttttgattaaccctttaggagttaagagagtaatatactatttagctaatatactgctaatttatatacatgcatttgtacattatgtaaatttgtaattttcagttgcaagtaagcaaatatgcactattgccataaaacagcaaagcagtcaagtttgtttattaaggagctattgatatttcatcgatagccttctagcttctaaatattttaaagtgcgtaactgaagttggaatttctctcaaaatcttattttttgttttgactatatttccttgctctcaagatggtatcattatttttccctatttcccttcacttttctctctctgaaactgtttctgcagttggatcatttctgactttgactatctgactttgtaaatctgcttttaaaaatattttgttggggatgggggtgtggtacttagatttcttatctttctgataaacctgtcttaaaatgtttctatgagtcttaatttttctttgaaaattttttactctattatttggaagtctggaggaataatacattcagggaaaagccaagttatagtgatgattttcctatttaagtaacatttacttggtttttgcctatgtttggcttgtgacatagaaactctaaatgaagcataacactagagaagaaaaatttcctctcctaaggctagactgatttagtctgctaggtggtaatgaacatgcttgccatttaaccttactcgtaccagttgactctgtaaaattttaaaactgtatgttactctttactcctaagataatgggtctttaaatattcagggtaccatagtaagttgccagatatttttttgcttctgggcaatacatatttattttgaaatggctatttttaaataagtgatacttcccttattcagaagctgtttgacagctttagccaactaatttagttgtaaacctgctaaaagttacatattttattgattggagagtgtctttcttaggacatatttacccttttttttttaaacataaagtaatctcatgaacttcagttatctgatttttctagcctactatagatacattttaaaggatagtagcccagtgtcatctcccaaacatagctaaaggttaagaacaaagagaaactaggaaaagaacctctcaatgcaaggactttagcataacagtatgggaaattttctacagcaaaaaataagtatattccttatttgttcctaagggtatccttgtattttgtagtacagtatagcaactattattcataatgatgacccagcatcaagaaagggtgtagttggctggatgcggtgggtcatacctgtaatcccagcactttgggaggccgaggtgggtggatcacctgaggtcaagagtttgagaccagcctggacaatatggcaaaaccctgtctctactaaaaatacaaaaattagccgggcgtggtggtgtgcacctgtaatcccagctactcaggaggctgaggaaggagaatcgcttgaacccaggaggtggaggtttcagtgagccaagattgtgctaccgcacaccagcctgtgcgatgggagcaagactccatctcaaaaaaaaaagaaaggttgaggccgggtgcggtggctcatgcctataatcccagcattttgggaggccgaggcgggcggatcacgagatcaggagattgagaccatcctggctacggtgaaaccccgtctctaccaaaaatacaaaaaattagcttggcctggtggcgggcgcctgtagtcccagctgcttgggaggctgaggcaggaggatggcgtgaacctgggaggcggagcttgcagtgagcccagatcacacccctacactccagtctgggcaacaaagcaagactccgtctcaaaaaaaaaaaaaaaaaggtgtagcatgtttttttagtattctgcttaagaatgtaggaaaaaaactaacacacacacacactacatttataaactttgaattttagttttgtggcaattcatttaggtaaagtgtgtgtgtgtttttttttttttttttgtttttgtttttggagacaatctcgctctgtaacccaggctgagtacaatggcatgatctcggctcactgcaatctctgcctccctgttcaagcagttctactgtgttagcctcccaagtagctgggattacaggcacgtgccaccatgcccagctaatgtttgcatttttactagaggtggggtttcaccatgttggccaggctggtcttgaactcctgacctcatgatccgcccaccttggcctcccaaagtgctgggattataggcgtgagctaccatgcccggcctatttatttttacattaaaaaaattaagttcctgttgtgtcagctgctgggcctggtacctttggatatacagtatttcatttaattttccacaattctgtgagtgaggtaatgtcccttccctgcatcccctccccctttgtttagagattaagaaacaggctcagatttagccaggtgcggtggcgcatgcctgtaatcccagctatataggaggttgaggcaggagactctcttgaactggggaggcagaggttgcggtgagccaagatggcaccattgcactccagcctgggcaacaagagtgaaactccgtctcaaaaaaaaataaaaaattaaaaaagaggctcagatttaattgatttataagttgactatttttttttttgagagagtcttgctctgtcacccaggctggagggcagtggcacaatctcggctcaccgcaacctccacctcccgggttcaagccattctcctgcctcagcctcccaagtagctgggattacaagcgcccgccaccacgcccagctaatttgttttgtatttttagtagagacggggtttcactattttggccaggctggtctcaaactcctgaccttgtgatccacccgccttggcctcccaaagtgctgggattacaggcgtgagccaccatgcccagcctataagttgacttctttaagtcatgagttttccagctgtttataatatattgccacttggtttatccactgataacctcaaatttagtgttttcaaaagtaaacttactaatagtgtctttcattacaaaactgattcctgctgtcctgtgtttcactttgccattaatagtatcaccgttggctgggcgcagtggctcacgcctgtagtattttgggaggccaaggtaggcggatcacctgaggtcaggagttcaatcccagcctggccaacatggtgaaatacaaaaatctaaaaatacaaaaattagccatgcatggtggcaggcacctgtaatcccggctgcttgggaggctgaggcaggagaatcgcttcaacctgggaggcggaggttgtagggagccgagaccacaccattgcattctagcctgggcaacaagagcaaaactccatctttaaaaaaaatatatatataagtgtgtgtatatatatgtgtatatatacatacatatatatacacacgtatatatacatacatatatacacgtatgtatacatatacacgtgtatatatatacgtgtgtatatatacgtgtgtatgtatacgtgtgtatatatatatgtggtatcactttacctgtctgagaggctaaaattaaggtctcagactggcaacttcattcatgtgttcatcttatttttaaatttatttgtttttaagctacagggtctatgtttgtcacccaggctggagttcagtagtgtcatcatagcttactacagactcaaactcctgggctccagcaatcctcttgcctcagccgtcaaagtagctgggactacaggctcgtaccaccctgcccagctaattttttggtgttttttgtagtgatgggggtctcactatgttgcccatgctggtctctaacttaactcctgggctcatgtgatcctcccctgtcagccttccgattagctaggagtataagcacgtaccaccatacctggctaatgtttaaaaattttgtttttgtggagactgggttttgttatgttgcccaggctggtctcggactcctggcctcaagcaatctttctgcccttgcttcccaaagtgttgggattaaataggtatgaaccactacacccggcctcatgttcatttgtagtctactgtttgctgggtactcttctgtgaacaaaataaacaattcctgctcttacggagcttgcactgcagtaggagataaaagtaaaatacatagtatattgcatggtgggaatgttaggagtaagtggttgtaaataggatatcccagaaggcctcactgagagggagacattggagcacatatactttgtttacacttagaaatttagagcttgaattagaaattagaagattgatttggagatctgcttttttgttttgtcatgaaaattagacattgtagcaacgttggagctttctactggctctgccaggtctgttcagctgtgaaggcctgtgagggctctgtttaatgtcccatgattcatgtggctgttatcttagttgaggtcttgaatatttctttcctactcttttgctttaactctgcttattcccaccttcagccagtcctacacaccacagttgggttatctttgtaaagcacaggtagatgcactgtgcatggaatactgtttccctgtttgccagataaaatccacacttcggagccctccgtaatctggtcttggcctactttctagtattccctagggtccactcatcaaaataaaaatgtattgttctcagtttcctgaatcagttctatactaaatctttgcattaaattccttctcccacctcgacatgtccaaatcacactctgtttaggacattttgtaagtccttaccttccatagcagaccatccctatccctccctccgggctggaagaaatctctcctactctaagctatagtattactttatgcaaactctttctgtacttcttaatgaacagatctcgtgttcccttgctagacttcaaacttctggaaggcagtctctgtgtaagagtagtttttgtggctgggcgtggtggctcatgcctataaccctagcactttgggaggctgaggcgaacggatcacttgaggtcaggagttcaagaccagcctggccaatatggtgaaactccgtctctactgaaaatacaaaaattagccaggtgtggtgccaggcgcctgtaatcccagctactcgggaggccgaggcaggagaatggcttgaacctgggaggcggagattgcagtgagctgagatcaggccactgcactccagccttggcgacagagtgagactccgtctcaaaaaaaaaaaagggtcttgctatgttgcccaggctggtctcaaactcctgggctcaaaacaatcctcccacctcagcctcctgaagtgctaggataacagttgtgagccactgcaatggtccctaaatctttatacatatggatttcatcactgatagcagcccacttcccattgtcttttctcaatgccacttttctttttttctttacttagcaaacctttcccaagataatgctcattttctgaatagcttttatttctgccattcaatttctcttttgaataaaaggcttccccctcttcatttgaagaacattaaaaacccttaaaaattttttcagcttcttatttcaatcaggagcctttctgttggacatgaccatttttccttgtagtttaagagctttggttagcatgttgcctagaggctgtttgtcatggatatacagacacatgcttgtcttccttccatgtgattgtatttttcatagacatccttatgaaaccacttgaacttgtttccttcagaatgttagcagagtatgcttctctttcaatgtaaagtctttggtttttttgtttttgcttttgttttgttttgttttttgagacggagtttcattcttgttgcccaggctggagtgcaatggtgtgatctcagctcaccgtaactttggctcaccgtaatctccgcctcccgagtagctgggattacaggcatgtgccacaacgcctggctaatttcgtatttttagtagggacggggtttctccatgctggtcaggctggtctcaaactcccgacctcaggaggtgtgagccacctcacccagccagtctttgctttcttaaatactggatcacttgctattttttgtcttcttcaaactgtcgcacctcaggaaaacttaacattgtttcataaatgttcaagagaggccaggcatgggcctcattaatagtatcacctttagctgggcgtggtggctcactcccataatcccaacactttgggaggctgaggcaggtggatcacaaggtcaggaattcaagaccagcttgaccaacatggtgaaaccccgtctctactaaaaatacaaaaattagccgggtgtggtggtgtgcacctgtaatcccagctactcgggagactgaggcaggagaatcgcttgaacctgggaggccgaggttgtggtgagctgagatcgtgcgactgcactccagcctgggtggcagagcaagactccatctcaaaaaaaaaaaaaaaaaaaaagttcaagagagctctagtagctaaattctagttctagttcttgttcttagctctagtagctaagctttatgcctctacaaagctaaacttttgatgataactatgttattaggttttaaagaacttttactgtattatggaaaacttaaatgtaaaacaaaaatagtgagaacagtgtaacaaatcatgtgccgctgggactcgatcattaacataggattcaatcattaacgttgctggccctctactgtttcttctacacctcttctacccacactgggttatttactagcaaatcctagaaacatttttattagtaaatatttccatttatgtctctaaaagagaaggattccttgtaaacatatcccccccaaagcactatttttgtgatacttacatattaatggattaacagacatatcttttttttttttttttttttttttttaccaaaaaacaaaaaaccaggtagtgaaaattgccaagtttcttcagctttcctagtgtgactcatctccaggagagtaggaagcaggtgggtctgaacacagaaatccacacgacttgcttctgccctctgcacagaagcgcgttctttatgccaggacctcattcccttccacacagctcagggagggcactcttttattttatgaacttgttatcagtaaatttaggactcagtggtccctgaatccttggtccttgacctgttattgtcagtccttaaggcccagacattgcctttggcttcctttctggaaaatttcagaactgtataaaaatcacttgtaaaactctgacagacacattttgccaagaatgtcatttatctcttgacagtttggcatttgcctttaaatattagattgtgtaatcataatggcattccaggaaaataatgtggtaggtggctggcactttaaaaagtgaaatggacttgggttcttgggaatgttaatcattattctacacaaaatggtgataccccttaatagtgaaatgctaagtgggtataaagcagtatttgtgaataagatcaaaaaagatgagtataaaatgtgatttatgggtttatttaatgagtttttaccagaacaatgtctgaaggatattttatatttttaagctgtgaaacagagaaagtaatgaggaatcttctagtgagtcccaccagtctcccagcctgaccagcacatccagaaatcgatcattatttttgtcattttaacctgccttcttagtgccttccttgcccttgactttgcagcagagaggagaaagaaactcgtggtctctcccataaatacacgtggtaacagcagtgaagtaattattatatattttgtggcaagtcattcattcagtggtgatggaatggcttatttttaatgcagtgtttttctttggactaaacctaaattcttttttctatctcatttagtgcctgtccattccaaggcagcataaagttagcatagcttctcattttactggtttggtaaaagttttaaaggtttagttcagtttgcttttgggttttcatatgaggtagactatgagaactctttaatttatgatgtgatatataattaaagacaatcccattgtagctggcatgtgggctattactggggatcatgggaaagagaaggcttggaggatcttctttataaaatacacgtaagtatggactgaattccaaacaaaccgcaaaatggaaggaacctcgttttatcgcatccaggtaaaggatagaaaaggtatcttcagttttcccagaagcaacatccacaaggacaactcgtaattttaaatgattaaaagtaattgcagtagatcagtgtcattcatagcaaattagttctgattgatggagaatgctgcatctgtggatttttatgttataaaattaatttaagacttcttttgttaaactcgtttaatcttctgcactactccgttctttcattatccttgtcagttttaagggctggaatatctttgtacaactaaattcagttgacttcttctggatacccaagttgaacagacacatatattagtggagctctggttggaaagaggacaccagtacacactattagtagcctactgcatgtggtttgtgttttttgcctttttttttttttaagagaagttctctctctctcaggctggagtggagtggcacaatcatagctcactgcagcctcaaactcctaggctcaaacaatcttcctgccttaggccttccaaagtgctgggattataggcatgagccagtgcagccagccacctattgtataaatggcttataagtcatttcacctggctaggcatggtggctcacgcctataatcccagcactctgggaagccgaggtgggaggatcacttgagcccaagagttcaagaccagcatgggcaaagagagagaccctgtctctacaaaaactaaaaaaattagctgggtgtggtggtgcctgctgtaggcccagctagggggaagtagaggtgggaggatcactgggaggtagagactgcagtgagccgtgatcatgctactgcactgtagcctgaatgacagagtgagaccctatctcaaaaaaaaaaaaaaaaaatagtaattcgttgaaccagtttcttattgataaatgtttagaccgtttccatttttaaacttcaaatattccaggaaacatatatgcagatttatcagaaacacttatttttgtaaactttttattaaagaataacatatatacaaaaagtagagaaattttttttttttttttttgagatggagtcttgctctgtcgcccaggctggaatgcagtggcacattcttggctcactgcaagctccacctcccgtgttcatgccattctcctgcctcagcctcccaagtagctgggactacaggcacccgccaccatgctcggctaattttttgtatttttagtagagacggggtttcaccgtgttaaccaggatggtctcgatctcctgacctcgtgatccacctgcatcggccccccaaagtgttgggattacaggtgtgagccaccgcgcctggccaaagtacagaaatttttattatttttttatttagttttttgagacagagtcacactctgtcacccaggctggactgcagtggtgcaattttggctcactgcaacctctgcctcctgggttcaagcgtttctcctgcttcagcctcccaagttgttgggattataggcgcataccaccatgcctggctaatttttgtagagaaattatttttgtagttcattgatgaaatctgtaaaacccatacattatgtgtatcaattcattcttttttctttttttaagttatatttttttgagacggagtctcactctgttgcccaggctggagtacagtggtgcaatctcagctcactgcaacttctgccttccggattcaagcgattctcctgcttcagcctcctgaatagctgggactacaggcacccgccaccacgcccagctaatttttgtgtttttagtagagatagggtttcgccatgttggccaggctggtcgcaaactcctgatctcaagtgatccgcctgccctggctccccacagtgctgggattacaggcgtgagccactgtgcccagcctatttttcttttttaatgctttgtaattttcttttgggtgactatactacagcttattctttttgccattgatgaacgtttggattgtctctaatttttggatgttacaaatagtcctgtgaacattcttaaacatcggtttcggtgaatgtaactatccatatgtattgggcgtatctccgggagtagcgctgacaggcatagggtatgcatatgtgcaggtttagtactgccaacagtttttcaaagtgggtgaaaccatatcacactctcaccagcagtgtctatttttaaaaaaataacttcatataagtgaaatttgaataaaagagtaaattcattttaagttttggaatatagtgctggatttgtcctcagaagtactaattcgtactccactgaacactagattttatccagctctttcgttgttttcattgtttatagtgaagaaatatctttttaaacttctttaatgaattggacttttttatacttcagttttacccatttccgttttcttgacttggatgttctggctttttctttgttggggtatttgtatttttttcttgctgctttgtaataacttatttttaaaatccacatttttgtcttcctagtttatcatttgtcttttacactatggaagtgttttccatgtctgttttctttaagggctgtattgttgatatttaattttattttaactggatttgcctttttttacgtgacacaaggatgctttttttaaaaaagttttaaaacattttaagcatgttatgcttttacttattacattaacgttaactttggaatattttgcaggatgtcagagggtgactggtcagagtaggcatgcatgtgtcatttgaccaagcaagaaataaagccagttttcctatgtggacagtattgaatcattttagtgtgcatgtttctaaggtagtaagttatcgtttagaaaagaattagatcaaattagcctagactgaactatcttatttaaatatctcttgtggatactcagggctcttgagcaaggactttaccaaaattacacctggcctcttgcagtcagttctgtgtctcattggacacgggcttggagtgccaaatatttaatttcaaatctttaaaaatatttattctctatgagattattaaaactttttaaatgtttctgttttgtattaacagtatataatttgcactgctgatggagaaatatgagaccaatctattgtgttttcctttttaatgttacagtgggatttgagagcttcccaaagcctctgtcacctaaaattcctactgagaatcatttttggattttaccgcaaagcagatacatagaacagattttaaacgagtagtcctctcttctaatatgaattaatttggtttctagaattgaatcttagcaccttaaaggggcaagaatctcaggggtaggtaagttttagaggaagggagcacagccatgttacccctctgtgattagagccctggagcataccaaaccttgaggcaagtctgaagaaggtggagtttggggggcagtgaaaacagatgctatggataagatctgaaaaaatttttttttgttttgttggtcttttgcatttggcagtactgcttgtggcaaggttgtatcattaactgtgttgattattccataagccaaggagacaattgtgggaactctccttagtaaatccctcgttttaggagcatagcatttccagtttaggggaatttgtattttgctgaacatttgaatttgactaaagggaatactgggtttatatgacaggctcattagggatagattgaggaggagagggtagaaagggagagaaaagctaaaattaagcgcctatttttcatgtatattttttattttatttttgagactgagtctcaccctatcacccaggctggagtgcagtgatgtgatctcggctcactgcaacctccacctcccaacttcaagcaattcttttgcctcggcctcctgagtagctgggactacaggcatgcatcaccatgcctgggtaatttttgtattttttagtagagatggggtttcaccatataggccacgctggtctcgaactcctgacctcaggtgatccacccgcctaggcctctcaaactgttgggattacaggcgtgagccgctgcgtctggccagttttttatgtatataggcaaaatgcagtcttacacattttacatgtttaacctgtctaatcctcacagaaatcctatgaaatgctgttttcccaatttgcaaagagaaaacaaagactcagggagtaaactgacattattttggctaggctcaaaaactcagtaaatggcattcctgggatttgaacggccgtctctgaatccaaagctcatgcatatcttcttacaagagtatatattgcctcctcctaaactaccagaattattatgtatattttatcaatgtcatgccaaattttggtaacactttaagtggcatatgcctggggtgttattggtaattctgccagatactgtaaagcctgtgtaatttcctttaccgtccaccttagcatcgagagtaaacatgaggttacgatcctgggaggacttaatgaatttgtagtgaagttttatggaccacaaggaagtaagtacatgtgttggtatgtgttcttctattacagtcttttactctgtttcttaatagaatatcaaagacagatggtagcatgcgtagtttctgaaaagcaagtttagttggactgcagaaccagtgaggaaatctttctcttatcacaatcactttatatacagtcatcccttgatatctgtaggggattggttccaggaccacctcataccaaaatccacagatgctcaagtccctttataagatgacatagaatttgcatgtaacctacacacatcctcccatgtcctttaaatcacatctagattacttgtaatagctaacacaacgcaaatgttatgtaaatagttgttatactgtattttatttatttatttatttattaagtgatggagtctcactctgtcacccaggctggagtgcagtggcacgattgtggcttaccgtaacctccacttcctgggttcaagcaattcttctgcctcagccttcgaagtagctgggactataggtgcctgccaccacgcccagctcatttctgtattttagtagagacagggtttcaccatgttggccaggctggtctcgcactcctgacctcaggtgatccacccgcctcagcctcccaaagtgctgggattacaggcatgagccccaccgcacttgtcctttttggtattttttttgtgttatttttaattgtattgttatttattattgtttggatttttttctctaatatttttgatctgtggttggttgaatccaggggtgtggaacctgcagatatagagggctgactgtagttttctctttatctctatgtgacagtactagacatgaattgtaaattctgggttttgttatggatggccacgtgaatggtttccaggaaatgttttttgttgttttctttttggccttggaggggggatgaatatggggtttattgagataggagggaaagtaacatggctattacttaccaaataattgaatagtgtttagtacttttgaagaatcaagtaaattgcagaatgaatctgcttattttttaactctggatctttccaagaaaagtatcttaatctgaacgtggtacacctattgattgtagtaggtccctgactcttgaaggaattaatttggaaggttttcagaagattaggggataatgtttaatttacactcagatttattttctaatttggagatgtagttctgatgaacatttttacttttatttcagcaccatatgaaggcggagtatggaaagttagagtggacctacctgataaataccctttcaaatctccatctataggtatgttactacttggtttttctccttagagagttttgaaatctaagggggaaaaatcttacatttcaggggaggtaattaatgccagaaatggctgtctaattgaatttttccttttttggctttggttaattaatcagtgacttttggggggaacttctatagtgtgttagaagacgtttaaatatactctttgcataattataatgaccattactttagatttttgtcttttggtgtcagattaaaccagctttaaggccccactgttctttaagctgttagcaggaaaataataaacatatcttaagtctaattttgaatgccagattgcaagaatgaatgttacatagtatgtgttttaatcctatcattttcagaaattctccctagatcctactttgcttttttgttcactccaactctgggtaccttacaattaaatgaccctttgcagtcttcccacctccagtctctttagccccctaaacagcagaagaaagaatagaaacctcagtggggttgtacaaagaggtactttctcctcaccttcatctccttttaccttaatgggtgatgttatttacctgtcacccccattgaggcactcagtgacagatctatctgattgaaggtggacacctttaaatatttggagactgtagaatggtagtaatttagttaatttaagccagctttttttttttttgcttcactttatacatgtctaaaatattataaaatattgaacaattttaagtaagaacaataaaattgtaatatattgagcattctctgagaatcagactaagcctcatgttcagaattgccagagttcaaacattttgctactgctgtgggctttttttttttttttttttttttgagacggagtctcactctgtcgcccaggctggagtgcagtggcacgatctcgactcactgcaaggtccgcctcctgggttcacgccattcttctgcctcagcctcccgagtagctggcactacaggtgcctgccaccacacccggctaattttttgtatttttagtagagacggggttccactgtgttagccaggatggtcttgatctcctgacctcgtgatccgccagcctcggcctcccaaagtgctggaattacaggcgtgagccattgcgcctggctgctgtgggctgtcttaagaagtaatgcccgatatcctggagtctagaccactccccactacacccccactcctaaccagttgaatcagaaatttctttcttgctataggggcctctaagtttcagcgttgtgaatggtaaagtgggagtggagctgtgaggtgttgagcctttgagacagcccccgagcacatctgacttagcacctgtataggtgtagaaacgtatacgcctgtacaccttctccttttgagagggcttttctgttgtgttgtggttccctgtccccagtttattcatcttctaactttagggtgtttctgtctactcagccatttaaaactcttatgttggttagtgataggactttaaagcctttatagaagtccatgcaagttcattcagatacatttcataaatacctgtttacctaaaggctaaaaactggcatgctaagtctagttttgttaaccccacattcctagtcagaaaggaaacaatagagcttgttgaaactaagagtgaacttatagaaatgcaatttcatatcctgtagaaatgttatttctcagaccttaatgtattttttctagataatatgattatctcatcataactttctaggtaataatgtctaaactttaggcattgcttgtttattaactaatgacacaaaaagcctccacgctttcttaaattaatgatgcaatatgaaatttggttgggacaaatgactaagctaatttaacttcttcataattgtttcttttgcctttctgtgtgctttcaggacttgataatgcctacaaatgtgtatcatcttctgtttggaaagtagatttagctgaaatatttgtacaagctgttcttgtttcctctagaggaaggttgcataagagagtttcaatcagttgtgcggggtgacccattttcaggtcatcaacagtgtaattactgttgagatgtgctttaagcattcagaaaggttgtggctcacttagaaaaggcaaggattcctttttgagttgtgtagatagttgtaaaattatacagaagggcgaggaggtaagatcaacccaatctcaacattctttttaaatcttgcccctgttgtatctgggtaggtgtagtgttcttcctgagccaaattttgagcttttaaacaatcagctgtgcaaatttagatcaaacatctttaatgcttggctcttggaattttgcagtgtctatgtactttgttctattttgtgtgtttgtgtatggatgtgtattttaattgtataaatgacccatatccattagagcaatgtaagaaaatctgtaagccaaagtaaagaaaaatcaaaatgtctcataatcttatcccttaaagggtgtcattatttacattctggaatatgctctttaagacatttctctctgaatatttaaatatatatattcaatataatgtgatatgcttatctttgggacactctccaaatatagttttagagggctgtcagtagttacatgattgcatgagatgtccctttaaaacaatttgcatctataaatgagtgggtattcgaaatagtggcatagctactttttggaaagaaaaggaatataggtagacaccttgggaggttatgaacttattcttatgatgccattattgtttcaaacactttgagctcttttttttggaattttacttctgtttcagtatcataagtgatggcaaatcttgatgctttgaagctggatgtgaatttttgaaatggctaacagtcatttaagcccaaagaataagatgaatggaaaaacgagtaatatcaattggggtataaaaccggccctctaggcactttgaaaagagtaaaagatataaaactcctttaatcaactataacatcgctgaatatttgcataattttccagagagactgctttgagatgaatcatatttgaatctttttctgatttacttgaaaattcagactttcatatttttcattcagaaacattagttcctagagtgcttagcaatactgctgggtgttactgtgtaggagttaggagagtgtgattggtcagtggactggttatcagggtagagaagttctggccctggttctccttgaccatgagagagatatgcagctgacccattgttttctctgctagaaaatgagatactagaattaaacagattctgcatgtttgatatgaccagtgtattaaaactcggggtacctggcatcctgctggacatgacgaaggctacagaagatctttactggttaggagagaagaagaatgtaaataaaatactacgtgtacttaatggcatggttccattgttttttaggagaggtgtgagtcagcacctcaatttagaagagagagcgtaaggaagacataagtttctacaagagagattgtcttcacaaaagcttcagagttgttgaggtgtgcatgaggactttagagatactcattcagaaccccaagtaatccccagttcatgaagattttgttttatgcaaagaaattgctgcagagactgccatagctcacacttctcgaggttcacagtttttagcctttgatacttgtgctcagctgttaagtgaaagctttcaccaaacagacttgcagttacagtgtgggtgaaataaagatgaatgatctcatagaagagggtaatacagagtaatttttaataaaaaaaaataagcagaggatacaaaatggttttatgtctaatccaaaagaatgcagattaaaacgaaagtacagtatatgatttgtcaaactggcagataaaacagtgttagaaaaggtattatgatacagccagtctaccactatgtattgcttggtaaatattttatatccttcaaataattttatttaaaaagttaaaaattatctaaagaaatatttagaaatgtgcactgtcaaaagaatacgtaaattttagtgttataatacttaaaagtcagaagcaacctaaatgacccagtcggtgataaagtagctaagtgatagtgcatcttagtggataaaatgttttacccattagtcatgttttaacacctctttgaagggacacacaggaaaatgttttttatatagtacaactctaattttttcctatacatttcacatttgaatgccaaactattgatgttatccatagctgttcagttaaaggagactaaaaacatacttttctgtaatttccaaatagtctacaatgtttgcttttattataaaagtaaatatttttaatcatattgcaaatgtatgtcttttgactgtcctgtctgtatcattgtctgagtctacactttgctgtcttttgctctagaaagccatcaggcttggccagaattccctgtggtagcttgctcaggacctgcctaacccacgtgtttcccagcagcctcccttcttttttcctttaaattttaattatgtgtgtgtataagtgcacacactgttttccttcctttgttttctgcttagagtttagagtttagtccatctcagatactgtctttacgcgcaactttcttcacttctttcttccccctttttctcttctcttgggtggttacctcaagtacttctcacctttttcttttctgcctgactcttccacttcccccttccgttgttgcatttttctcttcatatgaactgaaaaatgcccctctttagagctaataatcataatggggatacttttgataagcctaagccaagggaaaaaaaatataaaagtcttctaataaaagatacagggccgggtgtggtggctcacgccagtaatcccaacactttgggaggccgaggcgggtggatcatgacctcaggagattgagaccatcctggctaacacagtgaaaccccgtctctactaaaaatacaaaaaattagctgggcgtggtggcgggcacctgtagtcccagctactcaggaggctgaggcaggagaatggcgtgaacctaggaggcgtagcctgcagggagccaagatcgtgccactgcactccagcctgggcaacagagcgagactctgtctcaaaaaaaaaaaaaaaattatatatataaaaaaaattaaattcagggcttatagccactaaagatcttgcaacatccagaagttctcttctggatctattatattctccttcatatcatatctactttacttaaacactagcattccagataaaattaagatgtcattttatcttacatttaaatgattattggctactattaacagaattgtatcctaatttcagatagaactatagaatattttagaatcttttgtaaataactttaagagcagcctaggaaccctgtcatcatttatacttcttaaaaattagaaaactgtgttataaggtacaggtaacaagtttagaaaccaatttgtgaaatgctaccgatctatatctacatattttcagtgaggaggaccctctactaggagcaggctgtatgcattgcctctgggttgcaatttgatgataccaaagctgggaaggtaagagaaatggttgagaacaggattctggagggactgctgaatggtttgctgaatgttggtagaatggtcaggtacaaaaccagcaagctcgtgctgccatagaacttgatgtgaggccgagcgcagtggctcatcctgtaatcccagcattttggggaggccgaagtgggcacatcactggagacaaggggtttgagaccaccctgagcaatatggagaaaccccatctctaaaaaaaaaaatacaaaaattagctgggcatggtggtgtatacctttagttccagctactcgggaggctgaggtgggagaatcacttgagcccaggaggcagaggttgcagtgtgctgagatagcatcactgcactccagcctgggtgacagagtgaaaccggtctcaagaaattaaaaaaaaaaaaaaaaaaaagaatttgatgttagtggcatgaagcaagaacttgccaaacccatttgagtaaatggagacaaaatgaaaaagtcatgggcaatacaatagttaaaatactctgagctggctgggcgtggtggctcatgcctgtaatcccagcactttgggaggctgaggcgggtggatcacgaggtcaggagatcgagaccatcctggctaacacagtgaaatgctgtctctactaaaaaatacaaaaaattagctgggcatggtggcgggcgcctgtattcccagctacttgggaggctaaggcaggagaatggcgtgaacccgggaggcggagcttgcatgagccaagatcgcgccacggcactccagcctgggcaacagagcgagactcttgtctcaaaaaaaaaaaaaaaactctgagctatattaatggcctttaaaattgggtcaaactatcaggatggtttaggttgccctgttccactagactggacagcctgtcagagttcctcttaaatctcccagtctggcatatactctgataaccagtgtgccataattctttttttttttttttttttttttttttgagacggagtgttgctctgtcacctaggccagagtgcagtggcagcaccattgcagctaactgcaacctctgcctcccgggttcaagcaattctcctgcctcagcctcctgagtagctgggattacaggcatgctccatcatgccctgctaatttttgtgttttttagtagagacggggtttcaccatgttggccaggctggtcttaaatgcctgacctcaggtgatccacccaccttggcctcccacagtgctgagattacaggcgtgagccaccgcgcccagccaatatatatatatatttttttactcatgcaagtgataaagggaactgcattaatctttttcattgtcagaataatagactgttcaggcattatacattttttatttcactctggccagaaatgacctcacactatttttggagtggaggtttataatatggcatgactaaactacctatagaacttagaatacttaccattttatcttatgtcttcctagatggaatcattctagagttactccctcaagaactagcatgagtaacttcattgagcagtatttaagcagggatgggccagtatttgcagtagagaggagtttgtcattcacaagaggtttcaggttagtcatttaacaaaggcctacttgtaccactgtattttcacaaataaaatgaattctgtgactgggcacgatgactcatgcccgtaataccagcacgttgggaggccgaggcaggaggttcacttgaggccaggagttcgagaccagcctcaccaatatggtgaaaccccgtgtctactaaaaatatatatatataaaaagtagccgggcatggtggcgcgtgcctgtaatcccagctactcgagagacggaggaaggagaattacttgaacccaggaggcagaggttgcagtgagctgagatggcgctgctacactccagcctgggcgacaagagtgagactccgtctcaaataaaatgaattttggggctggggaggcaaaattccattcagatcacctgtgtacttctctaataaccgtggttatgactttagtcctgtcccaaacagttacataatggctactctgtagtgatctatatcttttttttttttttttgatacagagtcttgttctgttgtgcaggctggagtgcaatggcacaatctcagcttactgcaacctctgccccccgggttcaagtgattctcctgcctcagtctcccgaatagctgggattacaggcatgtgccaacacgccaagctaatttttgtattgtaggagagatggggtttcaccatgttgcccaggctggtgtcgaactcctgacctcaggtgatctgcctgccttggcctcccaaagtgctgggattacaggcgtgagccaacgtgcctggccaatgataagtatcttttgaattccagtagagagaaacaaggttctagtaagtaaggaaggttttgtaaaaaaataaatagagataatgctatgagaatataagccattgttaaaagctcttttactggtgttctgaaaataacatttttcaaaaattatgtctggcagctgaggctttggctgtggcatacatcatccttccaatcagtttcacaaagttattggatacctactgcgagctgggcgttattctgggtgctgtagatacagaagtgaacaaattgctctcttaatactttatgttcttttggagtgcgaagataaagcaaaatttaaaacttctgatagctttatgcagagaattaatggatagaataggtaccttggatcagatattcaggaagggtctgacaaagtaaatttaagctgagacttaaaaagattaaaaacaaaacaaaacaaaaaccagccctgatcctccaaaatcaggggtaagagctttccaggcagaagaaattttgagtacaaaggccccagcctggaaaactgggtaaaatgtgaggtgtgtgacacacgggccaagtggcaggcagggttgagttcacagaccgctttgtaggccaggttaaaggctcgactttcattttaaatgtaatagaaagattacatagttttcagcaggggagtgaaaggtctgattttgtttttttaatgatcattctactgctgtggggcaagacacagtgacgggatagaagcacagttataaaagcttttgtagccggagatgctggtggcttggacaaggctgccaaggtcaagaaactttgttctagacatacaccgctgtgaagacatgtggctccattaaggaaatcatccaagctggactgcagtggcataatcgtggctcactgcagcttggacctcctggactccaggcatgggccaccacgcttggctaatttttttgcattttttgtagccatgggtttcaccatgttgctctggctggtcttgaactcctatactcaagcgatctgcccacattggcctcccaatgtgctgggacagcaggtgtgagccaccatgcctggcctgtttttaatttttaaatggaagattctgaaggattttaaagtgcttattgtagagagatgtttagaaaagggagagcttggtgatgctggagttgggaagagaattgcaggagcaccaccatcgagaaggaaggagggagcaggatcagaacccagaggcctggtgtttgagaagaggggaacatgtgtgcaagctgttgaggcagggagaaagagtatgtgtgcagggaggagtttagaaatttttatggaaaatgaagaatcctgccaattggctttcatcttctcaaagaaaagggacaaggctatttagtgaaagaactagaggagagagttaggggaacaaagggagagaaagaaagtagatttgcaggattgtggtaaaatgtaacagtcatgggagactgggggagcgacccactagagaaaggggaagggaagattgtaggtgatgctgagtccaagaaaggctgttgagcatgtttagataaactggtatatatttgtttacttatgtctctcctccctgccagctcagtagatgtgaactccatgaaggcagcccctgggtctgttttgctaccaccacccctgtcctcccaaatactcactactcagggcctgatacagtgccctttctgcagaagaatattcgtgtgagtgaatgaatgcctacctactggtaccctcaagtccaagttgagcaaatgtgaatgatgcttcctgtggtagctttgctagatgggcattttggaggggagaggacaggggatttgcagaggattgcttgagagtgaggatggtgatggctcttaaatcttaagctgagtaagaagccagtgaagataagagggctggtagttgggaagaaaatgggagaatctgtggattacagttaacaggtgaaagaattaatgattcctggggtgggaagcttttggcaaggacaggggattggtaggataggagatgtctaaatttgtgattgtggaggtaaatatgtaattgtggagggaatgacaaaggtcagggtatgtcctggggagcatgaagtggaatggaatagaaggtcactgaggagaagcttaagaaacaagccgggcacggtggctcacgtctgtaatcccagcactttgggaggccgaggcaggcggatcacctgaggttaggagttcaagaccagcctgaccaacatagagaaaccccgtctctatactaaaaatacaaaattagctgggcatggtggcacatgcctgtaatcccagctactcaggagactgaggcaggagaatcacttgaaccccggaggcagaagttgcagtgagccgagatcgcgccattgcactccagcctgggcaacaagaatgaaactctgtctccaaaaaaaaaaaaaaaaagagagagagagagacccgggtgtcaggagtatggtctatattgtcaccaaaaatgacaggagttggggcagagagcaacttgggggccaagccaggtgctgaagttctcagtgagagaagccagtggtcaaatgggcccttttaatgtgaaacctgctgtgagcaggctgtaatgtctaaattcatttaccttcatcttgttattagccagagtaaaaatagtacagttagctttcccaccccattccccaggctgccacctctaaggataaccctgcttttgcatatgcttgttactatcagaggacttgtccatttctttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacagtccatttctttcttgaagttgacttatgccagttttaattctgcctttgacagctcattattatataatcttttcatttgctatttaaaacttccatcacacttgctgcctaggttagttcctactctgtattgggtgacctctagcttttgagctggttattctgacatctttttggcattaaatctatttctttccctttaggatttggtgtcataatgaaaacaagtatttttggcttcctttttctttaaactgaaattcttttgaaaacaacaaaagcaatgtcttagttctttttagaaacctgttcacagtttgagatttgcttatattcctggtgttggtgaaaactgtgttgttagtggaagtttagagattatgacatccaatttgcctgattttaaggatggaaaaaaatgaggctgagatgtatgactacgcactagttgcagagtccatcttctggcttccagtttagtgtgtgtgtgcttgttttttaactataccaaatgcagtcaggatgttttttttttttaatctaatttttgcttgcacatcaagaaaggatggtcttcttttttttttttttttttggttttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtaggatggtcttcttaataataaatatggggcacatgttctcaggacctcctggggctgtgtcacacaaataataaatattaaaaataaaaattataattgtattttccatttctagtgtgacagagttatgggaaacatatgtaaatcataatatcctctcatgttcttcacacttgtaagagcattaagagatggacacatagggtaaatattaatcagttttaggatgaagacagtaagatgaaattacttgttcatttaacttattaagctaattctaacattactgcatgcttactgtatgccagttactgttcaaatgctttacatatattaactcatttaatcttcacgattaatgatgtgtagataccattatttaacctagttttaggaataagggaacagaaaggcaaagagatgaagtagattgccccagaggctcacacagtggcatttaggcattctgactggagcctggtcctttttaaaaaatgtattgttacatcagttacacacatttttggggtacatgtgctattttggtacatatatgcaatacgtaatgatcaaaacagggtaattgggatatctgtcacctcaaacatttatcttttggagcctgatcttttaactacaactctaagagtggtagagaattgtagttgggtcttgtgagttcaagtccaatgtattctgtactgtattgtctctgaccatgaaaataagtactgcctgaacccaacagtgtggttatatgaacgacccagcgatcgaaagataaactatgaaaacaaaacagaagttagtctcccaaaaatgaaaccaaaggaaagtaggccagaggttttgataatccactaggttggtagaagggttatgctattgaaggataacacttcaccttttcttagttataaatgaccttttcttatccatctagcccattcctcagactctatattaccagagagaaaggaagaaacagaaaagaggaccccttgttgagtttagatctcctgaacacacacaggatcagttcagaagttcccatgacacagggcattgagagtgagctccttgcctggttcctcacccaagaagagacaggcccaggtccatctctcctgagtaggaaaggctcagatttctgaagagatttctacccgggcacaggctgcctcaggtggggcctggctgtctgaggttagatgaaaatctatcagattgtggactcctgcacatagctggccaatgtctgtcactagtggagctggcagcacccccccacccttactcaattggaacacccctactctggtcaccctgtgtgctaggaacagagatccaagttattacccttaaataatttatagtctgagatactgcaagggaagatgagattcagtctttaataagaatattttaaacaattatacctactgaaaaaatagaattaatcagtttggttgtgaacagtctactttatgtgggcagttgttctgaagatagacgatcagaatgacttaatgtattcacttaactgttttctcacaggaattcataagcttataatgcaattgcatcagccacagctgtctgaaccaccttagcctaggcttattttatccctgggatgtagctgctgttttggcctttggtgatcttcacccgtttaccgtagggtggatttaccttgattcacaagtcgtttgtctaacctctccttttgtcaagataattctgacaggtgaaatttctggtgattggcccaaagtatttcatctacccacaaatttgatcattaatatcctctcaaataaagggaacaaagatggaaaaataggtgaagcttggcctcatttatttacatattgaccccaatgtcagaagttactcagaagtgtgtgcaactctgtatagaccccttcctgggactggacacagaggctgaaataaaaaccagtttttcagcatgacttagcacaatgttatttattttcactgcctattagcctatgggtcatgagatttgttattctagagcagttgagtattggagtggaacaagcaaaagcaaggcatatttttctgttgtaatctgtactttttattttttaagatatataataatagttttacattaagtgtgatttggattccttctccagaattataaattacctaattcccttctgctaaaagacgcaggacagagaagggtaagcattttagctggacatttattcctgttgtacgatcctccccatcccctttaacgagtgctagaactacgccagagaataactgtccaaaaaacttaaggagttctgattttaatctggtcaaatcactgaaatatgttgttagaaaatgtctggtagtggccgggcacggtggctcactcctgtaatcccagcactttggtaggctgaggtgggtggatcacgaggtcaggagatcaagacgatcctggctaacatggtgaaaccccatctctactaaaaatacaaaaaaattagctgggtgtggtggtgggcacctgtagtcccagctacttgagaggctgaggcaggagaatagcttgaacccgtgaggtggaggctgcagtgagccgagatcgccactgcactccagcctgagtgatagagtgagattctgtctcaaaaaaaaaaaaaaagaaagaaaagaaaaagaaaatgcctggtagtgaataaaatcttaaatcatgaagattaaaaataacctgctacttctacttatgttgccataaaagcagttttcaaaatatgttctcttaaaatatcttgaaaatagttcctggtctaatggaaacaagtgttgggaaaattcccttgttgcagacatattcattaatgtgatgatagcattgccaaaaggaaggagaacatgccagggccaactcaacacagtcctgagaacattccttttccgaatttctggcccgttctttctctgtctcccccctccttgtccaggagttccattgttggcatcattatccagaatgtaaatggctttgccagaaacactgcccacagcttgtctaagaacaaatgtcaaggagatatgcttttttccatgtatttgctttggatatttttctaacaattaagcctgagggccaggtgcagtggctcacgcctgtaattccccacacttttggaggctgaggtgggtggatcacttgaggtcaggagttcaagaccagcctggccaacatggtgaaaccctatctctacgaaaaaatacaaaaattagctggttgtggtaatcccagctacttgggaggctgaggcaggagaatctcttgaacccaggaggcggaggttgcagtgagcaaggtgctgcaccaccacactcctgcctgggtgacgaagtgaccttatctcaaaaaaaaaaaaaaacacctagtattggaagagatcattttagtttagaaagtagaaagtttcttgatagagttggtctggttgtgttcatccctcaaaggcaaggttataaactgtttctgcctactttagaagagtcagagggtttgttttgtggctctttatggtattttatcatgttggtggttttgtattctctagaaaatttctgtacctaaaaatgctgccttacagaattaatttcctttaaggacttaactcttggatatttccccataattcctctgttctcagagtgcttgccattgttattaaatgctagatttttagagctgatagggccttcagaaatagagtaagagtggagatttgggagatcatatagttcaactatttgtcttcgtaggtaaagaaacagaccccacaaggtgaagtgacttgcccagggcctgcagttgattagttgaggctagaacccatgtccctgtttagtactttgctttgtggtgtgattctgccctctgtactagtgctcagatggtgttctgtacttagcaggggcactggagactgagctccaaaccatttattactaaagcgtatgtttaccaagtcctttttggttctgttatttattcctgtactcaactaagccaaatctagatttaattgaaaactgtatagacactgttaattccaagtgtgctctccaggtcatgtccaatgagggaggcaccttagtctttcagagacgttttgataaacatttaaagcttaccatagttatttgcttgacttaacacctttaaatgccccgtggcctcagatcgttgaagcataatgccctgtaggattcccattttgttttgcttgagatctgccattccccagcactcaggtgctgtgagctgattgagctgttccccaactagcctattttaggacacaagccatttgttaagccaagtatgtgaatatgtcactgttcaggcactagtctcagtggcccccccatctcccttgaataaaagccagtgtccttaaaagggccccaaatgctgatcacctctgtgacatcacttctcattttctgcccctttttcaaatcccttcagtttcaggaaaaaacttcagagcatcaggcaagctcctaatgtgctttgcacttggctgttccctctatagtgaccttctcctctcctcttggtaccaggtggctcctctttcacctccttcaaagcaagtcactttctcaggaagtcccttcctgaccatctcatttaaaattgccaccccgccccaacctttccatttctgttttcctcctttgctgtgtttttctccataatgctggtgaccttctaatgtaggacttattttttctaaagacctttccttacaggtatttccccttaagtcctgtgtctttgagtattggttttagtttaaatgaaaacttcccagtgcttctcatctgtagccagcattgggaacctttgccatagacgttgcttcattaggtgttagttttgagagttctcacagaggcaggattttaagtatcaagaacgtatttttaattcttaatagtagcttcaggcaatatttttcatatagtaggaccattctcttgcattaaaccacatagtggctcagcattgttccccactcatcagaaagcttccctgcagtagtgatagcagcatactcctatatataactgatcttgaggaccacgtaccttataacctgaggttcctctgattttagggggagggtaatgaatttgtattatttgaacaagagtgttaagatacgagatttcaaataaaatggttggttttactggctttttcttaaaatagttcagcactagttaatgcttgtgtaattcagtctattttagaatgtttgatactatgtataactttttttggaaacggagtctagctctggcttccaggctggagtgcagtggcatgatctcggctcactgcagccacctcccaggttcaagcaattctcctgcctcagcctcctgagtagctgggactacaggtgggcgccacatgcccggctaatttttgtattttcgttacagatggggtttcaccatgttggccaggctggtctcaaactcctgacatcaagtaatccgtccgtcttagcatcccaaagtgttgggattacgggcgagagccactgtggccagctgatactatgataactttttatttcggagtttttttaagctcaactattaaaattacacattgtagaaatgtcagagagccaaaagtgcaagtagaaataatgggagaatcttgcaaacatgacaaccatccacacctgttttcttctagccttttcccattgctgtgatcctagttctggttcaggtgtggtgaggtggtgatgagatttgaaaagtgcagcggagaaaatactaccaccactaagaattctacactgttaacatttgtacttactttcagtttcttatttatgtgcatatgttttaaacagagcaaataatatagaagcacattgtccctttttaaaaggaatatattaatagtgttaaagtctttttttttttttaaagacagtctcactccgtcacccaggctggagtgcagtggcgtgatcttggctcactgcaagctccgcctcctgggttcaagtgattctctacctcggtctcccgagtagctgggactacaggcacacgccaccacactcagctaattttttatttctttttactagagacagggtttcaccatgttggccaggctggtcttgaactcctgacctcaggtgatccacccaccttggcctcccaaagtgctgggattacatgcatgagccaccgtgcctggccagataaagtcatttttaaccactgtttcctcttctgttcccttttcctatcatgaccctggccctgtgccctaactgaaacaattacttttgcaaatttggtatatgttggttcagtacagttttcctatacttgttaccatggagaattggtagttgtttgttttagtttatttaaataacctcagcctgtaaatataacatcctgcaacttaaaaaaaaaaaacaaaactcagctttagatgtatacaagttgatacacatggatctacttcattacccttggctgtataggactcaggtagatggatgtactcccctttatccaaccctatcccattgacagggttgaatttggctgttggcttttataaataatattgcaacaaatactctcatggggcatctgggacatgtgtattagtatttttctaaagttaatgtagaatgttttttaccctaatttttctcctcttaataccaagacatgaacatttcccattattaaaatgtcttcataaaccacatgcttcttaaatctagactttgaaacatctttaatttccttaatgaaaaattaatattggacacaaagattttttttcatcagagtaacttaaacatcacataggccctcttgattgtagtagatagaacattatgctgtttcaacacagagcatttaaaaacaaaagttaaaagtgtgagtgactagagtggtctaagactggactacttggacttggtattcttatcccctgttttctacttcaggggaagtttctcaggtttttggagacaatctctgtagcgcctcacttgaggctcctcctccagtgccatttctctgcatctttcctgactcttcccattttactccgcctactgtatcaatactttattcagattgcaggtatttattggtgtctcttgtcccactgccacagtgacctcctcaagaatagtgaactgtcttatttttataccctatccaagcacaatgcctgcggtgtaggtgctgaccaaatatgttctgaatgaatatgagagagagagactgtggggatgggggtgatggaggatgggggtcggagatagtggtggtgatactcaccttaataaggaacttcagatattgaaagtgtggaacagaatgagtcctaaaaggaaatgaagtgataaggatgacaaaatgacacctttgacaatggatctctgctttagaatattgccatttgcatatatactgactgactgaataactggttttattaatttctccttgaagttcaaatggccatatagctattaaagtgtgtacttggtttgctaggaaaaattttaaaaacttaaacctccaacagatatagccaacttagagtattttttttaactccttgcttggttgccccaattttaatcaaaactgggtttccctgaatgagtagactaatgttaaaggaaatattttggtcactgcttttaggaaatcctttgtggtttgaagtggtattcctttagcatttcaacagtttcattcatgttccgtgcacagtgcagccaagtgataccagtaagtgagcgtcagaaggagaagttgaaatgcagaacctccagatttagagcttgaacaacaaaacttctgggagagtgaagtttcttaacttttatcatgacactggctatgaaccatttagtagtataatttatctttgagcagtaccttcatagctcagaaaacagttgctttaatgattgttttgtataagaagctgcatttctcccagtttgctcatttgttaatagaatgctgatgtattccaaataattggagctatcaggagaatataatgtttatcagtaatgaaagatctaaggttgaaagtagtgatttataagtattatcaccttttcccaatactgaaattgtttccagtactgaaatacttttattgttctctggatactttttgctgctaattaacatctctttttacaggattcatgaataaaattttccatcccaacattgatgaagcgtaagtaactattttaaaatgtttcaattttagcagcaactgctcatgattagtgtttctctgtgttataaaaagcctcggttatctttttggaccttatcaggaggtaggactgtatgaatggtcatgtaaatgatagaatccaaaggatatgaggttctcaatcacttagttcacattctgctgttgtaccacttatttttttccattgtcgtgactgggtccttcatttttcttgttacccagcaaacagtagtaatattccacatctcacttctctttttgtagacacagttcagagatctgttttcagcctacagatagactattttcagatcttataatattttctcaattcttgatagatagtaaggcaaaatgactatagtttcatttcagttaatgaatcttatttatccccttctttccttctaatattttattaatgatactttaaaatattccagcatatcctgttttatacttctagtgctgtttagaatatattattgtttgggatgcaattttaatttgtcatggcactaagttttactgtctctcacaaacatacctaacaggtttttctgcactctgtgtgagtaggttgtatatatacatacatcatgccccttagtcctttaatattaatattttattgtatcagttatcctaacaaggatattctcttatctatccacagtatatagttgtcagattcaggaatttaacgttaatgcaatacttatttaatctactgccatattccagtaacttactttttagcacttttttctttcaataaaggatccagtctagaatcacacattacatttagttgtcatgtttctttaaactgctttaatcaggattagttcctcagcctgcctttatcttttataaaattcactttttaaaataacatagaccagttattttatagattgttcctcaatttgtgtttgtctgatgtttcctgatcattagattcagggcatgaacacacttaaggccagaaaactacaaagtaagatggtgtccttcttggggtatcacattcagagacacacaaggtctgtctgccccttgtgttctcagcacctggttcaggtgttgtctggtttctccattgcatagttactattttcccctttcagtctgtaaggtgacacttcaagacctggtactattctgttcctcatcatacttttccccaattgggattctttttttcacagatctattagaagtatttctcttgataagtaaaaattagttgccagatacatgcaactaactttctaatttttaaaaacatgccattctttccatctgtttcaggtcaggaactgtgtgtctagatgtaattaatcaaacttggacagctctctatggtgagtttggccatggaatattttttggagatgttgagacattgcctaaaaaaatgttgtttggcttttcttttctggtttaagatgttttgttggtaatgggaagggatttttgagggaccgactgggaaagtttgatcagtggaaaaaatgttttctcttaagtacaaatatatcagtttagctgtggaagtttaaaatgattttttgagattccaaacttaaggtatagtgatacatgtgcacacacatgagtacatgcgcacacacatgaatacatgtgcaaacattttatatgtatgtattagcacataatatatacatattttggttttggaaaaaactaaaactacttaggaatgtccctctgaaatgagagagcaatgatatagtaagaggttttaggggatcatcttttcaaagaccaaaacctccttatgaaggaagagtaatttagccttaccttcagtgctgaaattgacaccccatctcttacagggaatcaacaaatgaattgcccagctctgcaaaatgctatgctgaatatcccagagagttataaagagcatcaggcctttcctccttatcacctggttggggagctgaaaatatgttaaaatacagtcatctcttggtatctgcaggggatcagttcccagaccacctgcagataccaaaattcatgcttactcaagtcccacagtcatccctgtgaaacccactgacatggagggctagctgtatttattgaaaaccacatgtgaatggacccatgcagttcaaactgtgtgtggacccatgttgttcaagggtcagttgtgtatttgaagttaattagggatacaacaaataaatctgtttttccctccacatgtccaaatctcaggcttcatagagtctacctactccagtgctcctaccccgtatacttccgctgattctccagctggaagtaatctctggataccattacattttatagctccttttttatggtccacttttactttctactgtgtatttgttgtttatgcctatttttttgtgctactagattatttcctatcttaagggctatcgggtgtgtgtctgattcatctgtaaggcccaggactcttatcacagtgcccttcaccagtatgggttgaaagaatgaatggtacaggtaaccattgctgagaggcacaagaaaagaagggaaagctcagttgaggctgagcttaaccagggatggctgcttcttgttgaacttgtacgaccttttagtggtctgaggtaggtaagacttcttagtccagccacaatctgcaagttacttttgccagatatccttgaactagattggtaaatgagaatcacagagaaaggttggtcaccagcagaacacagttaatccctgcctccacctgattgtgccgttcaaaaattattttctctacctgggatattcccccctgatctttgtgtggttagcaccttcttcactcatctcacatattacttcctcagagcagtttcctttcccagctactccatctgaaatcacacccctccatagcacagcacccagttgtatatatattttttaattttaaaattattttttaatacatagaaacagagttgcactctgttgcccaggctggaatgcagtggtgcgataatagctcactgcagccttgagctcctaggctcgaacagtcctcccatctcagcctccccagtagctgggactataggtgcatactaccatgcctggctagtaccccgttttcaataagcttctaaaactggtatttgtatattatttatcttatccccttggattgtaagcaccatgagtgaggactttgtcttgttctcgtctctctctctctatacacacgcacacgcacacgtgactgtaacagtgcctggtgcacaataagggttcgactatttgttgtcttaatgagtgaattaatcatgtccagaactgtttaacaagagagttttaggggagatgatggcatatagttgaggcaacaagaaagaacatacactccgagcttgattaaatggattccttttaagatggtttttttggtaaaaatgtctcatggcaggctgcctggaatatctgatgtaatgatgtgttttcttaaactacattcacatcttaaaaatgtacatatcaaaatactgcaatctggttccaattacaatgaagtaaattgatgtttagttttgctaaagcttttaccattgaccagaaaagctttgtgaaagatgtttgctgactgtcaagtacttcatgtctcagaacaggttttttaaaaaaataacagtttcactgaattataattcacagacatgcaaatcacccatttaaagtgtgtaattcagtagtttttaatacattcagttatatgcagccatcaccacagtcaattttagaacattttcatcacctcaaaaataaatgtgtaccctttaactattcgccctaggcaaccacgaatctgctttttgtttctgtggatttgtcttttctggacacttcttagaaacgtaattatataatatgtggtcttttgtgactgttttttttttcactttgcataatgttttcaaggttgatccgtgttgcatgtatcggaagttcttatggctgaataatatttcattgtgtagataaaccacattatttgtcagataatagacatttgggttattgctgtcttttggctattatgagtgttataaatatttgtgcacaagtatttgtgtagacatgtttgcatttctcttgggtatatacctaggagtgaaattgctggataatatgtttaactatttgaggactgatagactactttgtaaagtggccaacatgagtaagttttcatcacatttataaaatgttagtgtacttacattagcttgcaaagcatttaataagcagcaagagttaaaccacgttggtccaagtgaactgaaagcagacttctgtgttacatgtgtatgagttactgaacatgttccataatacaggagtgtgagcacactaacaggtaagtgcaggaaaacaagaagaaatattttcagagtatagtcaaaagtacactgagcatgggagaattgttttgacattttgctcaaaactatttctgaagaaaattcaacatttctttcacggaaagttttaggaacaggtaaatacaattatataaagtactggtagaatatgttcgttcagatgaccttgaagtgttttttcagacttatctgaacttgagatctgaactgaatttttattagaaactgttaaagcctctggcattgaaggttagttcataattggtgagttctgaatcacttcatttcctgcagtggttcctgagagaatcttagttcaaaggactgcccccgccaacccctgccccgccaaaaaaaaaaaaaaaaaaaaaactaacactaaataactaataggagaaagttggcgtgtcaacataaatattcaactgaaaagcaaaaggctaagcctggcacctaaaacttgtttcaacactttcctctgctgtagattcgatgagggagcagggagtggattgtgaaatttcctgccatttaccttgccccaggacatgtactgttctgtgggtatacatatttgtagcgtaacaacaattcacagttgaaatttcagatgtatgttaatcatagcctgatattaaacaacattcatgttagcagtaaatttagtcctctgtcccctcacacccttccccgccattgatttctggtaagccagttgactcattgcttctgttcttatcctgttttctctttgccaagtgtatgtgcaatttgtttattcagagttcaaaattggtataattgtggtttactcacccagtaatttttaattttgtattatttaaccttacaagagagctaattatagtgaggaatcggattaattttgtaagatgcttgccatcagtatgaagttatcaagtatgaagttatctattgttattgttatgacattaaacagaaagtagcagatgaccaaagtgattttggcttcctgcatgatagcatctttttttttgcatcccttcctgctcttccagacagcagtgacagaagctctgagaaacataaaatgtagccaaggggatctggatttccatttcaaaacaaattaattttaaggactgataggagagttcattaagccacaggtagctttttaagcactcttctattttccagttttcctttttttctccaaaatatattttatctgtagttggcttatcaccctgcactcctgggggcccaggtgccttcactgcgatacagctttaatctctctctcatcccacccttctggaccaggcatgcttgatccctgcaaatgtgtttctctctccagctttcattttactcattctttgactgccttcgtaaattatttatatgatggattaagttgtaggctgggcacggtggctcatgcctgtaatcccagcactttgggaggacaaggcaggcggatcaccttaggtcgggagttcgagaccagccataaccaacatggagaaaccccatctttattaaaaatacaaaattagccaggcgtggtggcgcatacctgtaattccagctactcggacagctgaggcaggagaattgcttgaacccgggaggcggaggttgcagtgagcccagattgcaccattgcactccagcctgggcaataagagcaaaactccatctcaaaaaaacaaacaaaaaaaaaagttgtggagaagtgaggtggaagacaattttcttatgaaattgggcagtttacattttcactcttagggttgctagccagtggactagatacttctactcttattttgctggagagaaaaatcaacatttgggaaaagtcttcccctagagttatctggggagttagtaacaggcaaataaaattgactacaacagaaggaatacttcaaggactttgagattaggcaagagatacaaatttttttttttttttgagacggagtctcgctctgtcgcccaggctggagtgcagtggcacgatctcagttcactgcgagctccgcctcccgggttcacgccattctcctgcctcagcctcccgagtagctgggactacaggcacctaaaatttattttaccaggcatttagaaatttaaaatacaaatttaacacttatcccatccccttttcagttagatagtctgtgaatcttcccaaataattcagattttggcagaaggtatatcttaaaataatgctttatgctggattagtgcatgctgtttcctaaacattttagtgtaactacacagataagaaatacatgtatgtgtcttcatggatgattaattggccaactactatttgaacagcttgagaacttcagtattgatctgtccatgttgaatcacaaacgtcatcctgcctttggaacagctggatgtcattatttgtagatagaggccaagtagagcaattctgtccagtactattgggataatgtcacctgttgtacataataaagaaatgtgctcagttgtggatttgcgcttcaacagtgcttagctagctccgtaaccaaccttctttatctgtctgcttggaaatcttcagatgaggtgtatgtggctcaggagtctaactagttatatacataaaaatggagtcttgctggctttgaacaacttagtggacattcattaaaaataccacactcactggtggtcagctttaaaaccatggggtggtccaggctttttggatcgtgggacatgagccagccagggtatggctctgaaagacagccacagctatgctctactttcgtaggggctctgattttagggcttgtttcattcttgattatatgtaaatgtaaccttgatttgttttatcttcattcacttacgattactgagttataaagtcttcccagcgtatggacacttggcttgtaattgcaggaagttacctcttgttattcttttctgatattaacaactaaattattgtctagtaattacaagcttgaatagcgagttttagtatgacagcaagactatccagctagctaattacacattaactgccctcatttctggaaggttaataacaaatcctattaccatgttttagcttacaagctcttaaggtaagcagggttataaggtttgaacgaggatgaattacctctaaaaaacacccaaatagacgagaattgttttgagattgacaatgcaacaagagcagtgtttttgatgaacaagagcttgttttcttcattgtgatctatgcagtagcacttattttcttctgcaactctctgaagtttaaatatgttggggggaaaggggctacaattaggcaatgaatgggaaattaccttttaagcgggtttggaatgctttaaaaacagtctatgtcctgtaactacacacctcagtttggtggcctggtagcctggccctgagcagaatgtggctggttttcccagtttcagcaccctgcatccatctgtccatctatcttttctcttctcttttctcttctttctttctttctctctctctcctttctctctctctgtccctccccccatcccccttccctctctctctctttctctctctctctctttcttttttgagacagagtcttactctgtcgcccaggctggagtgcagtggcgcaatctcggctcactgtaacctctgccacctgggttcaagcagttctcctgcctcagcctcccaagtagctgggattacaggcgcctgccaccgcacctggctaattttgtggttttagtagagatagcatttcaccatcttggccatgctggtcttgaactcctgacctcatgatccacctgcctcggcctcccaaagtactgggattacaggcgtgtgccaccacgccaggccagcgccctgcatctttcatattgccctttcccacacagcacaggaacacctgtttctagctttgaatacttaaaaaccaaaatgctactactgagatttaaatgtatttatcatgtatgttgcaaacattctttgagtgtttgaattcctactaattgttatttttttctttttttttgagacaaggtcttgccctgtcacccaggctggagtgcagcgtggctcactgcagcctcaaccttctgggctcaagtgatcctcctgtctcagcctctcaaatagcagagactacaggcatgcaccaccacatcaggctaattttttatttatactagagatgggggtgtcactatgttgtccaggctggtctcgaacccctgggctcaagtgatctgcccacctgggcctcccaaagtgctaggattacagtcatgggccactgcacccagccaccttttttgagaggtgggaggagggaagagtttggtgtgttttttaagcatcccacttcttttcggaggtgttttcacctgtttctgtttttttattttgttttgttttgttgcctgcatggccctcttcattaagactttatcttttaaagatccccatgggctaatatgagaagatatgtgaatctgctgagcttagactttttatatattttctccacacatgagaccctctcagtcaagtaattgtatgaattctttaatataccttttagtatttggtggcgggttatattatcttaattgcagctagttagccttcagtaaactaggtgcagcattgtgagccctgtggccagttgggcctgagccacagcactgcaggaagtctggtgggttgcttcagctctccacctgtgtgccctcaaaacaggtggagaaatgggctttttgtcactgaagttgagttcaaattaattgttttattattttattttattttatttgagatggagtcttgctctgtcactcaggctggagtgcagtggtgcaatcttggctcactgcaacctctgcctcctgggttcaagcgattctcctgcctcagcctcccaagtagctgggattaccggcgcccaccaccaaacccgactaatttttgtatatttagtagagacaggatttcaccatgttggccaggttggtcttgaacccctgacttcaagtgatctgcccgcctcagcctcccaaagtgctgggattacaggcgtgagccactgcgcccggctcaaattagttattttagagaatattacttttaatctcaaaactgtttctttgaattctgcctgcctatccgattggttttactgaagttttccttgaggggctgtctgtcatcttttagggccctctgtttgcaagtttttttcaaaaataacaactgcttagttgtgtgcagtgtaggactctttataggtttttgactactcttcttttcttgtagaatttcactgtcttttaatgtttacagactgcaagcaggataaaattaaaaattcaaccattattaatattgctgctttgtaggagctggtaaaggagtagaaggtaaagatctattaattatagtgtctaatacacccttgaggaaaatctgttaactccaaattattaagtacctaaagaaatctggagatcttaatttatttgccctatttcaggccttaccaaaaaaaaaaaaaaaagctacctggtttttgtgcatatagtagatacccaccaccaccaccaaaaataattgtggaatgaatgagatttcatggttggctttattttgggcacatattgtaaaattcatgacttgcgtggcagttcatgacgaattcaatacagttcctaaagtcaaccaatggaattttgaaaggtcaacagctgcttttctctagtagtcaaggatgtgaataacttgggtgaaattcccaggagtttcaactataatgaccaaaagttcaggggaaagagatctatgtaagtcacagagggaatcatcagttctagacaacaattgacttgtgatttttgtccatgttttcctctaggtgtgaacaggatttttctttcctttcctgtcagccctgttccttattgaattacagaacagataaataccttagacagtagtgactatccctgtgattttcggcttggaaagccaggagtcctcctccagagggagagggatgatgaaagaagtttggatagcatgcttctggaggatgcagaattttgattggcaaataatcattgtacatattcatggggtacatagtgatgtgttttttgttttttgtttttgtttgagacagagtcttgctctgtcgtccaggctggagtgcagcagcgtgatcttggcttaccgcagcctccacctcccgagttcaagcagttctccaggttgcagaattttgattgagggcaagaggaacttattgtttgtgggaaatgacctaagtgattgttttaaggaaactttctctgattacaaaggcgagagtatagagcctttaaggccatttagtagatggctgccctgatccagggctggaatgatatattggttttgacatagttacatgccaggggaaataaaagaaaaactagagacatttctgggaaactgagtgagtacatggaagaaaggaagaacacctagccagattccttccagaggcttggagcctgagagccagggcgttagagtcaacctactcccttcattaggtgaagggaatgggttttcaggaaaataatcttagacatgtaaagtttgataagactacaagactagacatatgaaggaccagttatatggatttggtagttaccaacatagacttcttatttttctttctttcttttttatttaaagagactgggcctcagctgggcatggtagctcacgcctgtaatcccagcactgggaggccaaggcgaagaggatcacttgagccttggagtttgggactagcttgggcaacatagaacttgtctctggaaaaaaaaaaagagagactgggtctcactgtgtcatccaggctggagtgtagtagttgtgatcatagctcactgtaacttcaaactcctgggctctagtgatcctccctccttagcctcctgagtaactgggattacaggtacaagccaccacacccagtagacttattcctttaaaattgtaggatggccaggcgcggtggctcatgcctgtaatcccagcactttgggagtctgaggtggatggatcaccctgagatcaggagttcgagaccagcctggccaacatggcaaaacgctgtctctactaaaaatacaaaaaattagctgggcgtgcacctgtaatccagctactctagagcttgaagcaggagaattgcttgaacccaaaaggcagaggttccagtgagctgagattgtgccactacactccagcctggggagatagagcgagactccagcctggggagatagagcgagactccgtctcaaaaaataataataataataataataataattataggatgacggcttcccggggtaacagtgtacaaagctaattcttaaaatgcaaatgccacagaatttgagccgctgtgcaggatgctgatgtctttcccgataagttttttgttatttgtttttaacaggatgttgggcttctgggggacaggtagtagaaggagaaaggggatggggtaagtgggattgagaacggaagaatggctttgatggttcttggcacttggcaccacttggtggtggtttctgagttacagcatgtatttttcagtattaagtccgaaaaacaaatgaagaatatttaggtaaaagtctccaaaatgactgcctgtgtgctaattgtggttcccagtgaggcagagcatgtcaaggtttgggtatccacaggattttaacctgcagaaagcagtgtatattacattttttttttgagtggggggtggtagagagagggtcttgctttgtcacccaggctggtatgcagtggcatcacaacatactgcagcctcgacccatccacctgcccctgacttgagcaatcctctcacctcggcaactactgagcacctactctcctgagtagttggaaccacaggcacatgccaccatgcccaattattattattattattattattattattattattattattttgtagagaccggatctccctatgttgcccaggctgttattgaactcctgggctcaggccgtcttcctgccttggcctcccaaagtgctaggattacagacatgaaccaccttgcccagcttgaaattttccatttatttcaaaggaaatagaggaaaaagaaataacttgtggtcactggttcataaatagccaagaataaaacatgagatgtgtgattcatcccctcttgtgttttctccttcaagccctgcaccatttcattgtgagtcacctggaatagggcaattttactttaagaattggtacatttttttcagtgtaactctttttaattaatacatattctttaagggatacaggtagctgaaatgtctaccctttgaggatgtcatatttgtattaatagtttagttctctggtgcaatttgaagtatatcttatagtcacttttagtaatgtgtgttacttccctgtaaggaatagcaatgttatacttctccttttgcagtgaagaaattgagatgtagaaaggaagagacctgcccaaggtcaaagagcaaggcagtggaaagcctgagattagacttgtggtcttttagatttttcatctgttgttcaccactgaggagccagctttctgtttgctggagacagttcagcctaatggaattttctctgccagatgtccacattgtgttaggtgatgattctaaccatcctctaatacccattctcctccaaagtggccctttagttcccctccagaacagatctgcttttgactgcctgtggtttggcacacctctgcctagagataacagtggtaacagcagtgtgcagaaaagaaagtgggaagggtcagggaatgtcactaaaccagagtcgagctgttagaggtgaacattttcttgcaaaaaagaacctacgagcaaatggccctttccttcccgtctattctttggggataggggatcatgggccaggtagtatttcctgtgcattttgcacacagatgtctgtatcacacacatacagatcccatccagtcctaaaccagaagccctggggtaggtatgaagctgcaaccttaggatgctaagcaagtttttggaaaaactccacaggtaattgtgatggacaagcaggacctagacttagcccagaaccactgctctagactaagtgatgctacttttgatgataagttgtttatgatttgggagtctcactccattgcccaggctggagtgcagtggtacaatctcagctcactacaacctctgcctcccaggttcaagcaattctcctgcctcagcctcccaagtagctgggattacaggtgcccaccaccacgcctggctaattttttgtatttttagtagagacagggttttgccacgttggccaggctggtgtgaaactcctgacctcaggcagtccacctgcctcggcctcccaaagtgctaggattacaggcatgagccactgtgcccagcctgtttttaaatagtaaatatgaatataaattatatgcctaaactgagatatgagtgttataattttaacattaatgtaagatcagactgaagagtcagtgctaatgaaccacattttggttctaattgagtctaaggcaaaagtaagagctgtttgctcatcataaaccatatactcaggaatcttgggacttcctttaaaagttaagacaggcggaaatggggtcggctgactgtactctacaggtttaggtcaactgtatctggctctcttcctttaaaaaaattgaaggttaatgtttttagataaagatctttgaactgacacatttttatcgttattattatcgacacatttttatcgttttatcattaacaaaaatctagggaaaaagtgttctttatttttctacagatgagtatctttattttattcttgatttatagttttagtcttctctgccagtgtatttatcttgaaagaagactttctgcacatctgcacatttgagagatgctcctttcagaagcacccttaggagtaatcactgtgttagccacttgcaggaaggccttattgctttaagatggcagagccatcacatcctggcctcccgaagttgtcatcttcacccaaaactgggcctcatgtgtttccttttctgctcttctgttttacaggtgtgactcagcacttctgtaaaatggatcaaaaatgtgttaatgcaggaagacggtagatacaggaaggaagaaccaataattaagggttcttttatttgtttggaacaaattcataggcaaagccttttattggtagcttgaggaaacttaaaagtagtaggaaagggtataaaatctctttctgggacacgctaaactcctagttttataacacgttgtctgtgatatttctctagccctgaagcacttctgaacattacttcagaacataaaacctatgctttgtttttaaaggttttcgttgttatgtaatagcatccagctgctaatccttttgagcagcacctgtaataataatatggcaggaggagccttccgttcgctgtgtgcaggtgtctgcgggttacctcctgcggtggagctgcatgaaaacaagcacaccgtctctgtgaatagccacagaaacatctgaacgtcctttgcttagcatgcttctttgcacttgtgagggattctttggggaggagggtgatcatctctgatccatggatttagcttccctgccagcgatggtatgcgattttgacccagagacatggggagcttgtgccttcgtgaaatttgcggcagcggcagtgtgtgttttatccattaacagaggcagcatagtggatgagctcaggtttgagttcctgatccatacttaagctctgtgtgcctcaatttctccatctgtaaaatggtgcctacctcattgactgtagtgaaattaagagtgtatatgcagaccatggaagagttccttgcttgtagtaagcactatgtaagcattaacctgccattactgttaatattactgttaatgggccgggcgcagtggctcactcctgtaattccagcactttgggaggccgaggcgggcagatcacgaggtcaggagatcgagaccatcctggctaacacggtgaaaccccttctctgctaaaaatacaaaaaaattagctggatgtggcggcgtgtgcctgtagtcctagctgctggggagactgaggcaggagaatggcgtgaacccaggaggcggagcttgcagtgagtggagatcacactactgcaccccagcctggttgacagcaagactctgtctcaaaaaaaaaaaaaaaaaaaaattactgttaatgtaactattgtttaacttttccctgctatgggatcacattcaattgtaaaactactgttttttgtttttatttttgtttttttgagatagagttttgctcttgttgcacaggctgcggtgcaatggcgcagtctgggctcactgcaaactccacctcctgggttcaagcaattctcctgcctcagcctcccaagtagctgggattacaggcacctgccaccacacccagctaatttttgtatttttagtagaaacgggatttcaccgtgttggccaagctggtctcaaactcctgacctcaggtgatctgcccatctcagcctcccaaagtgttgggattacagttgtaagccactgcgtctggcctgtaaaactgaatttgcttaccttttggcattttctaccactgccttaataactcacccacccaaggataaagataagaaaataaaaacattttcagacttttcatgttttattggatatttcaaacatatgccaaaatagaaaggacatatttacaggaaaatgttatttttattttatttatttatttgagacagggttccactcacttgcccaggctggagtactgtggtgcaatcttggctcactgcaacctccacctccccaggttcaagcaattctgcctcagcctcccaagtagctgggactacaggcacgcgccatcacacccagctaattttttgtattttttagtagggacagggttttgccatgttggccaggctggtctcgaactcctggccttatgtgatccacccaccttggcctaccaaagtgctgggattacaggtgtgagccaaaaatgttgatttttaaaggcaaaagaaatgtcatttgaaatgtgaaaagtagaagttacacatctattgccttgaggtagctttttaaaatgtttgtcttatgcatacacactgtacatagttgtaattctagaaaacataccattttatggcctttctctacccagcattcaagtataagcatttttttcattgaaaacaaatagttttcaatggttttgtaccataataattgtttccctttttaaaaaaattgtagataaaacattggtgaaaatcttactgcagatagtttgggggttatataggaaggtgatttttgttttgcttttttgattaggagtgtcaggatttctttcgtggtacatgagaaccttactataaagtggctctttaggaccgttctgaagtcagccttatgaaggtgaaatagactctgatgaaatcaccccaagtctgtggcttttgttgtaaggcagagctgctctgtgtcaatacctggtgtgtgagaacaggacgtggtagctgtcatgggaccctctagcccatcattctctagacctgcactgtccaatacaggatctactagccatgtgtggttatttaaatttaattagaattaaataaactgaaaattaatttccttattcacactggccatattttgagtgctcagtagccacttatggctagtggctattggtttaggtgagcacatataaaacatttttatcactgcagaaagttcggttgagtaacacagctctagattagtctctaactgctcagcttcttaaccttacagtgataagagccacctcttataggtaagattttctagagcaaagttgggcagaccttgggtacttgtttttgtatatgtagttttataggaatacagccacatcgatttgttgacctatactttggctgcttttgtgttacagtggcagagctgagttttgagtagttatgacagagaccatatgtggcctgcaaagcctaaaagtatttgaccctttacaaaaaggtttgcctaccgcttttatctagatcagggtttcttaacctcagcactgctgacattttggtctagataatcctttgttgtggggctgtcctgtgcattgtggtgtttagcagcttccctggccttcacccaccggatgccagtagcaccgcttagatatgacaaccaaaaatgtctctagacattgccaaattccatggggagcaaaatcacccttggctgagaaccacaaatctcaagcaatgtggcttggcaaagcattcatctgtaatactgcaaaggagcgcccattgttaaaagcaaaattggttgaaagagctgactaaattaatgagtagttttttatgctacttagtatacttcagcattgtctccagaaacaggaatgttttatataaaacatgacaaagcagctggagtggggcagagacatggaagcattctcatgtccttccatttctcaggggtgctgcagttcactgaggagcagagtgtggaagttacagcatatctgagctatggggtgtgtgggttgtgttatacccaggttctcagggcctgcttttctaaaacgctgggtaactgcaggtgtttgttgtttgctaactgtgtgtagatatcatctgtgtatgcctggcaagaaaggagttaataaatgtcacgtctataatcccagcacttggggaggccaagatggaaggatctcttgagtccaggagttcaagaccagcctgggcagcataaggagaccctgtctctatttaaaaaaaaaaaaattagctgggtatggtggcacatgcctatagtccaatttacttggaagactgaggctgggaggttggcttgagcccaagagtttgaagttgcagtgaggtatgatcacacctatgcactccaacttgggcaacagagtgagatcctctctcaaaaaaaaaacttttttaaataaataaatgcagtagattggtgcttatctgtcttatgaatatttgtagtcttatgtggtccatatagattcctatcctcattacccagaataattgaaaaattggttatatttacctccattagaagttgcaagaattgaattaaatgtcaagtcctataaaattgtgttcaaggctgagcgcagtggttcacacctgtaatcccagcactttggaaggccaaggctggcaggtcacttgaggttaggagtttgagaccatcctgaccaacatggtgaaaccccgtctctactaaaaatacaaaaattagccaggcatggtggcaggtgcctgtagtgccagctacttgggaggctgaggcaggagaatcgcttgaacatggaggcagaggtttcagtgagtcaggattgcaccactgcactccagcctgggcaatagagcaagactctgtctcaaaaaaaaaaacaaacaaaaaaaccccacaaaaactgtcttcaattcttttaagacccagcatctgaatacctttcagagtggggggttttgtaagctgtagaaaatggctgtgtgaaatagccatataaatagagtgaaatagaattgggaaaattgtccttcaaagtgaatgtcaggtatatctttatctcgttcttcaaattaaaattaaaatgtttaaattggtattgaaatgaatgtgtaatacaagtcacatgtaatagagcacactcgtatggagaatcatccccgtgtgaatatctaagaaggtaagcagcttgactactgaatgcaagtgaattttaggtgaacttgcatttcccatgtgtgacatgtttgtttggtttttcagatcttaccaatatatttgagtccttcctgcctcagttattggcctatcctaaccccatagatcctctcaatggtgacgctgcagccatgtacctccaccgaccagaagaatacaagcagaaaattaaaggtaagaggatgggtagtttaacctggagacaaaagaacttaaatctgttgggcttcagtcattaaaagtccttcttaaattacttagttcctaatactttttcttaggcctaaaaagagacagctgtgggctgaagtagtgctcaccaacctcgggtggcagtagcaccagtttgctcatcctttgcgatttagaatcctattttcccatccttaaaacagtttacgtgctgatgggatatgagtttcatttaaatgaagataagtttgcgactggccgtggtggctcacgcctgtaatcccagcactttggtagcccgaggcaggcggatcacaaggtcaggagatcgagaccagcctggccaacatggtgaaaccccatctctactaaaaatacaaaaattagcctggtgtggtggcacgcgcctgtagtcccagctactcgggaggctgaggcaagagaatcgcctgaaccaggaagcagaggttgcagtgagcctagactgtgccattgtactccagcctgggtgacagagcaagattctgtctttaaaaaagaaaaaaaatctaaagctccacctgggttcattggattttccattttacctctgtgtatgtttcagaactttcatagtgaaaagtctagatacatgaagctccaccaagaagcaaaggaattcaaagtttgtgaaatatacctgctgcttttaaccaatggcaggcattagtatctagccagtttttcacatgatgggcctatctgcatagcagtccagaatgtttgcttcctcaaaatgtgtggcctctctgaggtacatttgcaagaggtggcagtagaagtaatttaccagagcttgaatgtgcaggtcttcactctgaaatgtgcaggtatgaggcaaacagggactattcatgaaacaatagcttttcttctatttgttttctaattcttcttccaaggtctctatagggtattgtttggagctgttgttgagataaagcagaaataaatttactataattaattagatctcaagtgctttgcaaattaatatctaatttatgtagcaaaatatatagctaagcaaacatgtatttgaagaaaaaggcagtcagtttcagccagataaagtgctgttatgagactatattaaaattttgacataggaatcacttagcaatgtctgcaaaccacagatatcttggagcagagtatatttctctagttcacatatgcattctgtctcaacaatttagcagtagccctgtttcagtacatgtctgctatagtcccatttacaaaaagaaccgagcctacatttatcttagaatggctcactccagcgtacggacccctagccttcggaaatgttcatgttggctatcattttgtcttccttagtaatctcagaaaatcatggccatcagacctgagctcacccccacttcctactgtgccttgatatcttctcccttccctcctgcatcttttctttgttcctaactataggaaataaataagagacacccttcctcatttctcaaactcactcccaccaccaatctgtgatcttgttcccccaaccccccgccccctcccaatgcagtcttcctcctccaccccatcagaggtctccctgtttcaggagcagtgatctgctcctgtgggctctcttaggagtcatgctgtttattccttttcattttcaaacttcttgcgtcctcaccttaaactcctctagtttttttcccctcctctgcttaatctgtgccctcatttcttcccaatcctttggactcttctcaagtcccattttgctggacctttctgcaagtgttacattttaccctcatctttctggaaacttctcattccatttcctaaatgtggtcattcacttaggactcggtccctgggctccctctcttcctttgtcatccctgaggagctgtttcacctctcacagcttcagtcagtcccctccagggagatgatttctgaatgtgtgtctaggcctggcctctctcccaagctgctgctggacatttccatttgtgtggcagtcaccaccaacccaacacagctaacacagtcagtgttcatatttagttggcgctgtattatagtacatgtttgaaaaagtgtttaaatattggatagcccgtagcactgggcaccattggagctgtctaaagctgtcacttccctgctcaaaaccctttgctgggtgacatctttgcctgccattcagggctctctgatactgagtggaatctacatctttgcccttactccttttttttttttttttttttttttttttttttgagacggagtcttgccctgtcgcctaggctggagtgcagtggtgcgatctcggcccactgcagcctctgcctcccgggttcaagtgattctccttcctcagcctcccgagtagctgggattacaggcatgtgccaccacatccagctagttttttgtatttttgtagagatggggtttcaccatgttggccaggctggtctcgaagtcctaacctcaggtgatatacccgccttggcctcccaaagtgctgggtttacaggcatgagccgctgcacctggccatagttctctcttaaggttgtgtttaaacatcccagccacttactttcaacaaaacaaagcctttccctggagtggcctctcctatgccatagctggcaggacttgggggtcagtgtggctgggactgcctcggccgtttttcgtccgtaactgcttccctctggtgacactcagcagctccttttatcttcctctgtttcctcctcctcattggtgaccttgctcttcctttctctctctcaaaggccttgtcctagtaagtacttaatatacatttgtttccttgaatacattaaagagggctgatagtatcaaattctagtgtcaaaaaaaggtcaatatttatcttctacaaaggaagacgcaaaatagtcaacccattagaggttaaaaataaaattgttaaagtttgaataaatatttctcaattaaggtaaattcctacctaatcatgggctactttaatctcatcaaaatcattagcataaaattttgttataatgaatttgaagggctctaagtctcaagtctgcaaaccttttctgtaaaggaccacattggccagatgtggcctttatcacacattctgtttattattttttaagacagtttttaaaatataaaaacattcttagctaggccctgtgctagttattcaaatctggtaggcccatttggccattcagcttatcttcctattgcagtgagtccccgcaactctataggaggaaaaacaaagccacaagggtgtgtttttgtgtggcttgcattttgaataggtttctgtcatgtcttttcctattgtgtggaggctgttcacttgaaaacagtatgcacttagagtttttaggaacaagtttgtttattcagcagttcttaaaagccgtttcagcagtcttattcagcctagggttccaccaaggctgtagcagcggaaatctaccttcaggtaaattatacatggaaaaaccactcagagccgagtggtgtctccgtatagcagcttagtcctgagcagattgagcgatggtttttgccagctgcttcaaaaacctgacaggcaggatctgtttagactaaaatcgattcctaaaataatagacctggactgaccgtaattatgtaactgcagatctaaaaatgatgaaggatttccttataaattactatggaatcatgactggtcctatactatctgggagatgaaagtaaaaagaaagcgtggggctcccatttccctggtccctgaagagttcttggggtgctgcagcacacacattcccctgcaagctgagcctgctgtgttgctcttcccaatacccctttcctcagggggcaaaatgcagaaaccctgtcccaaagaagtctccctatgggattctccttagctgtagtgatcatgattactgtcatctttgtcccccctggtgttcaaggtaagtttgaacctccgcagccttgccagctttttggggtcgccaaagcacatgcctgcccactcactgcccttgttgtctttctcccaccccgtgcagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 38217 - DNA, 44829 bp, Homo sapiens
aactacaccagggccggtgcacctcggggcggcggcgcaggactaggctaggccgggccgggccgggcagggcggcgcgagtcgggggtggggcggcggcgcagcgccgtcgtcgtagtccccgcctcttccccaggggccgcgtcggagcctcggcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcaggtaagcggcgcccgactccagccccgaactccggtccctggctctgccctgcccgctggccgcctcaggcctctctggccggcccgcggccaactcgacgccggggcttggcaggccgcgctgggcctggaggggcgggtcgggccccgggctcggattcgaggctgccacgggcccggcctgcccgtctgcgaccccaggtgggactccggcggtggaaagtcctcctcccggcctcgtttcccgcatttcccagggcgggcgggtccctgagtcagaacccgcgacccacaggcggcatcgatctgaggcattcgtttttcatttttccacctttggtttgatgtcattggaaaagaaagaaagaaaaaagcatgaaacggaaactgggtggagagaaaagattaaaatctctgctgctgccgatagctccccacagcaagatgctattgctcagggtttcagagcctagtttgtcgaaacccatccccctcgcctccgttttaagacaaaagtaaaaaatgaagcaagagacaagcccgcagtttgcagtagatttggaagaggcgatgtttggctgtggtgatgccccaaaagggagagctacgatgaagtctgcagggcgtgtgccgggtgtattttaaatgcttggaagtgacgttttaagagatttgatggcatagctggggaggaaatgtataggaaatgattggatcattttctcgggtttgatttaatacattgaggccccagggaaaagagctgcttgtttcactccgcgtctgtagctaagttcccccaggaaatttagagaccttctgcagggtttttggaagtgttaatctaacatacagtaatggtgggaattgagccaggtggtaaactgatgttgattggaaccgcaaataacggcttgtgtttgtcatgtttcagatgctttcggtgcatacagatgtcaatcctccttttatcaaataaaatgtcctatcttagacgatctacaattttatattttagaagtaaggaaagccagccagtacgatgaaaacgtagattaaccctggtgcggccggccggttactggtttgttttgctatcatcagccatgtgttgcaatccgtccccactcaggcttggactcccaaaatgactagttaagaatttcacttcttggttttataaacacggcccaaattgtggcaatgcagttaatccttagatctcttcagagcacatggatctagcacatgctttttttctatgaccttgggcagcctgcgggttccttactgctttaataaaatgggaataacagatgccacttaactgtcaccacagtgtttgcaaatcacccctactgtatactgtcatctgatttcatccttttcatcctgacttggataaggctaacgagcaaaagagctgtggtttttctttgtactgccatcttcttgagctattaggtaatgctgacatactgctagaatataaaaaatttgctggagtatcaaaatcatgtattccttagtgtggcatttaatattttttaattatgcagaattgaagtataaaaaaaagagaaaaaaatcttcctagaaaaattgtaaaagatgaaagcccaaaaaactgcaaaaccctccctaaacaaaaaccaaatagataaccaaaggtaatattttaatgtgcattcttgtgggtttatagctatgtaaatatacatagttatagatcagtatatgtgtgtacagataaggaatgcaggaaagctaatattgatttttttatgcaacaatcacagtattaagtaatttacatccattttttttttcttttaattcataccaaacccttatgaaccagggtttgttctcattgtcaaagactcaaagtggctcagtaacttgcctcaaggtcacaggctgctaagtagtgattataaggatatacacacactcacctacttaaaacacaggctcacagtccagatataggtgtatgcattagcagatatatacacatgcatatgtattctcttatgtacccatatatacgtatacagacatatctttgtacatttgtgtgcagttttatgagccccgatcatacttgcacatacttttgcacgtgtccatgtgtatcttgttctcagacatgtgcattcatacatttgcacatgtgtatcatgcacatgtatctacaaaggcatgctagataaataatgaaataggttcataattctattttgtaatgttcttcacacaatgttattaatgtcttctatataaaatatttttaatgtctgcatggcatgtaattgtatggctgaatcataatttaactaattgcttatctttggtcactaagaatgtttacagtttttttcattgaaatttatttcacatacgtcttcaaccgtttccttagcataaattactagccatggaaatgcctggtcagcgaatatgcatttttaaaaggcttttgaattatagaatgatggtgaattgtccaggcaacttgataggagcatgatactctttggttgtcacacagggctgttctgacttctatttgatctggttaatcaaattgagctagttttctcaccaagtaaatgtaatggaaaactgtatgattcattcataaatgcaaacacagttttgtctttatggtctttttattggtagtgtaatatgtggacaacttgaatttagcatagtgacagactatgcagaaagggtaggctcaaccaggtgtggtggctcacacctgtaatcacagcactttgggaggccgaggtgggcggatcacttgaggtcaggagttcgagaccagcctggccaacatggcaaaaccttgcctctactaaaaatacaaaaattagccaggtgtggtggcactcacctgtaatcccagctacttgggaggctgaggcaggagaattgcttgaacctgggaggcagaagttgcagtgagccaagattgtgccactgaaccccagcctgggtgacagagtgggactgtctcaaaaaaaaccaaaacaaaacaaaacaaaaaatggccaggcaaggtggctcatgcctgtaatcccagcactttgggaggccaaggcaggcagatcacaaagatcacgaggtcaagagattgagaccatcctggccaacatgtgaaaccccatctctattaaaaatacaaaaattagctgggcgtggtggcgtgcacctgtagtcccagctactcaggaggctgaggcaggagaatcgcttgaacctgggaggcagatgtttcagtgaactgagatcgtgccactgcactcctgcctggcgacagagcaagactctgtttaaaaaaaaaagcacggtgtggtggtgcacatctgtaactccagctacttgggaggctgaggcaggaaaatcacttgaacccaggaggcagagtttgcagtaggctgggatcgcgccactgtactccaggttgggtgagcaagactgtcttaaaaaaaaaaaaaaaaaaaggcaccgaggtgggcggatcacaaggtcaggagatcgagaccatcctggctaacatggtgaaaccccatctctactaaaaatacaaaaaattagttgggcgtggtggcacgtgcctgtagtagtcccagctactcgggaggctgaggcaggagaaacccgggaggtgaagattgcagtgagccgagatcgcgccactgcactccaggctgggcgacgaagtgagactctgtccaaaaaaaaaaaaaagaggctaggcttataggttcccctggcattattttattttttttttcatttttgccttttgaaactgagactgtctcagacagtatggaagcactattttagaaagacctaagtaggcccatactgagtgctgagaaacctgttgcgtgtttctctctctgaggacgttaactcccgttcatccatagatgaacgcagatcttctgcggtagatgtgtgcatgaattttgccaattcatttcaagtattttgggatacttggatttgaattcaatgtaagtgggtgatgatgacactgccatgtaggttcaaacagattacagaatgtttagttctggacttgcctcattacctgctaaagaagttgcccacttgtgagcatcaccaatactctgtatgatagtttgatgacattatagtgcagattttggaatggtatacttttggataaattctctcaggattatggaggaatattttgatgagcataagaatttcatctctgataggtcaaaccatattcatgttaaattattagatgaagtaatgatcctggaggaaggaatgaatagtgcttatgtggcttttttgcttatttttcagtttcaaaagaagttatatcacagaatgccaacataacctaaatgtcaaagtttcttaagttatatgctgtatttgtggcctacatggtcagtgatcaaagaaaatttataaaaatattaggaagatgggtaaattattcctttgaaaactttaattgtggtaaaatacacataaaatttaccatgttaaccacttttaagtatacagtttagtggcattaagtacattcacattgttgtggaaccagtccatctccagaactttgtcaccttgcagaactgaaactccatatccattaaacaataactctccattccccctcctccagcccctggaagccaccattctactttctatgtatttgactaccgtaggtacctctcataagtggaattagacaggatttgtccttttgtgactggcatatgtcacttagcataatgtcttcagagttcatccatgttgtagcatgtgtcagaatttcctgcctctttaaggctgaataatagtccattttatatatgtaccacattttgtttatgcattcatttgttgacggatgcttggtttgcttctaccttttggtcattgtgagtaatgctgctataaaaaacatgagtctacaaatatctttcaagtccctgctttcagttcttttggatatacccagaaatggaattgctgggtcatacggcaattctatttttaagttttcgagaaactcccatactgttttccatggcagcttcaccattttattttcccaccaacaatgcataaggattccaatttctccatatcctcaacatacttgttatgttctcttttttgtttttgtttttttgatagtagccatctaatgggtgtgaagtggtatctcattgcagtattgatccctatttccctaataattagcgatgttgagcatcttttcatgtgcttattggccattgatattttctttagagaaaatgtgtattcatgttctttgttcatttttgaattgagttttttgttgtcgagttgtaggagtaatttcttcatgatgtttacattttcaactttttactatggaaatttcaaacacatacaataataaagtagtgtaagaaattttatgtaccatcacccagcttcagcaattgtgaatgaatggccaatattatttcacttatactcaccacattattttgaaacgaatcctagaaatcatatattgataaatatttctatgtgtaacgctaaaagaaaacaaatggtatgatatttcaagaagatatcacatgaggaatatatcatgagagctctcttgtaatctgtgaggagtatggaaacaggatttgtcagtgtcgggctgtggatccataactaactgtcctttgtattgattgggctcactcttgccaagcctcatgctttgtttttgtagcagtgatagattcctgttaatctatccttgttttcttacctgatcccatgggtgaccacttgttaggcaagatttatttggcttaatcatactatctgtgtcctgaaaatagggcagtgcttcctggtttgggcagaaaccaaggcccagttgaactgctctagggaattttgctctaagctgatgccaccagtagtttaactgcacataacttcaaattgttttatcctagacattaattatatttcataattttatggtagattataaagtaaatcctaccatgagaataacttcatatttttattaagaaagaaaaaaagtctccaagagattcaagtgacatcctcagatttatttgtttttagggctttaaaataattattttggtttcttaaaatgttcttgttttacctttaagcaagtacaacagcttagaagaattatattcttttttgtttgtttgttttgagatggagtgtctttcttcttgctcaggctggaaggcaatggcgcgatctcggctcactgcaacctccgcctcccaggttcaagcgattctcctgcctcagcctcctgagtagctgggattacaggtgcccaccaccacgcccagctaattttttgtatttttcgtagagatggggtttcaccatgttggccaggctggtcttgaactcctgacctcaagtgatctgcccgcctcggtctcccaaagtgctgggattacaggtgtgagccactgcgcccggcctatattcttataataatggacaatttagataaagcaactttaatacttctgttccattcatactgaaaattggcatgatggtttatctttttttcaagtcattgttgccaataagctaggcaactggcaaacatcatgtatgaaattttttgggcttgacatactttccagtggtaattgcttctagtggttggctaggtgggggtatgagttagagtaggctctgggtatccacaggttctacattcgcagattcaaccaactgcagattgaaaataggggaaaataaccatacaataataaataatagtgcaagtaaaatatacactataacagctattttacatagcatttacattgtattaagtgttataagtaaagatgatttaaagtacatgaggtaggttatgtgtaaatactataccattttatgtcagaggcttgtgcatcctcccattttggtatctgtggggagtcctggaaccaattcccagtggatactgagggatgactgtatgatatgtcttgttaacttgaccaagagtggtagtaaagcaagtgtaacttgatatcacttagcacatcctgctgttacaataaggcttactcatgatttttctgaataacataatttatattaaatgtcctaaatactagcactgatcaagtttaagagcattcctagtgaaatattttcttattaatgcagttcccttcatatgtatatttatttatttatttccttccttccttccttccttccttctttctctctctctctctctctctttctttctttctttcaacagagtcttgctctgttccccaggctggagtgcagtggcgcaatcttggcacactgcaacccctgccttccagtttgaagccattctcctgcctcagcctctggagtagctgggactacaggtgcccgccagcaggcccggctaatttttgtatttttagtagaggtggggtttcaccatgttggccaggctagtctcgaactcctgacttcaaatgatctacccaccttggcttacagagattacaggtgtgagccaccatgcccaggctaccttcatatgtatttttcttttctcttctctcctcttcttttttatttatttatttatttatttttgagacagggtctggttctgtcacctaggctgtagtgcagtggtgagagctctgctcactgcaatctccgcctcctgggttcaagagattctcgtgcctcagcttcccaagtagctggtgttacaggtgcatgccaccacgcctggctaatttttgtatttttagtagagatggggtttcaccacgttgcccaggctggtctcgaactcctggccttaagtgatctgcccatctctgcctcccaaagtgctgggattacaggcatgagccaccgtgcccggcccatatgtataatatatttcttatccccctccccgagcaatttagcataatctttgaccatttttctgtttttgtcttttaaattagtttatctcagcaatattaattagtacttaccataatcaaaggcttgaatacaatttggaggtctatctggagactggacaatttatgaatagagatataagggtttagggagtggtgcctgtttaataatgatttcattttctttttttgctttttttttttttttgagacggagtctcactctgtcgccaggctggagtgcagtggcgaaatctcagctcactgcaacctccgcctcctgggctcaagtgattctcctgcctcagtctcctgagtagctgggactacaggcgcccgctatcacgcccagctaattttttctatttttagcagagggggtttcaccatgttggccaagatggtctcgatctcttgacctcgtgatccacccgcctccatctcccaaagtgctgggattacaggtgtgagccactgcgcctggccgatttcattttatcattcgatgcttaaatgtgatatttaaaattaagcattttgtattaaatagtaatacattcttcatgtgctagattcaaacagtaactttctaaagaaaaacttgatttccctttcctccctatctctttgcagagctgtaactgctcctcaagtttggtgtgtgttctacaggcttttttttttttttttttgagacagggcctcactctgcacccaggctggagtgcagccacatagtctcggctcactgcaaccctccatcttcaggctttcttcttaacctttccttggctttaaatgttttttaaataaatctgtactttcaaatagactttactttttggaacttttttccccctaagatgggttcctgctatgttgctacccaggctggcgtcaaactccttggctcaagcgatcattcccccactgacctcccaagtagctgggaccacaggcacacgccagcacacccagctgaaacatttttaatttttcagaaacactgagaagacagtagagagtttccatatgccctatgcccagctttccctattagcatcttatatcagtatggtacggttttcacaattattgaaccaatattagtacattgttatcaattaaagtctgtactttgttcagattttctaagtttttacctaatgtcctttttctgttccaggatcccatccaggatccaggatgatataatgtggtaatgttacatttagtcgtcctgtctccttaggctcttcttggctgtgagtttctcaaactttccttgtttttgatgagcttgacagttttgaggagtattggtcaggtctttgtagaatgtccctcaattggggtttgtttgatgtttttctcatgattagactggggctgtggatttgggggaagaccacaggtaaagtgctgttctcatcacatcatatcaagaatgcacactttcaacatgacttatcattgttgacattgaccttgatcacctggctgaggtagtgtttctcaggtttctcttctgtaaagatacgttttaccccactttccatacttactcttgggaaggaagtcactatgcatggtccacacataaggagtggggagttatgtaacacctcgctgagggccaagtattgacatgaattatttggaatttcctgcatggggcatttgtctctgctctgataatttgtttagtatttatatctgtatagactcataaatatttattttattcttccaattatccaataactgctttattttattgcttaaattgcatacctccatcattgtggatttttttttaaccacttccatactttttggcactaggctcatcttatatatttcctgcactatcctagaatcaggcatttttccaaggagcctaggttccttttattgaaaaataatactacaaaccaagatctgtgctccttgctactagggtgtcattgcttttaggccttctaagctgacagagcaaggaactatatatgtctgtatattaacctgtgggtatacacatctgtaactatttctgtatgtaccatctatctatattaagctaaacataagttcatactaatatctccacctctaatttgttaccatatgggtcactctagcctactccccttatctataaactcccactccaacatggagaaacctggctcacttccaccatccatttacatcattcttcagttctgatatacatgtgtaagttgtatcagaattattaacccacacccctgtgggaaatagtattataaccactacaggacaaagcatatgtacagttcctttgcctttagtcttaaaaactctacttatttccaaatgttacttaggtcagcaccttttcctccacccacttgagtgaggttgtttcaaacatttataatacagttatcttgttttgtcacattttgcatacatcctccagccacctaagtggatttttaaaatttgcataccttgagattctttctttgtgctatcaagttctataaattttcacaaatgcatagtgtctttttttttctttttaaacaacacgttttaagaaaaatggtaggactgatttttctttattttccaaactttctgctaatgatcatgtttgctttctttttaaagtacctttaaagaaaattttatttagaaataattttaaacttagagaaggttgcaagaatagtataacataacactcatatatctattaccaaattcatcttagacttattgttaaattttgattaacaatgaatacaatcctataaaaattgaaagcgctacagataaaacccaagtccctttaatcatcacagtcctttctctatagaattcagtgttgatttagctacttgttgtcaaattattattattattatttttgagacggagtctcgctctgttgtccaggctggagtgcagtggtgccatctcagctcactgcaatctctgcctcccgggttgaagcaattctcctgcctcagcctcccgagtagttgggattacaggcacgcaccacaatgtccagctaattcttgtatttttagtagagacggggtttcactatgttggtcaggctggtctcaaactcctgacctcaggcaatctgcccacctcagcctcccaaagtgctgggattacaggcatgagccactgcacccggcccaaactttctttctgtttataaatctcgtctacagccataccactctgaacatgcccaatctcgtctgtttataaatctcattttcacttgtacttctaccagtacctggtgccaccagttcttgagcttttgggggatacaaaacaggttgttttttggctttctggtttaggatttagctttcttgggtctgctgagtcagttaccacttgtcatcctgcttctagctttcagaaatttattgctgcttcctttcctgttgcttgtaagtttttttgcctttaaacaaacaacattttactcacatttatatttaagagggtttcaggaggaataagaggcaactgtctaatctttaattggacattatacagtaagtgtaattctttgtgtttcatttgctaaacttgcagacttagtgaggccaaaaacaccagccatgtcactgttctgtccccagaccccacatcagttgtggcctgacacatttaatgagagttgttaaattaacctagcagttgaatacttgtagaatgaaacattctgtgatgatagtgtaacaggaaaggtattaaatgcttgatgcacctactttttggctctctttgttcttgaaggaagaggggacctcatgaccaggcctgaatcaaggtggactctcctgaatagaataccttttcccacccataatgtctacctgagtatgctctactccaggctaatgagcaagcatagcttttggaacttctcactatcagagctgagcaggctgcagtcaacatgcaagcctgggttctaggcatggctctgtcactgtctttcagtgtctacatttgatttcactgtcttttcaatgtggaatattccattcttgggatatactaattggttgtttttagaagaaacaatattgtaggaattacattgtgatcaagataagttttccttcatatataatacaaactttaattgaacacctgagcacttaatgctaagtgctgtaggttgaatactaaatgttaaacatttctcatttctaaagagataaaggttggagatgcctgtttctcctttgtgtttcttttctgttatttctttctaaaattggtaactataaagccatactattcttttcatttttattgtgaaattatggatacatatgaaaggaatacatagtatagatataccttgtgcaaaataacaataataaatcagagacctgtgactgccatccaaatcatagcaatcttttttgaaagtttgtttgtttcacacgtattcttttagaccagtcagtaggagagagctgcttttgccttagttgctttgtaaggccatgtttctcctcaactcttccatgtttaaaatgcactccttgtgctgagtactgatggggataccatacctgctgttctcctctcctgaaaccatcatcactgtcctctctacagttatagcagtcatctgtgtatggctacatgcatagcctgtgaatttatttggagatttgtaaagtaatatgaatacttttcatagatgcgaactggtaagttaaaatggtattaagattagctgctatttcttcagctaagtttctgttagaaatccacctccatgcctgttttggccaacactcactaatgtatccatgctgtgccactcactggtaagtgctggggtgaacgcagtgataaaccatgcaaaggtctcagtccacagagggctcacagtctgcatcactattcctcgtacagtctttttcttctcccatttctgaattgttagtgaagtatgatttatgtataaaaacatgtacaatcacaaatgtgcagctcaatgaattttcacaaactgaacatgcacagctaactagtacttaaatccagaaacagcattgccagcactccaaaagatcccttcagtgcctttccagtcactctcctcccgggacatactcactggtatgtttagtttgcctgttctttaaaaaaatctttatatgaatctaatcatacagtaaatactgttttgagtctggcttcttttgctcaacatgatgttgcaaaatttacccatgtgggttacagtttattcatgcacactgctgtctcattatgtgaaaataccacaatttatttacctattctactgtagataggcatttgaataatttccagttttatgaatactgttgctttttccctccttatgtgtcttttggtatcatatgtaaatgtttctgttggacatataactaggagtggaattgctggatatgtgtaaattcattttttgttgatattagcaaacagttttctaaagtagttgtacaggtttatactcccatcagtagtgtagtgcgagaattctggttattatatattctcaacaacatttggtattttctgttttttattttggtcatcatctgtggttttaattttcatttctataatgactaatgaaatagagcacctttttgtaagtttattggccatttagatatctttttttgtgaaatgtctattcaagtcttgtccctttttttattgaatggcttccttattgattttaagaagttctttatatattttggatataagtccattgtctgaaaaatatatcctcccgctctttggattttcttttcactttcctaatggtgtcttctgaatgaatagtagagttctcgtgtgtgtgttttggttttgttttgtgttttaggcagagtctcgctctgttgcccaggctggagtgcagtggggtaatctcggctcactgcaacctctacctcccaggttgcagtgattctcgtgcctcagcctcccaagtagctgggactacaggggcatgccaccacacccagctaatttttctatttttagtagagatggggtttcaccatgttggccaggctggtctcaaactcctgatctcaagtgatcgtcccacctcggcctcccaaagtgctggtattacaggcatgagccactgtgcctggcccaaacaagtgatttttaaaattgttcttgaaatctaaaagaattattttttttaagaggcagggtcttgctatgttgcccaggctggtcttgaactcctgggctcaagcagtccttccacctcagcctcccaaagtgctgggattacaggtgagatccaccatgtccagccataaaataattcttgaatagatgccagttgtagtccatggtcttttgtgacttttttttctcctttggaaggagctgcttaatgtatcattttaaatgacaaataattaggagcttgtttgtgcttccatgtttctattttagagctttaacatatcttagatgaaatctatatacggggtcttgagaggttaaaacagaatgtatttaccacctttgcatttaaattatggactagattttatataaattattttaaaatgagtctgatacagccattatttttagtattgtttactctgtaaacaaaagatgaccagttcctgctattctgtcaaagtcagggagccaggtgtgtagtctccttttcaacttgtctttctctagggctttaaatccttctcaaatgggccctggagctctgagctaagcctgaattttcttatggaaccaagaagtggagaaaaagaactcacattactgaggatatggactggttataaatagtgtagatgctacttcttaatttaaaatgctatatgttcatgagcagctagacttgctattaactatttggaaatattgaacaattgtcgctccttatttccgtagtctttgtaagatcatgacccatcaaggacctaccgttaacctcaaaggctcttggctgtaggttttcctcaagctgggtgccagaaaacagaggattatttgcttgataatatcttggtggagccatcagtactagaaatatttggatgtcagacacagatcccaggggttggcaggttgatgataattttctggtgccaccccaaaaccttgcagtgctactaccataaccatggttggctaattagtgccttcggggatgagggttgatttctgctagttccttgcctttctctttggatggcatgccttcacttgttacttggacctatgtaaagaataggaagatcagaagaaaaccataaaattgatgatcataggtcacagtatttgtgctttcatttctaaggactcattctaacataaataattttctctttcaaaaccaaggtgtactcatcagttatattgatacatattaacagtgatgataaccacaaaaattttaaatagaaagctttacaaacggttagctttgtgaggggatttactgcaaaattagggtattcttttcatctgttattgtattgactttttaaaacattattctgattacttagtttttcctttggcaaattttgatttttaaatgtgttttcattttgctattgagaggattttcatttatcttttccatgggagatattgaggatagtctaactctggtaattggtttggtgggtttttcttttcttttttttggctccctatgagcaacttgaagatttttttttttttgagacggagtctcgcctctgtcgcccaggcgggagtgcagtggcgcaatctcggctcactgcaagctccacctcccgggttcacaccattctcctgcctcagcctcccaagtagctgggactacaggtgcccaccatcacgcccagctaatttttttgtatttttagtagagatggggtttcaccttgttagccaggatggtctcgatctcctaacctcgtgatctgcctgcctcggcctcccaaagtgctgggattacccacacccggcctcttgtactgtaatgtttttaaggttcatccatatttcagcatgtgtcagtatctcattttttctgggtgaataatatttcattgtacagataagccacattttgtcgatcccttcgtaagttgatgaacattgttggctattatggataatgctactgtgaagattcatgtaccagtttttgtgtgaacttgttttcagttctcttgggtatataccttggagtggaattgcttgatgttaatataaatctgtgttgctgtttttgtttgagacaggatctcactctgttgctcagactgagcaacagactagactggactcactgcagccttgaactccttggctaaagtgatcctcctgtctcagcgtcttgagtagctggatcacaggtgtgccgccatgcctggctaatttttaaatttttagtagagacaggatcttgctgtgttgcccaggctggtctcagactcctggcctcaagtgatcctcctgcctcagcctcccaaagtgctgggattgcaggctgagccactgtgttttcagcctatgtttaacttattttgaggaactgccaaacttttccacagcagctgtaccattttacattcccaccagcagtgtattagagttcccgtttctccacatactcagcacttgttattgtctgtcttttttattatagccatcctagtaagcatgaagtggtattgagtcttggttttgatttgcgttttcctgctgacttaatgatgttgagcattttgtgtctactggccttttgtatatcttctttggagaaatgtctgttcaaatcatttgcccattttataattgggttgcctttttattgtttagtctctcttatcttgtcagaattatttaaaatatcttcccctaattaataacaattagatagagaatttttcttgaatgtaaataatttggtgatgttagaataacagagtttatatttacaatatataaagtaaatgtacaggccacacaaacttaatgattatttctgaacagcagtaaaatagcatactcagctgtttaccaaaagaaatgtgcttgtttactttttgtaattatactgccttgttttggtaggatttagggactatgcagaagtagtgggttggtaatgagagctttaaaaattgcattttaaggtaaaagttttagcaattaactctaagatagaagtagtaaataacattcaaaactagagttcaagcattgacccagaattttctgatatttatttttaataacttaaagaagggacttgaaacttacaagaattttcttgctgtttaaatatgaccaaaccaagaaaaaattaagtagtgaaaatacttgcaactttatggacttactggatacttcagcattatttttcacgtgctttgtttgtttgtttgtatgaattctgaggtgtatgttgataccttttctcatatataaggatttatgggttttgtttagtgtagggttttttgttgttctctcattcttagtaaatatagataatccaagaatgacttttaagtgcctttaggtcctgccatttgctacagttataaatgttgccccttgcttagccctaatcctagccccagctctgctattgcttaaaaacaactcattttagaactgcttagtgaggagggcggtggtgaagctttcttgctgattgggaactcaaataatagtttaaatctgtagggtataatgtcttaaacgtgttaaattcaagtttgtttctattagaattagaactatatatgatttctgtgttggagattcataaaaatgtcatatttatttttaataacaataggacctagatacagaggaaggtgataaggagggaaaaaaaaacgctctattttattttatttatttatttatttttgagacagaatctcactttgtcgcccaggctgaagtgcagtggcttgatctcagcttactgtaacctccacctccccggatcaagtgattctcgtgcctaagcctcccgagtagttgggactacaggtgcatgccaccacacctggttgatttttgtatttttagtagagacgagattttaccatgttggccaggctggtctcaaactcctgacctcaagtgatccgcccacctcagcctcccaaagtgctgggattacaggtgtgacttgagaacaaaaccttagtagcacctatttgtaaataaatgttttcttaaaattgaaggtcatcaaggccaaaggcaccatggcagattgtgacatatctgaagtaggaagagttttagggttcttctggggagccattctagtctgctcagcacatagaagggagcaaaggtaatcaggaaaagagtaatggcacactctgggtgtgagaaagtgaaaggtcatctgaattctcaggtgattggattatttatttcttagcgatggaggcataggtagttataggtagttctgtattaaactctactttgtatggcctgtgtaggtaattgtatagctgtatttggaaaaaatgccatttaaatcatatttcagccgggtatggtggctcacgcctataatcccagcgctttgggaggctgaggcaggcggatcacttgaggtcaggagtttggtaccaacctggccaacatggcacaaccccatctctactaaaaatacaaaaattagccaggtatggtggtgcatgcctgtaatcccaactacttgggaggctgaggcggaagaatcacttgaacccaggaggcagaggttgcagtgagccaagatggtaccactgcactccagcctgggtgacagagtgagattctgtctcaaaaaaataaatcatatttgaagtttagtaaaattggtcagaaattatatgacaggaaaaaaaatccagtgtccaacagctatttattatctatcacagtcactcaaaggatatcccccctacccttgcccaacatctctgtgcactgagagcagaagttcccagatctgtcccagttttcagatctgtctctctgagtatcccctacaacccagattctgtgacagttaaattggactcgggcttccactgacccagttgatggaagagactgagcatctttccaactctaacccaaacgtgacaatgccgcgtattctttcagaaagtgtcaggaaagagcccgaagatccctgagctccagggacatggcagggaggctgcacagaagggttcccaggggtggaaaaggggaatcttaaaaataaattttggaaccaagtaatcaattttatagcacactctagttctagcgcacatggttcctccacttgttagtgaatgcctgacttgttgcccctgaagtgtaaaaagatgtatatttaaggattccattgttcagcaagttattatgcatgcagatggcaggcactaagtgcttactctttttgaaggtgattgcctctccccgcgatccccctacattgcagtgttttgttttaaacagctttcttgatggagcctaatcttatcaccagcattatagaaataagccagagtgagaagcctgtacagtgaggtcttgggattataccatagtcataatggtgttttaaattgtttttatttttcaattgaaaaaagtacactattctaaagtagtgaattttagtggagcaaactcttcacctggaagtgtttttttccttaccaaagtgaaaattggtggttctaagaaggctggaatttatttgcactgtcatcttttactatggtgggggatgatcaaatttaacatttccaagtttccaggagacaggcagcctatcttataaatattgtcatagaagacctcttaacctctttgttctttggatttctgtatttcttagaattgtcatgcttcctttctgagacctaaattatgcaggggtaacgtgattactttgacaccaagctcaggaaatataaaacgggttaagtataaaccaagctaggtttaaatgaagttcattactggctacagtatattaagggaacatattcgaaaagtctgtatttgcctttgttcttgctgctgactcttctgcttcttttggtgaccttcccacagcacaagagtggttaggtgtgaggaggctaagaataccttgccaagagcttcaaataatgttaaaaccagtattttaggtgaaccatggtcccaagaactctatttaagtaattcctagttcggtgtcccaggagcatttggctttactgcacctattttggccacatgtctttgtttaaaaggaaaaattatcttaggttataatacagctattttgggagtaccttaagtttaacattagattactaggattcgaaaaaatgtacccagatggtagatgctgatgagaatttgacacaagaattcatttgaaattgaagcttttgtagtattagtcagaaaaatttattgacatctggttttgaacagcatagtgagtggagattgagatgatcagttaaaatttaatggattgtggccgggcacaatggctcacgcctgtaattccagcactttgggaggctaaggcaggcatatcacctgaggtcgggagtttgagacgagcctggcccacgtctactaaaaatacaaaaattagccaggtctggtggcatacgcctgtagtcccagctacttggagtctgaggcaacagaattgcttgaacctgggaggtggaggtttcagtgagccgagatcccaccattgctctccagcctgggcaacaaaagcgaaactacatctcaaaaaaaaaaaaaaaaaaagaaagaaagaaaatttaatggattatggagctctacttcacattagtacacctcggtctctctgtttttctgtctcaattcaagatagagttctttgtagcggtatggtttagaggtggtatgtattttacaagtatgtcagttggctctgtatatcctgatgataccgaagccaggaccagacccctacgtcagttatatcactaaatattctgttattaattttcagattggctcctagtcccagccaactcatgttttaaattaatatagttcattgtcacactggactggaaaaaccaaatgaaatgtctttattctatgaagatgacttgtgtagactatacagactagcaacagcagacactttcagtgcgagttattttaaaaaattgaagatttgactggcagaaaagttgctgagatagggaaaagggatatctattgacagatatatgtagaattagggagaattttatgttttcataagtgtctcaattatttaagatttaatttggtgtgcatgtggaatataatggtaacatggtttgtctgtgatttgtcttttgtcttaacagattatttttctaactttaaaaaagtatacatcacttgaggccaggagttttaaaccagtctgggcaacacaggaagaccccatctctacaaaacataaattttaaaaaaagttagccagggtcacagtgtgccataattgtgccactgcactcctgcctggacaacaagagtgagatcctgtctctccaaaaaaaaaaaagtatgcaagtgataaatattcactacaaaatatttgaacatgcagatacacaacaaaaaggaaaaattcccctgtactcctattacctagaaataacagtgttgaactgtaaatgtctcattctaggcctcctttccattatatgtctgcctttttaaaaaggattatatgatgcctattgtttggcaagtttagcttttttcatgtaataatagtacactgtaaatatctatttgagtaatgaaatttaatttttttttttttaaagacatggtctctctcatgccccaggctggagggcagtggcacaatcttagctcgctgcagccacgacctcctgggttcaagccatcctgctgcctcagcctcctgagtagctagaaccacaggtgcatgccaccactcccgggtaatttttgtattttttgtagagacagggtttgttttgccatgttgcccaggctagtcttgaactcctaaactctcctaatctcaagcgatcccacccacctaggcctcccagagtgctaggattacaggtgtgagccaccatgcctggctgaaatttaatgtatattttttttgacacagagtttcactctgttgcccaggctggagtgcagtggcaccatctcagctcactgcaacctccgcctcccgggttaaaacgattcttgtgcctcagcctcctgagcagctgggactataggagtgtgccaccatgcctggctaatttttgtatttttagtagagattgggttttgccatgttggccaggatggcaaaatttaatttttaatggccgtttagtagtcctttgtgtgatgtactataatttatttgtctcctatgattggaatttaggttgtttctaatttttgctgacacaacacttatatgtacccattttgcctctttgaatatttccatagaataacttcctgggagtagaatacttttcttaaaggatttgtgcatttcaaggctttcaaaatacgttgccaaatagctttcgagaaaggctatttatttcagtttttgggttcttatctttctaattggctttatgcttacattaaaatatgaaatttttatttagttgcagaatgaagaagagtctggagaacctgaacaggctgcaggtgatgctcctccaccttacagcagcatttctgcagagagcgcaggtaggtaacagggcaaggtgatcacggaatccttaaaaacactctgtgctttgacattacagtttaaaaaaaaaaaagcttcagaagcagttggaagaaaggttacaaagcaagtctggattttaaataattgagaagtggatacatttaaaaatcacccccagtctcttacattcatctaagaatgtcttttggttcaattgttatgtatgtactcttaagggaatggctgggttttgtctgctagagttagtggaactccttttatttcaattcagctaatcatcaaaaaattgtgactgttaaaattctgcagcatattttgactacaaggatgagtctgggtttccaaagcccccatcttacaatgtagctacaacactgcccagttatgatgaagcggagaggaccaaggctgaagctactatccctttggttcctgggagagtgagtataatttgccatgttacttgatggctgctctgtgggaattaagttattttcattatccaattttgattcgttacttatgattgtattgattagtgaaagtagagctaattttaaaaatcaggtacatttgcttttgggataataaactcatctcttcttaaaaatgatgaggtaaattactagtcagacctgctcatttttccttcatctctcctattaccactactttttcaagtctcctgggatggctgaagtatcttgaagcagaagcacactaatgtttccttgattctgcacacttaatattttgctgttgggtggatagctgctagggaggtctaggaagagaataaatatatgcaaatttgtagaattaaactcataagagggatcttcacattgatttagatgaactccgttcttccagcagtccagatcatgtcatttgtggggacatagtgagttcagattccatctagcctgatgttgattcatggaggtggagattgggatgccatataaaccagtggagattattgggcactcttggttcttgatgtcagatatgtgagtgctgcatttgtcattttgtaaatattcatccagattgaggctgatgaaggtagggcattgtgggagaatggaagcaggataagtccccagaaatgcggggaccatcaggcctctaggctctattctagcaagtaactggagtgagtgatgagcaagtacagaagcctagtctgggcagtgtgatggcataggcccagatgttcccctcttggctttaagatagtagacagtttgcagaccacacctactgtgaggagcgaagctcctaaaatcattgcttggtagaaatagtttatgagcccaatctaggatgatcctaaatggcgatgatgtgcattcagttcttacaggtaccagggagaaactaaaaaccctagtgtctaagggcaagaccatcataatgtaactgccgtatattggaagcaaaccacatgcttggtactgtgcttgatgcttttatatattttgtatattgtttccaatcttcatagtaaccttgaaaggtagagattatattatctccattttacagatgtgaaaatttaggtccagagagaaaaagtaattttcccaaagtcatatgactgataagtagcagaagtgaaagtcaaacccagatattctagaatccaaagtccttgtttgtttcactgtactctgcagatctgttgcaatatatggtaaatagatcagtatggaaattagctctgattaatcacataactcttcagaatactttcatttgatacaagtacatatttaggaacttcttaaagggctctagtattcagcagacatgtataaagcactttttaaatataagatgcagtatattttacagtggataggtaaaaagctttgtataaggcagtgttcctcattgttattcaaaagcctaaaatccaactagggtaaagggcccacaaatactgataactaagacacataagagcagtgggcatcaagaactgaaactttttactgggtgatcataggggaaaatgagatttgatgtgggcccggagttttgatgggtaagaacattccagagggaaaaaggcacagaaagcaggtgtgaattcagccaggtgaaggcagttctgtggatgtagtaattggctttgtatgagcaagagtttgtgaagggagatagaaagtcctgactacaactgttgtttatagaatctttggaatgttagatgggcgtatttaaacttcatatgtagcttttagagaatccttcagagtttttgagcaggggtatgagaggacttgtgtggtgttttggaaacattaacttggcagcaatttctaggatgcatcatggtagaagagataccaagaggacaggaagaacagttagaaggtgttcgtaatattattagatgttacttccatatattttttggagtatatctttgaatagttatgcaaaaaacaattagcttttaattttggcaaaaccttattctgctgatacgaagtaagaatactaggtatttaatgttttaaaaaattaattataaaaattcgtttttatagaaatttcaaacaatagaggaagtatgttaagttagaaaaggaagctgccattgccaccgacttccctttctctagttcccactccccaggggaaccactgttaacaatttgggtcttccagacccttttctgtgtacaacaagttttgatattccctaaaatatttttcatttaaggagccctcattgaactgtgtacaaatctatcacttttaagtatatattcaattatttttaaatatctcaacacacacctatatcagttaaaaagatagcccacatgtgttggtattgttcatgatcatgttatttctagttttgcaatattacgttatcaagttaggatggaaaagatcttatctgctgataaggttagaagtgagatttagatctgtataccaatacaaatacatgcttatggagttgagcagtgggcagttctgtggactattcatgtatgatcgtactattcttttttcccctatatcagcctcgtaaagcacttgagctggttgattttatctttttttttttgagacggagtctcactctgttgcccaggctggagtgcagtggtgggatcttggctcactgcaagctctgcctcccgggttcatgccattctcctgccttagcctcccgagtagctgggactacaggtgcccgccaccactcccggctaatttttttgtatttttagtagagacgggtttcaccatgttagccaggatggtctcgatctcctgacctcgtgatctgcctgccttggcctcccaaagtgctgggattacaggcatgagccactgcacctggctgattttatctctaattactaatattttaggtcctaaacaggtcctcgattactgatattctagaatttaaaccaaatgtgtaagtaaattttgtcttttgtcttttcttgaggtatatttttttaaaggaagagtaaatagttctttgtgaactattcttgaagtgtattgtttttgaagtgtattaaatttttgaagtgtattgttaaagaacttgggttataagatgaaaatttcatttagaacactggggatagaagaaagatttgcttcttttctaattatatattaataatgcaaaatggaattttaaacacacattgagcctttaatgctcataattttgaactgaaccaaagcaataacttttttccttgctactcaaatttaacccttcatttttctttatgtcttccctttgcctagaaataattctttttcttttcatttaggatgaggattttgtgggtcgggatgattttgatgatgctgaccagctgaggataggaaatgatgggattttcatgttaacttttttcagtaagtatgtatgcatatcagaaccaccccctacaaactagagtgctttggattatgggtgaatctgactgaattaaaataactagttgagctaatatattaatacattatgtttatttggtgccttttactggaatattcaaagcttaatatacctttgttttaatatcccttctctttgccttctattttcatgaatatctgtggaaaatataattaaagcagttatgaggatgctgcatttttacatgagctaagcctcatcttccaggtctacggggcccttttgcgttgcttctactcatacttaatctgtagaataggaattaaatgcctttgatgaattttgctctgaaagcttcttttttctgacagatcaaagtcagcctgattttctcccttcatgttacttgccatttatctttttgtgtgcctcacatagaagtgagcaaccatttcctttatttgttgtattagaaagataagaaaatgcaatgcttttagaggtgatgttatataagttgtcaaaattcagagaacaggaggatgagtgacttgaatcagattatttgggggcacttatttaatgttgaaggcatttattttatttactggactatatatatataacacacacagtaaaaagcagaggtcaggctgggcatggtggctcatgcctataatcccagcactttgggaggccgaggcaggcagatgccctgaggtcaggagttcgagaccagcctggccaccatggtgaaaccccatctctactaaaaatacaaaaattagctgggtgtggtggcaggcacctgtaatcccagctactcaggaggctgaggcaggagaatcgattgaacccgggaggcagaggttgccgtgaggtgagatcgcaccattgcactctagcctgggggacaagagtgagacttcgtctcaaaaaaaaaaaaaaaaaaagaggtcaaaggctgggcacagtggctcatgcctgtaatcccagcactttggaaggctgaggtgggcgaatcacctggggctagaggttcaagaccaacctggccaacatggagaaaccccatctctactaaaaacaaaaattagccgttagccgggcctggcggtgcacgcctatagtcccagccactcgggaggctgaggcaggagaatcacttgaacctgggaggcagagattgcagtgagccaaggtcgtgctactgcactccagcctgggtgacagagtgagactcagtctcaaaaaaaaaaaaaaaaaaaaaagcagaggttgtaagtatacagtttggtgaatgttaaggtttgctttttgctgttttttgttttttttgctttttccttttgagacaaggtcttgctctgttgcccaggctgaatttggagtgcagtggtgtgatcacttctcagtgtacccttgacttcctgggctcaagtgatccccccacctcagcctcccaagtagctgggacttgcaggtgtgcaccactgtgcccggcttttgtttgtttgtttgtttgttttgtttttttcagtttttgtagagatgggtctcactgtggtgctcaggctggtctcaaactgctgggctcgggatcctccaacgttggcctcccaaagtgctaggattacagatgtgagctattgtgctcagcctattaaggcgtttttgaaagtgactagcagtagacataagtgtgtaaaacctgatagggaggagtttttcttgtttgctttttggggaaagacagaagaatggatgttttagaggaggtatggtgacggttgtggaggacaggctgtcttttatcctttggaaagtcatttaaacagaggcaggtgtaaggcactcttgttcttgggtaacaggacatgtctaacatctttcccctcctctgcttttgcagtggcattcctctttaactggattgggtttttcctgtctttttgcctgaccacttcagctgcaggaaggtatggggccatttcaggatttggtctctctctaattaaatggatcctgattgtcagggtaagttgtataacagaaaagatgggctctacagagaggcaataatcagaatatttttgaatattcgatttttcatttgcttttttaaaagttatttcagtgtgttaaatgatttttggtttgtctgtggtttcatgatgaagctgaaccaaaatcatttgcaaatggttcatgcacacaagttttgttgtcaaatctattgaaaactggtctatcattaatattgttcaccatctgctttgtttgtttttaatgtttataatatgataatgtatatgttctgaaattagttgtttttataataaaaggaaggatattacccctttgatatctcatcaaaagcagccattcctctcattaattctgttacagttttaatctagctctcttcttccttcttttcttttctccttctcttcccctctcccttccaggattgcttatgccaaaatgtttggggagccaaaactgtttaacaagtattgctccattaggagcctacctctcaagtaaattacagagatgtatgtctttagtgacttcagagttaccagttagttaaatttgcatgaagtaatttacagttgtaaaagatctaggcttttaaagtatcctctgatttcagataaatttattgctatcgtcaaccttataaacaaaaccaatttatccgtcataaattggcatacttaactaactaatgggtgttgcttgaccactgtagtttttctacgtagtgccaccttatttattataaaacatttgttaacgtttttagggttccagaatcctttgggaatctgatgaaagttgtaagcttttcccccacatagctaatatgtactcatctataataatggactttaggttaagaactcgagccctaaagaggttttcattccttccctaaattttaattgttactttattaacaaagaaaatactatattttacttttcgaactacattaaactcttggacaccaaagcctccaaggaaaagagaaataaaattaattccagtcttttttttttttcaaactaaattttcaactgcatttaaaaagtgaatcaaatgggccgggtgcggtggctcacgcctgtaatcccagcactttgggaggccgaggcggacagatcacgaagtcaggagatcgagaccatcctggctaacatggtgaaaccccgtctctactaaaaaaatacaaaaaaaatagccagacatggtagcgggggcctgtagtcccagctactcgggaggctgaggaaggagaatggcgtgaacccaggaggtggagcttacagtgagccgagatcgtgccactgcactccagcctgggcgacagagcgagactccttctcaaaaaaaaaaaaaaagttaaatgaattaacttgtatcaggtaggatgcttttgactgtgagtaacaaaaacctagctcaaaatggcttagaaaaaaatttttaattgtttttttaaacggggaaattttatttcccctgaaaacaagtccctgacaaggttagttaagtcagtggttctttgacatcatcaaggacagctgacatatcagcatattggcacaggtcccccctcccctcagggttaaaagatggcagtttcacgtatcagtattacattgaaacacgacagtgctcaagagaagaaaaagaactatttaaaaaaaaattttctaccacctttagaaagaactgtttttttctttgagaagcaaggaaagcttctcagaagccctcaatttccactggtcagaatggcatcctgtgcccattcctaaaccagcaagggaaggggattaccctggtatacatgataaagcttccaaagtcaagacaaggctggaggagtaggaagaaaatcaggcctcattagaaagaaggcaatggtatcatctactcaggaggctgaggtgagaggattgcttgagcccaggagttcaaatgcagcctggacaacatagtgagatcctgtctcttaaaattaataataataataattgcttttggcactgaataggcaaagtaaaacgatcattattgaaacacatttctagaagagcaaatattatgtggggaaaatgttttctaaaaaaaccaatttttgtatactttcaaaataaggagttaataaagctaaaagctgtcatatttaacaattgcttttccttgaaaggaaatagatttgcatttattgtaaccatttcaagctagtaatatgtaaaatactttcacttatattttaaaattattctaaaggctaagtgatggcattggtagaacaaataagtcttgctggtcacggtagctcacgcctgtaatcccagcactttgggaggctgatgtgggtggatcacctgaggtagggagtttgagaccggcttgaccaacatggagaaaccccatctctactaaaaatataaagttagccaggcatggtggtatatgcctgtaatcccagctactcgggaggctgaggcaggagaatcgcttgaacctgagaggcagaggttgcagtgagccgagatcacgccattgcacttcagcctgggcaacaagagcgaaactccgtctcaaaaaaaaaaaaaaaaagaataagtcttgcattttgtgattttgtgtacccttaagttaaaatgagaaattgtgtctgttaagctgctataaagtgttttgccttattttttagttttccacctatttccctggatattttgatggtcagtactggctctggtgggtgttccttgttttaggtaagtgtttttaatgtaagaaaaggcaagaaaacattacattaaattttataagtaaaattacttgtagtaaatgttcatcttgattactgtatagtaatatattaacaattaataataaacatttttaaaatgttgctttcttaaaaatagtctttcgttaccatcagagtaacatgcacgttaataaaaagtttctttgtggttgtaggttcttcctaacctatacatatattcttctcccccatgtgataaatggggtatgctgatgactctgtagtctgtcagtttttttccccttgtgagctattgccacacagcattcacagactcaaaccagaattgcttatacgcttactgcagccagttgaactaactcataagtgcaggtggcccatctttggtgggtctgtcagtagaaaacagaaaatatgtaacctcgctagacataacttctgaaagaaccaccattggatttccagaatgctttagtttaccgttggtgagaataagaactattttacaataggcaagaggacttttttttttttttttttttttttttttacagagtcttgctctgtcgcacaggctggagtgcagtggcgtgatctcggctcactgcaagctccacctcccgggttcacaccattctcctgcctcagcctcccgagtagctgggactacaggcacctgccaccacgcccggctaatttttttgtatttttagtagagacggggttttaccgtgttggccaggatggtctcgatctcctgactttgtgatccgcccgcctcggcctcccaaagtgctgggattacaggcctgagccaccatgcctggcctggattatattttttactctaaatatttatttttaaatacttttttcctagacattaaaacaaagagatgaacattggagtaaattatttcaatgttggcttcttgattatatgtaaagaaaatatatatgatacagttagagagaccaccatcacttctgtcatttctacaaaagaataacagggccatcttgtggctattaaagatggtgtgattgcctcactgtgcttctgtgacatcagtttctcctatgtcctgttttgcttcttgttgcccccttaattaagatccttggtggtggttctgctaatggttctggctaggacatcctggcacccatgcctggcaggtgtttaataaattgaggacctgggccaggcatggtggctcacgcctgtaatcccagcattttgggagactgagtcaggaggatttcaccttgaggccaggattttaagaccagcctgggcaacatagcaagacctcgtctctacaaaaaaatttttttaaattaaccaagcatggtggtttgtgcctgtagtcctagctacttgggagactgagccaggaggaccccttgagcccaggagttggagcctgcagtgaactatgatggcgtcactgcacttcagcttgggtgacagcaagacagtgtctctaaaaacaaaacaaaacagttcaggacctgttttgccaaaactgacagagccttgcattgctgaccctacattttacttagaaaacataaatcattcatcgcaccatctaccacctcctcaacagcatcatgtactctatgattggtcattagaattctaaggaaagagaaatagtaattttttttcctctattgattattgagaacttcagtaataaaaatgaccaacaggagaataatttagaagaaatagttccttggcttgcttattttctaaactgtacctttaagagaaaggctgaccacccgtgtttccccaagtcaaatcctgaatggaccaaagaggagcccttaagcgtatgttcagattgattgcttatggcataaataatttaaagaaatttaatggattgattcccttttaaagtttcatgggaggaggttttataatccttcatcattgatcattcttgctatgtaccatttgcttgtaagcaaaaaataagagtttggcccggcgtggtggctcatgcctgtaatcccagcactttgggaggccgaggcaggcagataacttgaggtcaggagttcgagaccagcatggccaccgtggtgaaaccccgtctctactaaaaatacaaaaattagctggctgtggttgctcatgcctatgatcccagctacttgggaggagaatggcttgaacccgagagacggaggttgcggtgagctgagatcgtgccactgcactccagcctgggtaacagagcaagattccatctcaaaaaaaaaaaaaaaaaaaaaaaatatatatatatatatatatatatatattaataagagtttggatacacttatgagcatttgtgcccaatattcgggtcattttgggaacttcccttttgaagagaaccagtttaatggtgttttgtcttgcagagctctgtgcagagctcccaagctggctgctcttgagctatagttagcctatagtttatttgttccacagttatttttcaagtttttttaaattagttgccaacattttaaaaatcaaaattatttcacataaaacgcctgaatgtttttacttttcttgaaagttggaatatcaagaaaagctagcctacatttcacatggcaccctttggctggagctgagttgttgctgtctcctccatacaggtcatgtgccttccagttcagtaagatcccaccaccataccccaacttagtatttgaaggggtaacccctgctcaatagtcacttgttgctttgggtcccaaacagaatgatgttccccaagctcagagctgacagctcttggttactgctaaaaatcagttcaactgtccaagtaccattttctaccactgagtatcccagtaaaagtatttaaaaaaaaaaatgtgctaaaggctcagagaccatctctgaaagaggaaggccaggaggagtatctgagtttccactggaggggcatatcacctctctgctgacagttttaggaggtacaaacttttgtgaatgtatagattctggtgtagtcacacaaaaagagtcttactaagaatagagaaataggctgggtacagtggttgacacctataatcccaactctttgggaggctgagacaggagaatcacttgagcctaggagttgaaggccagcctgagcaacatagcgagacccctatctctacagaaaattaaaaaattagctgggcatgaacctgttatcttagctacttgggaagcagaggcaggaggatcatctgggcccaggaattcaagcttgcagaggctgtgatcataccgctgcactccagcctgggcaacagagcaagaccctgtctgttaataataataataataataataataataataatagtagacaaagtttcaagttgagacgatgagaattgctgtaatagataaggggatcctgacatctagtggacaacattatatactgtcgacagaaaaaacagcccatgacaaggaaggttacattttttctttttacttgagaaaaacacagttataacctctttttgttgttgttgttgttgttgttgtttggagttcattatcttggaatgcttttttggaactcaataggtagattttgatgtttctcaatgaggctttcatatgtaaatgtttggctccatcttattttttatttcctttttagaccaattcaattctgaatgtgcaaaagacactattgactcttacattataccttctcattgaaggatggataatttggtatgaaaatcctctgcagattctggaggaaattgctaatgttttgattacctttagcagaaaaataacaatgtatcgctatcaggagagggatttctggggaggggacttaacatggaaattataaattcattcatgacttttcttttttaaattaggctttctcctgtttctcagaggatttatcaattatgcaaaagttcggaagatgccagaaactttctcaaatctccccaggaccagagttctctttatttattaaaggtattaaagaaaaaatttattctagtcccagtgtaaccatgtgctacattgtagatttctgttcagttttagagtaagtatctgtgataggggcatatagagaaagtaaagaaggcacagtccctgccttttagcagtttcttgtctagtaacagggatttttacaaaaagctattgataaagtcaaattagaaaaactgccataggagaaatcattacttcatgctttgacagtgtgaaagaggcaggggtcttagcagtcatcagaaagctgggatatttggctgcttgactgaattccagcatcctgaagccactgcttactgttgcaccagttccagaggatgacattcagaaggaacccttcaggcctaatcactcatctctgcccctaaatcccagaacctggagagactgtgtagtactttaagaactccttttgtctgggctgctgacaagcccaccaagtcttccatcttttaaaattgtcattgaggctttccccatggctttcttcaggttgacattctgataccactctaatgtgaggaaggtcaaactcaagaaaagaggagaaaggaccttttcccttgcctagaacaggaggactaagccctgccaaggctctttgattcacacatgattttccccagaggctgacactccatcttacatcaatggctgcctgaaggaagaggtagagaatcttgagaaagagtacaccagagagagctctctgtggtagcaagttctaataggctttcttggacttggctgtttgttccttggggctttggggactgtgttaatcatagagtggaaccttgagcaccacctagaggccagtccagttgaaggtcttaggcaaagcattataaaggataggtggtgtagttcagataaactttacatgatagtggagagtgtggggaagaatttcagaatcatctgaggcagagtgaagagcaaaaatagggaagtatggggcttgttcagaggatagcagcttgattggggcataaaggagtattgagggtcaaggctaaaaagtcaggttgaaacaagtttctcagataccttgagcaccaagcccatttgcagtagaaccatgaaattgatagagccagcgacatgttgggtcaatgcaagactaagcccacgtggagcacgaatttgttctgtactcgcagagtgtcagtttatataggcaatcatatactaatcgtgaggttctcaattttgaagacttgtggtggtctcaggaggtatgcttcaagaaaataaagcatctaccatagttgattttccaggtgatagaacagcattgaaagcttttaggcaacagaatcatataatgagaccctcttgaatataacaaacattttttcaagcatagtatagtaaactaaaattaacactcatggagttttccatgtgtcagataatatattaagcattttacatggataattaaatgtatgtaggtaaagaaggcttaaactgcttttaaagttagtttcattattaaaaaaactagtattcattattaaaaaacaggaatctttgattgcatgtctgaaaatgtgtagcatgtcatgaatttgaattcagtcacacagtctggacacagatggatattcataccactggcctgggccttaatgcctacaatgtgtctttgtttatgtctagaacataagagacttattagatattctttgcagttttatttagttaccattgtcatctttcatctatatatcagattggaatttatagttagccttaggtttaacttttacctatcaaggattccaaagctagtactgttgggttgctacaagtcctccttatgaagggtgctgaaatcacctaatattttccctctaatacattgacacccaagatatactgaggggacagatttctttctctttttaaaaaaagtcatcaattctgtaggtgtagtctaatgttagctctgaatttctaaatggactgagatcacacctctgtctattctctttgttcttcagttagaaagaaatctgaatctttattaggggattgcataccttcttcatcttggttctaagcataagaaatagcagcccagttgacagaaagcctgaacgtctcagttttcctgtgttgtttggtgctttactgaaaattttgttgttattgtttggattttctaaaatttctgaaatgttttttgatattctaaatttaaaactatgtatgtggggttgtgatttgaagtaggcagtccttagtaataataatgttgtaggaagtactaagggagattcaagtgttgagcctgctggtgcttcaggagtgtacgttaagagttgtcagaaactttctcagaggtaaatgaatgcacaccattggagggcataatagagtttatttgcttttctatttaactgtgataccctggtttatttgaaatcattcctgacacacccagagaattcagagctctaaattaagggtttgaggaacttacagcagaatttagaattctaatgacttcactaattttccagggatccccagagggaacctgaaaagccataatatcctatgggactgagttccctttgtccactgaaagggtaagaactctgtccagatccagatgtagaatcccttctttctctagttcagaggacatttagtttaattttgttagaagacatactagaaaaccgtcatgtgaagtaagaaagctttatttttttcctccctatcgattctttattatgcttatcacagtttttaaaaagtaattatctgctaattccaacatcaggttagataagtctatttgtattgatggatttttctcttgactctgggttacattttcctgtttttacacacctggccagttatttctttgttgcagcattgttaattatcatgttgtagagattatgagctctgaattttgtcagaaggttgttgagtttttgcctagcaggcagtcaaattactaaaggataaatttgatcttatttctaactgtcatgtacagtgattcttctagggagatagggataggggagagggaaaatgtagtttaaaaatcctaggctaactcctgctgaggaaaatcactggtaaactagtgactactctgctaaattgcctctcttgacattgtcaacctgaagccatcaaaaggatcagaatacagagtttatgcaagtagaaagctgggaatggccaatcagagaacacaaactttagaaaatggggtcagtgttcccaaaagctttattttcttttatggacttctacttctttgatggagatgtcaccaattaaaaggtagctgaagaaagacacaggtagggaatttttaaaataactttgccagaaagatacagatacagaatttttaaaataactttaccaaaacagaaaaataatatactttccatattgtactaagatttggcattttactagaaaagggcataagaatagtgacttttctagtcaggctacctgaaatatagtacaaataaaccaatcttgaagtgatcccaaaacacctccttctaatcagtcaaagtagatattacaaaagctaaacattaaagctcatgtactactatcataggggcagctctcaggttccttttcagagtccatttaagcttaagggagggaaaaatgtattaataagctgttatctgttttcctacttcataacaaaatgccagaaggaactgctaaaggtgtgcacagtggccatcaagaagtatgtgactgggccgggcgcagtggctcacgcctgtaatcccagcactttgggaggccgaggtgggcaggtcacctgaggttagaagtttgagaccagcctgggcaacatgacaaaaccccgtctctactaaagatacaaaaattatctgggtgtggtggtgtgcacctgtaatcccagctacttgggaggctgaggcagaagaatcgcttgaacccaggaggtggaggttgcagtgagccaagatcacaccactgcactccagcctgggcgacagagcgagactctgtctcaaaaaaaaaaaaaaaaaaaaaaaaaaagtatgtgactgaggaagcagaagaaacagatacctgttataaacatctgtacctgaaatggtaaaaaatgtaaagtgtttatacttttcttatttaccagttcactggaaaatacatttttatggattaccacctcctctgatgctgccaggtgaatgaggagttagctacagtaataaggtggtaacacagttgattggttatatctaacactatttgtgtggtaccaaaagcacttgtacatatgaagcataatatattttaaaattatttattttaactgcatctgaaatagaaggaaaaaaggaggtttttgagccctagcattaatgagctagggccttcataattaaaaaagtgacctagtgagctgtacctattaggcatcaaatattttaatttttttccatgtgataacagacactttcatttctccttttctgtaatttttctcctgttccttaatacttcttttattttattaaaggaaattcatctcaaggtaaaggtttacttattggactatgttataagatagcaagataatagggaaatggtgtttccagtagaatttttgctaaacaaaatttacatgtctccaagaagaactggttgtcttcctcttggaattaaatgatctgtaggctattggattcctttttttttttttttttttttacaaagtgatctgatctataatttagtaatacggtccagagtccctaagatctgtttgttcttcagtttgtgtactgccagcatttctgtaacactgccactcaagcctccaagtctcagacagcagtgccctctagcagtctttcatttggagattgtgtggtgattgagattacccactggtgacctctctaggtcctcttgagatattttattttaatttaatttttacttctcttactgaacaagcaaagggatttttaatgtttgttgggtgtcaggctttgactttgagggatctattaaagctgtttacctatgctaaagcatcataaactaaggaagtggccaggtaattgtccgtaccatattgtatattcttgcaaactctgttttgacctactagtcactgtttcatcagttttcatctattaaaagaaactgggccaggcatggtggctcacgcctgtaatcccagcactttgggaagccaaggcgggcagatcacgaggtcaggagatcaagaccatcctggctaacacagtgaaaccccgtctctactaaaaatacaaaaaatcagctgggtgtggtggcgggcgcctgtagtcccagctactcgggaggctgaggcaggagaacagcatgaacccggggggcggagcttgcagtgagccgaaattgtgccactgcactccagcctgggtgatagagcgggactccgtctcaaaaaaaaaaaaaaaaaaaatatatagaaactgataaaacaaattatttatgtttataatgagtctggcctcattgcaaaaacattcatttaatattcatctgccaattttcttttttgcttctgcttggcttttagagttcctcatatttttgtgtctctgtctctgtgctttccgaggtctttcaatctcttatgtctctcaatctaaagaaaagatgtccttgtatcagtttcagtggtttacttcaaatcacaacacaaatgaatttatagtttggaaaaatgttgataatattaaaatatgttcatttcctccagtgtgtttgtagtctctctccattttggcagccttttaaatacttacgcagtaatctaatcagaaaagatacagaagacaccgggcatagtggtgcacgcctgttagtgccagtcacttgcggggctgaggcagaaggttggcttgagccctggaggtgtaggttgcagtgagccgagctcgcgccactgcactccagcctgagtgacagactcttgtctccaaaaaaaaaaaaaagaaaagaaaagaaagaaaagacatagaagagtttcttgtggcttttatagtaatttggaggatagaaaagtaagttataggccgatatttgagcccatccaactctcacttcttgctgagtaccacaaaatagtttctcaataaatgtttattaagcagtaaatgtatctctttagtgtttcttcttttattcttaatagttcttcttttattgttaatatagggaattacttgtagtttttcccaagttattttcatgagaaccaaaacaatatactagtacagaaatgcctcaaagtattagatgaaaactgcatttagtaaaatgcgtaggcattatttcgagagcatttatttcagtcagatatattcctttcttaaaatttagtttgaaagtacatgtattattttaagagaaacatgccccaaatacaatgactttttaggaaaacttgttttttaaaagtatttgtggtacctgtgagtttatccttgttttctaattttgccatgctcggttgaggtatagcatgacatggttggcatccttactggaaagcttccttgtgcaatatctagtggaattgttagggtaaacagtatcttcaggtatattaggaaaattacttgtgcacttggattatgctctctgtcccaagtttcagtcattgctgacagcgttcagtgtgggatgcgcagtagcactgcttccattgtattcttttgttaagaggtttggaaagagagactcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattag

SEQ ID NO: 38218 - DNA, 49602 bp, Homo sapiens
atattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgaggtgcgggcgcggcgggctgggcggggggcggcggcgcggggcccgggcgccaggtgagctccaggtaggtgccaggtgagcgcccgaggcttccggcccgcgcacctgccctcgctccgaagtccgcgcctggtggcgcccagctgacgccgagcggtgtcggagttggttgaccccctggcgcggctggtgctttctggatcctccccgtagagatggcttggatttttccttacccctttcacagtcgctcctttcatttcgacaccctggcagtttgtatttcttcgtcgccttttttccgcgtttttaacccgtgtagaccccagggtgcaaatccaacccggagactgcccgggaaactaacagctggagccaccagcgccacgaactctttgggtttttgcaggctttaggacctgggaggggtgcccggatctgcttgctggggatgttttttttttcttcttcttcagttaaagcttactgttgggaattacgaaaaacgtaggcgaagtggtaatagagggaaaagctcttttactgagtaaagttaagttaagtttctcatgaaacctcctggtaaatgactttctaggtgaacttacattaggtgagagattatttttagtatcgcttttatattttatcagttgatgaatctcaaagtcttgccgtcttaagaaagggctttttcatcgagtgcttgaaatgtaggtttgtgagttgatcagaggcctcaaagcttcaggtgggttgaagttgcaatagataattctttgtattctgactttgaaagcgtttattttcacttcagtgtccaaaattttcacacacagaaaagttgaaaaagtgatagatacatatgcatatatactctttctagattctatgacgttttgctgtatttgttatatttgcctacaaaaatgattatttatttatgtggagacggagtttcgctcttgttgcccaggctggagtgcaatgccgcgatctcggcttaccgaaatctccgcctcccgggttcaagcgattctcctgcctcagcctcctgaggcaggcatgcgccaccatgcccggctaattttgtgtttttgttttgttttgtttttgagacggagcctcagtttgtcgcccaggctggagtgcagtggcgcgatctccactcactgcaaactccgcctcccgggttcaagcgattttcctgcctcagcctcccgagtagccgggactacagacgtgcgccgccatgcccagctaattttcatacctttagtagagacggggtttcaccatgttggccaggatggtctcgatctcttgacctagtgatccgcctgcctcggcctcccaaagtgctgaaattacaagcttgagccaccgcgcccaggcctgattttaagaaagttttccaaattcaggaaggtgggcaaaaaaaaaaaaaaagtcttacaaaacaacgtaatctttcttggtcactgaaacttactagatataggcgagttttatatggaccgtttatggacctttcttatttagaaatctaatgaactaacggttagcttgatagatacgtctggggcatttgccatatcttggtttcccatttctcaggttttaataacagtaaccttgaaaaaagttgatgttcctctggctgtgaaagggctgctgtacctgtttaattattgagttgtgatgataaagcaggctgtatgtgcagttccttgttctttggatgaaaaagtaaactaggggtatagcgtcctagtaatgtaatttttagaaaatattcaactttaggtttcaaaattggaaatcttgattataaacatttgtctttttttttttctttttttagacggaatctcgctctgtcgcccaggcctggagtgcagtggcgccatctgggctcactgcaacctccccctcccgggttcaagcgattctcctgcctcagcctcccaagtagctgggattacaggcatgcaccaccacgccctgctaatgtttttatttttagtagagacggggtttcaccatgtttgtcaggctgcttttgaactcctgacctcaagtgatccacttgcctcggcctcccaaagtgctgagattacaggtttgagccaccacgcccggccataaacatttttctttttggacaaaaataacattattatagacattttagaaaatacaaaaaaaaagaaaagcaaaattaaaacatattcctgagtgaacattttggtttatagtttttgagagttttccgtgtggataaaactcggtggaaaacaaaaacctgaaaaaaaaaaaactaaaaaataagcttttggtgttctgagtcacactgagaaattatagtgaggaaatacctatttgttttttcaagtacatgttactctaaatcaagcttttccaacccgcgggccaaatgtggcccaggatggctttaaatgcggcccaacataaattggtaaattttcttaaaacattatgaaattttttttgcaattttttttttttaaagctcatcagctattgctagtgttagtgtattttatatatggcccaagacagttcttccagtgtggcccagggaagccaaaaggttggacacccttgctctaaatgtttaaggtgaagcatattaacatgctgtttttcggtgattgggtcttaagaagataatctaaataatttgttgaagtttaaccatactcacataatttaaacaatttaaagttatttggcgggtaattgaaaccatgtgttctgtttattttgcatcaagagtcactcattatactttgctagtcatggctaaggtccagatgcttgctagcttattgtgagcatttcttcctgatttcagcaaccacatggggaaattttttctctttttttttaggcaagtccagagagttgaggggtggggttgagactactgggattttgtattgctttaggttttggttttagggattagcctatatattttttcctttcatcacatctttaaaatttttttttttaagagatggaggtctcaagatgttgcccaggctgcactcaaactcctgggctcaagtgatccgccctgagtagctgggaatacaaggtgcatgccatcaagccaactcatcatgtctttacactctaataaccagccctgtcaacttatctgttggtatgtttttcccttgggaggctcgccaccatgtttttaacctatagtactctttttaggaggcaggaattgctgtcttaccctgagcccaggcgtttatgctaactcattgctttaactgatttttacttcagcatttatctttttaatgtctggattctcctaagaactttaaaagctaaactttacatttaagcaaatcattaatgttggaaatattttatatatgtgagctaataaccttatgtgaatatacttgttaaaccagtacctagagcaagaaacagaagccctagccctccacttgagtatctttccagtcactacccattcctcaggggtaaccactggcttaatattagaattcagcatagattaattttgcctagttttttgtactttgtgtctgctttttgttcaatgtgagattcatccatatcgtgtgagattgtcctttgttcttattgtcttaccaatttatttttaacatgtttataatctataatatttaaaaaattactttgacatattctgagtcaagtctccctctcttttttgctgaacagaaggttcagtttttgaataagcagatggtctggcttcagattacctgttaggagtgagtctaaagtcattgtgattgatttttttttttttctttacacatttcagattttttttttttaaccaatgatatttgttttttgcttttataaaacagggatggctagtcccctcagaagattttcatgctcacttgggcagagaatcagtgcataagtatttaagtaactctttaaagaccacagtaaggatggcagatagtttacacctaaattcaactgccaagtaattagcagtatttctttaattgacccagtgtttgagggggagggacagcaaaagtgccaggtattttcctttccctgtgtgtgtttattctatagatgctttccatagaatattttcaggatgctttattgagaattaccacaaataactggtgtcatatatgtttgaatgtcttcattggtggcaaatcttagtcttttaaggttagatttaattattttcagtggccaagtataatttggagtatgcctatggaacagcagaagcagagagaggctctatagtcctgtccaaagtgtattctttggcttttacatataatttaagccttctgagcttcagtgttttcatgtataatggaaaagtagtcattccatatgatggttctgattgtactgctgtggatgtttattaactcctccccaggtcttcgctttattttgtattactttagggtttccccatagtgtgttgcctgtttttgagacagggtctttctttgtcacccaggctggagtgcagtggtgcgatcttggctcactgcagcctcaacctcttgggctaaagtgatcctcctgcctcagcttcccgaggagctaggaccacaggcacacaccaccatgcccagctaattaaaaaaaaattttttttttataaagacagggatttcaccacatggctcaggctggtcttgaactcctgggatcaagtgatcctcccgcttcagtctcccaaagtgcaggtattagaggcatgagccaccgcacctgtttttttttttgttgttgtgttttttggtttttgttttaagacagattgtgctgtgtcgccaggctagagtacagtggcgagatcatagctcactgcagcctcgaactcctggcctcaagtgatcctcccgcctcagcctcccaaagtgttgggattactgcgaccggctctaggatgcactcttgaagcatattattcccctgctgttttgtcatgcagccagacttgtccaatcatatgttttctttcagggctttggatcttgagagaataacgagctgtagggttttttggagacctttccagagtcatgtcagcgtgtggatcagactgttctttggcatggttctttgagctgctttctctggtctgttggcactgtttttttccagtctgattttccagtcatctttcagtgttgtgagtttcaacagccttccagtaaagttgctttttaaagatagccagagtcagttactaatgtttctaatgcttgtagacaagaactgtaatacagtaacttaactctatgtcttgaaaaataagtaggtacttgaggtaaataatatgtaatggggtaaaatacttaagattaaccaaaatgatagaactgacttttgtgtggcttttacacaggctccaaagatgttttccatttttggaataaggttcccaaggtcactactttgaagtataatagtgatgaagatgtataacttaacaaaaattgttttcctttctatacgtgtggtgatgtccaccatctctacatatcaaatctgtaaatcagaaattcagtcaacaagtattcagaatttccagatgtgctgagttttagtaatttaaaatataataaaggcttctgagtttttaatgaattttcgttgtttctaagacaaatgatatttccttcatattttttgaagttttgaatttttatctatttttttcaggtgtttaaacacaggtatgagatatacaggatctcagaaattacttttgaagttcattaaactatttgattgtactttttttcttttgagacagggcctagctttgtcttccagactggagtgtggtggtgtgatcatggctcattgcaacctcgacctcctgaactcaagcaatcctccctcctcagtctcctgaatagctgggactataggcgcaccctatcatgcccagctaattaaaaaaaaaaatttttttttgtagagacgtggtctcactatgttgcctagtctcgaactcctggcctcaagcaatcttcccgccttggcctcccaaagttctgggattacaggtgtgagccaccacgcctggtctgcttattataccttttcaacaagattttatactgttgaaattactttttagtgctttgggattcttttacaatatggtcaaaatattcactaactcatctcataagttatactaatatttgatatttgttaattttggactacctgagagttcttgtatggagcatttgaattacgttttagaattgtattttgaaggctgggtgcggtggctcacacctgtaatcccagtactttgggaagccgaggtggatggatcacctgaggtcaggagttcaagacaagcctggccaacatggtgaacccctgtctctattaaaaatataaaaattagccagacatggtggcgagcacctgtaatcccagctactcgggaggctgaggcaggagaatcacttgaacctgagaggcggaggttgcagtgagccaagattgcgccactgcactccagcctgggcgacaagagtggaactccatctcaaaagacaaaacaaaacaaaagaattgtattttgaagttattttgatagattttgaaatatttgggggatttttttgatatttaaagaaatacacttttataatatcatcttacatgtaaatcttaaataccctggaggcatcaggcattatgcttgttctggtacataatgttaagcttttggctgtacacttttttatgtctttgcaaactcccccccccttctaacagcataacttttctactgccattaatcagattaaatagtataaaactatgctgtagtctttgtttagaggatttatcttcatgttgtgagtctccctttgaagcagcacaaaaagacagtgcttgtcctcctcctgctttttttttttttttaagatggagtcttgcttttatcactcgggctgaagtgcaatggcaccgtcttggcccactgcaactccgcctcctgggttcaagtgattctcctgcctcagcctcccaagtagctaggattacaggcgcctgccaccatgcccagctaatttttgtatttttagtagagatggggtttcaccatgttggccaggctggtctcgaactcttgacctcaagtgatccgcccacctcgccttcccaaaggtctgggcatgagccactgtgcccggccatgctgctgctttttagtaagtgtcctgacaagtgccaaaagtggaaacctggcttcattttgaaattgatgtttttggcttcaggtttctcttatcaaagctgggaagactgcaacctgttttaatagcattgtacagtattacaatgtaatctagtacattttgaggtttttgacttaggtattacaaatatatttagaacataggctatttctcttcccgtttggtaaacctctcatctgcaaaaacacaactaatattaaagtacagtgtattgccaacaaggatgtttctggtcacttttaagaataacattttaaacaacaacaaaaaaatttacttatttttaaacttaatgcattgtatttgatttacatattcctttaatggagaagttcttaaattggagtgaacagagctgagaaactttgtgaattctctgcagttgtgtgttttcttggggaaagaggacagaactttcattagatactcaaagcatttagtgaatcaggaaggttaaaaattaccaaacaggaactgtttgttttagcttaaggttttcgtcttttctttttccttcctgaaaattaactacagaaaattccaggtttccagggttgtagcgagttgaattttaagtgatttgagatacgaagtccacatttctgtggcctgtctagaggttctcatcttgctaaatgacatttagaagcagcataactgcttctaatctaggattaccacacatctaggattctaacagttttcatccattcatcaaatgtttactgagcacatgctctgtgagaggccctttactaagtacaaattcactgaagaacatgtctgtcttcaagttcattcattttagttctgtgtgtcaaagctcatatagtaaactacaaaactaaattatgttgctgttctagaattttttttttttctcttctgagacagagtcttgctctgttacccaggctggagtgcagtggtgcaatctatgctcacttcaacctctgcctcctgggttcaagcgattctcctgcctcaaccttctgagtagctgggattacaggcactcaccaccacacaggggtactttttgtatttttagtagagacaaggtttcgccatgttggccaggctggtctcaaactcatgacctcatgtgatccacccacgttggcctcccaaagtgctgggattacagacatgagccaccctgcctggcctgttctataattttttgatgtcatatatttcaggctggcatttggcagtcactcagtacaatgacattactcacattaagaatacataatttacctaaccctggcaggtgtggtggctcatgcctataatcccagcactttgggaggctgaggcaaggggattacctgaggcagggagttagcgaccagcctggccaacatggtgaaactccatctctactaaaaatacaaaaattagccaggcagggtggtatgcacctgaaatcccagctactcgggaggctgaggcaggagaatcacatgaacccaggaggtggaggttacagtgagctaagatcatgccactgcactccagcctgggcaacagagcaagactatctcaaaaaaaaaaaaaaaaaaagaatacataatttaccttattaagtaagctaatattatttattaaagtaaatttacttattaaataaatttacttaatacatttactgtattaattaagtagattactggctttattaagtaaattatgtattcccagtgtggtaatgtcattgccaagggagtgaaacttggttctgggcgtggtagtgaaagaatcgtactcttggccgggcgcggtagctcacccctgtaatcccaacactttgggagttgaggcgggtggatcacgaggtcaggagatggagaccatcctggctaacatggtgaaagcctgtctgtactaaaaaaatacaaagaaattagcttggcgtgctggcgggctcctgtagtcccagctactcgggaggctgaggcaggagaatggcgtgaacccgggaggcggagcttgcagtgagcccatatcgcgccactgcactccagcctgggcaacagagtgagactccgtctcaaaaaaaaaaaaagaatcttactcctcttatgtataaaaaggcacacttacagtgtacaaacaaatatgtatattccatcatattaaaatttcatgggggagaagataatgaggaaaaaatctggaagtacttcttaagggaacagtgatgaaataaagggtgagaaacattgaaataagtcactatggaaaattataagcttgtgcttagttgaggtttagaaatctttttctctgataggaatttttattgcaatagaatttggcttgtagttcagtaggaagaggaacaattttagcatactgaactgcgtgtaggaacttatgagttaaagttttaaggtaaaagttatttttattgataatatataggcaaactttgtattccaccactaccttctgggacagattagaaattaagaaactgtatgtaaaagttgctaatggttatttttactctggtttcattttctagttccagtttcttaaatggaaatgctaaacagtttataccgtattaacaaaataacctcagaaataacacttaagaacttaaatttcagttcagtcactgaatggagtataccatttaatttttgtctataccatgttgtgtagctaaagtgaaattagaggttatttagtatttatatgttccgtttaatccaagtattgaacagcttctctgtgccattcattccctttgccagatgctggggttacaaagaaaaaaaatatatatatatatgtatatatttttgagaccaagtcatgctctgtcgccagactggagtgcagtggcatgatcttggctcatgcaacctcctcctcctgggttcaagcaatccttgtgtctcagcctcccaagtagctgggattacaggcacatgccaccatgcccagctaatttttgtacttttagtaaagacggggtttcaccatgttggccaagctggtcttgaactcctggcctcccaaagtgctgggatcacagatgtgagccgctgtgcccccggccacaaagaaaaattttttgcttttaaggagcattcagtctgcatagaagacagatttgcgaatgatttcaataaagtgaattattaactttatcctgcctgcctcttctgagttactaacttttatgggagtatgtgttaggtgcagtaaggatgtacatagggaggatgctttggatcaggacctgcaagactgctgtgttcttgacacctagccttgcccttgagtagttgaaagaattagaataaatattttgaattttagaaccttagttttctcctgggcaaaatgggcctacttttttattttttatttttgagacggagtctcgctctgtcacccaggctggagtgcagtggtgcaatcttggctcactgcaagctctgcctcccgggttcacgccattctcctgcctcagcctcccgagtagctgggactacaggcgcctgccaccacacccggctaattttttgtatttttggtagagacggggtttcactgtgttagccagtataatcttgatctcctgacctcgtgatccgcccgcctctgcctcccaaagtgctgggattacaggcgtgagccaccgcgcccggccatgggcctacttttgtgttctgtccgaaagcctctaagttgtagggatccaatgtgttggcatatgtgagtgctttgaaaaccacatggtgctgaacaaatgcaaatgggtaattacctagcctagagaagtaagttaaagtttatagtggtcttgacaagtgacaagtatttaatatttccattatttttactatttcttgattctcttgcactttatatgctgggcttactgaacgttttactcaaattcagatgctcatctatgcgtgtatttttttaaaaattttaattttttttttttttgagacggagtcttgctctgttgcctaggctggagtgcagtggcccaatctctgctcaccgcaagctccgcctcccgggttcatgccattctcctgcctcagcctcctgagtagctgggactacaggcgcctgccaccacgcctggctaaatttttgtatttttagttgagacggggtttcatcgtgttagccaggatggtctctatctcctgacctcgtgatccgcccaccttggcctcccaaagtgctgggattacaggcgtgagccaccacgcctggccttaaaaattttaatttttatgggcacatagtaggtgtatttatctctacctttgttctgaacctctggtcagtttcctttttgtaattcctggcaaaactggtttgggaaatttggaaacttgaagtaccacttgacttctgatttttatttttttattttttatttatttatttttcttttttgagacggagtctcgctctgtcgcccaggctggagtgcagttgtgcgatctcggctcactgcaagctctgcctcccgggttcacgccattctcctgcctcagcctcccgagtagctaggactacaggcgcccgtcaccatgccctgctaattttttgtatttttagtagaggcggggtctcaccgtgttagccaggatggttttgatctcctgacctcgtggtccgcccgcctctgcctcccaaagtgctgggattacaggcgtgagccaccgtgcctggcccgacttctgatttttaggtcaagcccagagtcttccttaaagaatccttgggattggttccatgattcctcttttccagatactgcttagcctccagacgtatcagtagcctccaagcctccaaaatgactccagtcacaattaaataaaatagcacatgtaaagtgcctgatagttggtgcacaataaatattaagtttcattacgccttgatgctccaaatcagaaaactcaaaaggccttgacctcttccagcccttgtggtcagcagttctctccacctttccatattctcagctttggttttttttttttttttcctcagctttggttttttttttttgagacaaggtatgctctgtcacccagggtggagtccagtggtgtgatctctgctcactgcagcctcaaacttgctgggctcaggtgatcctcccacctcagccttccaagtagccgggactacaggcgtgcgccactatacctggctactttttgtattttttgtagagatggggttttgctgtgttgcccaagttggtctcaaattcctgggctcaagtgatcctccctcctcgtcctcccaaagtgctgggattacagatgtgaaccaccgggcccagcctcaccttatctttttgatgccacccaatttttttttttttttttttttttttttgagacggagtctcgctctgtcacccaggctggagtgcagtggcgcgatctcggctcactgcaggctccgcctcccaggttcacgccattctcctgcctcagcctcccgagtagctgggactacaggcacccgccaccacgcctggctaattttttgtatttttagtagcgacggggtttcactgtgttagccaggatggtctcgatctcctgacctcgtggtccgcccgccttggcctcccaaagtgctgggattacaggcgtgagccaccgcgcctggcccatgattacttttttaggtcttcatgtttgtgttagtggatccttatatgtaaggctctgcctttttctacctagcagccaattcttagttatttcttactgcctagtgagactcttcaccttaatctaacttcttagttgctctcacatcctttttgcctaccattgtatctctagcatctagcacaatgcctagtattgcacaagtgtttgtctttagaatgagtgaggggacaccattttatttatatcagtattatgataatcacattgaaattgtaattattatttcttccttttcattctatgcctttgtatattagtcatctttatcacctctgtttagtaatgtcttggcactcagtagagtttattgagttaaaattattcttgaaatatattacttccagctgggtatgatggctcatgcctgtaatcccagcactttgggagaccaagataggaggattgcctgagtccaggagttcgagaccagcctgggcaacacagcaataccctgtctctattttaataataaaaatgtatattaaacaaatagaaatttattacttccaataatttttttttccccagagtctcattctgtcacccaggctagagtgcagttgtataatcatagcttactgcagccttgaactcctgggctcaagtgatcctcccacctcagtctattttgagaatttaaataattacagtttttgctttatgcagcattatgcctcagcctcccaagtgggaatgattttctgcttttagaaaataatgcagaggccagtatctaataaatgttatagtgacttgatataaaacttacataggacttgtcaaaatgtcctcaacttaaaatacttacccacagtatgatgcagtagtaaaagtgctgtatctagagtcacagctctggggctcgaggtatcactgctctagagtgtgaatgtagtcatatttcttactttctctaaacctcagatttttcaaatgtaaaaaggtgatgatattttactaggtaattgtagaacctagatgataatttataaatggctttgcaaactgaaatgttattctcttgtattaaaaccttcgtgtttcttacagaagaataaagactgtagcttatatttaggtcttactaacaagatgctgttaaatatactttaaaaaaccactagtgaaaaacccttaaaaattcatttgcttgagagggagtgtctgctcacactttgttttgtgctctctgctgtgaagtgatcagtggcaggtgtggaaagaaaaaagtgataccagtcaagcaccccagtctgaaaatctgaaatttgaaatggttccaaaatttgaaaccttttcagtgctgacatgatatcacaagtggaagattccatacctggcacactttgtttcatgctcagaactatttaaaatattgtgtaaaattacatttggctatgtgtataaggtatatgtgaaacacaaatgaattttgtatttagacttaggtcccatccctaaggtatctcattatgtatttgcaaatattccaaatctagaatctgaaacacttcgggtcccaagtacagggatactcaacctgtaccctcttctgtttcagggggctgaaaggaagcacacctagatcatgcattaaataaacaggtcttggaaggcaagacagaaaaggagccagggctttggagccaggcagaccaatttcattccctgctttgccactcagtgcgtggcaggtcctctgagcctcagttccattatcttgtgaaattggaagaatagcacctactttacaaggtttcctaagaattagaaagaatgtacactgaatgcttaacacagttttaacagcatagatactcagtgtatggcagagtatgactgtgtgcactttaaaaaaggatttggaaggatacattccaaatgttaatggagagtatcttgaagagggaatgtgtgagggatggaagcggaagagaaagtagagacttttaattttctgtcatgtatttctatttgaattttttttgaaaataagtgagagtacctgagaagtctgtgtaagtggccaagagcactccgttggaggaataggcagcagaagagtaacctgacaaagagcccgagcaggagctgccagaagagggggattgtggagccagcaggaggaagagtgaggagtagtggagatggacttgctgatgataccttcgagtctgctgtgaatggaaaggagatagggcagggttggtccgggtctgtctcttgtatgatggtaactgtgagaatatttgaaggccaataggcaggtgctagtatacatgttagagatttaaggtattttaggagggcaggagttgtgaacaaagggaagtaggagagaatgggtaggattagctttaggcagactgcactgtaacgagacaaaagagtgggtatgtatgaaattgagtttattgagttggtttgtttttgtgaagtaatctgctgaaaatgagctgagctttagaggtttggggagaatggggttttgaaatatctgatatggagagtggtaagagctctgagtagggaaactgattttgccgtgtgtgtgtgtgtgtgtgtgtgtgtgtgtgtgtgtgtgtgtattttatttatttatttatttatttatttatttatttattttgagacagagtttaaagctgattttgcccagtgtgtgtgtgtgtgtgtgtgtgtgtgtgtgtgtgtgtattttatttatttatttatttatttatttatttatttatttattttgagacagagtttagctcttgttacccaggctggagtacaatggcgtgatctcggctcactgcaacctcctcctcctgggttcaagcgattcttctgccttagcctcccaagtagctgggattacaggcatgcaccaccatgcccggctaattttgtatttttagtagcgatggggtttcactatattggtcaggctggtctcaaatctgctgaccttaagtgatccacccgccttagcctcccaaagtgctgggattagaggcgtgagccactatgcccaaccccagtatcattaaaggtttagtttaagttggagacagtacatttatatactgagatttcaatatttttttacatcagcagttcagaaacacaggtacagatatggaaaaagtgacagttggattgatccggggctggagttttgctagttgaatgcagtgggaaacaatggatgtgtttaggaaactagtaagggtgtagttgaaggtagtgtactctggcgttgtttgcccatctttgaattgggattgataataatagcacttagttcagaaggttgttgcgaaggttgaaatgagctcccacagtacttagtactcagaacagtgctttgcacatggtatgtgcacagtaacttattgtgctgggtggggatgagggaaagaacggaggagactggtgggaaaaagggaggaaggctgaggattggaatccccataaggatgatgaaaagttacttgtggattgaatttccgagttggatttggttctcatcaaaaggttgtgggtttaaggatgctgatgtccaagttcccagggagtggcagataagatccctggttttgagtgaagaccatgagaatagaggccctgagggccctggctgttacttctgtgaaaaaatacattctgtgttacaaattgcttaaaagggaacttttaaaacgtaatcataacttgattactaccagtaacttacacatgtggatggcacccaaatccaatcattatttagttactttactggttttgttatctgtcttagtttatttgggctgctgtaaaataccatagaccaaggatctctaatctccgggctatggaccggtactggtctgtggcctgttaggaactaggttgcacagcaggaggtgaggggcgggcaagcgagcattactgcctgagctccgcctcctgtcagatcagcagcagccattagattctcataggagtatgaaccctgttatgagctgcgcatgtgatgagggatctaaggtaggcgatccttatgagaattttaactaatgcccgataggatctgaggtggaacaggctcatcccaaaaccatcccccccgccgctccagtccgtggaaaaaattgtctttcctgaaaccagtccctggcaccaaaaaggttgggactaccacaatagacagtgtgacttataaacaacagattttttttttttttgagacagaatctcgctctgtcacccaggctggagtgcagtggcgcagtctccattcactgcaaccgctgcctcccaggttcaagtgattctcttgcctcagcctcccaagtagctgggattacaggtgcacactaccatacctggctcattttctatttttactagagacagggttttatcatggctgagaccaccaggctagtctcaaactcctgacctcaggcgatccgcccacctcagcctcccaaagtgctgggattacaggcatgagctactgtgcccagctaacaacaggaatttatttctcacagttctggagtctgggaagttcaagaacaagaaattggtgagggcctgcttcctggttgtcttctcattgcatcctcacatggcagaagggcatagggactctctggggcctcttttataagggcactaattgcattcatgaggcttctgccttcatgacttaatgaccttccagagaccctgttgggggttagaatcttttttttttttttttttttttttttttttttttttttgagacagtgtttcactcttgttgcccggctggagtgcagtggctcaatgttggttcacggcaacctccgcctcctgggttcaagcagttctcctgcctcagcctcccaagtagctgggattacaggcatgcgccaccatgccccactaattttatatttttagtagagacagggtttctccatgttggtcaggctggtctcaaactcccgacctcaggtgatctgcctgcctcggcctcccaaagtgctgagattataggcatgagccaccgcttccggctagaatcttaacatgagagttttggggggacacaaacatgtagtctatagccttactcttttgctaattaaaaaaatcagaaagctgagggctttctttagtcatttgaaatgcttaaggggagtttttggcttagtttttttggtaacagctttattgagatttaattgacaattcacttatttaaacagtacaatccaggattacatgcctgtaatcctagcactttggaggagaccaaggcaggaggattgcttaaagccaggaatttgagactagcctggacaacgtagtgagatcccattgctaaaaaaataaaaataaaaagccgagtgtgctggtgcctgcttatagtctcagctactcaggaggctgaggtgggcagatcatttcagcccagcagttcaaggttgcagtgagctatgatcaagccactgcactctagcctgggtgacagaatgaaaccctgtctttaaaaaaacaaagtaaaaggtaacaatgcagtgacttttagtgtatttagagttgtgtatccatcaccataatacattttagaacgttaatttttttttttttttgagacagagtcttgctctgtcgcccaggcgggattgcagtggtgcgatcttgggtcactgtaacctctgtccactgcaacctttgtctcttgggttcaagtgattcttctgtcttggcctaccaagtagctgggattacaggcgcatgccaccacgcctggctaatttttgtatttttagtagtgacagggtttcaccctgttggccaggctggtctcgaactcctgacctcgtgatctgcccgccttggcctcccaaagtactgggattacaggtgtgagccactgcacccagccaagatgacttcttagataatcctatgtgttttcatgttcattgcatcaggagtcatccagtgtctggttttagaatttgaagaccagtgagttcatttggtgacagacctatctgcctgttggaaatttcccctacttttcatctaatttagggattcttagcttggggtcactgtagaattcaggaaacatttgagaggggaaaaattaatttatttttagtgacctatacctgaaagttaacatctacatcaactataattgtaggccacaagccaaagaagtattaatagtatctgtgagtttgtcaccactagagagaccagagatactttcatatcacatcacagttattgcagatatctcagaatactgtctttgctcactactacattggaattataatagttattagatctgccactagaacttgtttaatctgctaataaagcacatatatcacaaattcatttttaatattttgatgactgatttggtttcctttataatcctgtgcattttatgcacttaaaaggcaggataaacacttaatttcattttaattactaagttttgggttaggagtttgtgccttagctacttccagtggtatctagtgaggtatgggctcttttcttttttaaaattatgacttgcggttttatatatattcattgtgtttcattcacttatattaattactcttcttgatgtttaaattgtctcacttttagcctatgggagttattttctaagttggtttcagtgttctttgtgatacaggttattaacctttgataatttcttgctttttggcaaggccaacacaatgtcctggactcaactcgtacatttcctgtttcagacttataatcagtcattccttcaaggaatcctgttttccatctggtggggaatggaccacactctggtgtgagtacactgggtgtactcagtgttactgagttgttactgcttgtaggactctttcgtatacagagataggatatattttcctcaagggacagagctagcaaacattttagaggaaaaaaaatctgtttacgtggtttttggttcaagtttaacattatagatttttatttaacttactgggttttatatttatcttttttcttactgaaaattttggttcttcaaatatttgcattggcttaccgcttgtattaaaacagtttcaaaataaaaatgtcaacattactactaattgacttgagtttggcttacaatttctttgtagtatttttattaagaatgtgcagtcaaaatactgtattctaaagttaaaatagcttttctttgtggctctatcactaagtagtatacggttgttttcattcttcaggagttttttttttttttctgttttcagtgcatataattatattgcaagttatattcaaaagtctcatttccatctttcttctacctcattctttccttcccccattagtagttcttgaaaagttagagtttatctttctgatattttgttagcaaaactatacgtatattcatatcattgctcctctccttcatatacaaggtaatggactacatacactgtgtgcaccttgctttttacatgttatattctaaagattgttctctatcactattacttagaaatattttatggttctgtagtattccattatgtggtagatatatctttgtatattcatccagtcccttattgatggatttatgggttgtttccaaacttttgctcctacagataatatcacaataaccatatgcatatactgttgcatatttatggggctgtttcttcatagtggattccttagaagtagaattgtcaagttaaagggtaaatctatgtgtgatttttctagatccccaaatttccctcagtaaaagtggtgtcattttgacattcccatcatagttatgagaatgcctgtttccctcatttttgccaactatgctgtcaagcttttgggttttttttttgtttttgtttttgttttttttttgagactgagtctcactctcttgcccaggtgggagtgcagtggtgtgatcctggttcactgcaaccttggcttcctgagttcaagcgattctcctgcctcagcctccttaatagctgggattacaggcacatgcaaccacgcccagctaatttttgtatttttagtagagacagcattttgccacgttggccaggctggtctcgaactcctgacctcaagtgatccgcccgcctcgcctcccgaagtgctgggattacaggtgtgagccactgcacccggccaagcttttggatttttgccggtctgataggtaagcatgatttcatgtagtttaaaaaaaaaaaaaaaggctggggggggcaggcgcggtggctcatacctgtaatcccagcactttgggaggctgaggtgggcggatcacgcggtcaggagttcgagaccagcttggccaacgtagtgaaaccccatctgtactaaaaatagaataattagccgggcatggtggcgcacgcctgtagtcccagctacttgggaggctgaggcaggagaattacttgaacctgggaggtggaggttgcaatgagctgagattgtgccactgcactccagcctgggcaacagagtgagactctgtctcaaaaagaaaaaaaaaaaggtaaaatatgcataacatcaagtgtaccatttaaaacatttttaagtggtacagtttagtggcattaagtagattcacactgtgccgtcatcaccactatccctctccagaacttctccatcatttcataccgaaactctatccattaaacaatagctactatttccttctctccacagtccctgggaaccactgtctctatgaatttgactattctaggtaccccatatatgtggaaccatagagtattttgtcttttcatgactggctaatttcacttagcataatgtcttcagagttcatccatgttttgtagctatgtatcagaattttacatagatctgtgtatcagaattttaatttttaagactgaatactgttttcttgtatgcatatactatatttatccaaattcatggtttgtatatacatgttttgcctttttttgaattaggtgggtttctttttgctgttaaggtctcatgtattttaaatgtatatttttattatgaatgacaaagcatcttttggtatgttttagcagtttccatttcttctgtgaacttcatcatctgttaccttttaaaaaattgaatatttcaaaatatatatttttttgagacaggatcttgctttgtcacccggttagagtgcgtaagtgcaattatagctcattgcagcctcaacctcccaggctcaagtcctcccgagtagctaggtctacaggcatgtgctatcgcacccagctaattttaaaacattttttgtagagacagctctcgctgtgttaccaggctggtctgaaactcctggcctaggtgatccccctgcctttgcctcccaaagtgctgggattacgggtgtaagccactgtgcctggcctcaaaatattaaaaaaaaaaaaaaaagcaactttatttttaggaactaattgtatactagagatttatctgtgatataagtgactttgctatgatttttaccctgcaaactttaccaaaaaaatgggtagtctcttttattgctcctagattttgagaatagctgggaagttttttctttcactcccagattataaaggttttcactcttattttgtcttctagtacttacgttatttcactttacatttcagcctctgatccatctggaatttatattgatgtataataaggaattgatccaattatgtttttcctaatgactatctggttgtcccaacacgtttgtttaaaatgttcatctttccatgttacattgatttgtgatgacatttttatcgtgtacagattgagaatcccaatttcgaaaatctgaaattgtaaatgctctagtatctaaaactttttcagcaccagcgtgagaatcaaagaaaatgctcattggagcattttggatttcagattttcggatttgggtataatgcaaatattccaaaatgtgaaaaaaaatcttaactccataacatttccagtcacaagcattttggataagggatactcaatctgtatttgatttcagtatgttcttgggtttgtttctggaatttattctgttggtctgtctattcatgtgccagtgtgacatcattttaattttagagacttttaaatctattttagtatctagtaggacagctttcatttctgttccctacatatgttgctatctccccaagttttcctggctattttttttttttttctttaggaacttttatttgtaacttgtatagctccagggaaaatctgttgctatttttattgggatattacatttattaacttaggaagaactaataataatgctgagactttgtatataagaatgaaatatctttctattattcaagtctatttttaagtctttcaagagactttaaacttttcatataggttttgccatggtattttttgttctttttgttgctgttgtaaaggtcttttcaattatattttaactttttagtattttaacatgtgtattttgtttgtatatgacaactggtgtttaattttatataatctggctactttactaaactcctatctatagtaatttttccatttactcttatgagtttttctaaatatccaacaatatcaccagcaaatgcagttttactactttttttttttttcttgagacagtttcactcttttgcccaggctgaagtgcagtggctcactgcagcctctgcctcccaggatctagcgattctcctgcctcagcctcccgagtagctgctattacaggcatgagccaccacacctggctaatttttgtatttttagtagagatggggttttgccgccttggccaggctggtcttgaactcgtgacctcaggtgatctgcccgcctcggcctcttaaagtgctgagattacaggcgtgagccacagtgcccagccttactacttctttaacagttcttatatctgtagataccttttcttgtctagtctttttaatctgcttttacctgaagtcaccttcattctcttgattagttatttttgtcaagaactttttgattcttaatttttgacataatcaaaatttcatgtaagatttcagaagtgactttatagaatgtttttttgtaacagctctgagatatgattcatatgccatataattgtcatttgaagtgtacaattcaaggttttcagatttgtacaaccaccaccataatcaattttagaatatttttatcacttccaaaagaaagctcatcccctttagccattacctctcccttttcccattttgccagccctgggcacccactgtattaattatcttactgcataacaaaacatagcaggttaaaacaacaaacatgctattccgtgtatgtgcctgtctgcctctctgtctctgtatgtcttggtttgcctcacattgcatcctctctcatttctactctgcatttgtcttctgttttcctttctgttaccttcattctctgcatttgtacccaatggccagtagcttctgaatccacacagccagtacagctccagtgccatgcccatataactgattcagtatggcaagttcagatactcaggagggagacttaatttgttcatcctggtccatttagatttggcaagtacaatcacctttctttttttctttttttttgagatggagtttcgctcttgttgcccaggctggggtgcagtggtgcgatctcagcttactgcaacctctgcctcccaggttcaagcagttctcctgcctcaacctcctgagtagctgggattacaggcatgcgccaccacgcctgggtaattttgtattttgtattttttattttttttgagacagagtcttgctctcttgcccaggctggagtgcattggcgcgatctcgcctcactgcaagctccgcctcctggggtcacgttattctcctgcctcagcctcccgagtagctgggactacaggtgcccaccaccacgcccagctaattttttatatttttagtagagatggggtttcaccgtgttagccaggatggtctcgatctcctgacatcgtgatctgcccaccttggcctcccaaagtgctgggattacaggcgtgagccaccatgtggacctggcctatatttctattagaaagccatttccaaaacattggtcacaccagaattcaaccttatatagaaaatatagtgtttttagtgatttcattttgaaatattttgtacataaaaacaaaatgaaactattttgagtactttatgcctatacagactactagtaactgaacattcatataacgtagtatgttttgtaaaatgtttagcggttgcaaactggtttgccagatatgttttgtttagtaaaacttgagttgtaatcctttcaaagatggaagtaatatatagaaacggacgtttctgccctcttgaaaaagatgtggcaagagcaggcccacattttacatggcaacagttgataagggctaagctgtcttccccagatagatggaagaggacattgtccagcttgctgcaatccacacctgggtctctttattcagtcatgttctttgtactttctaagtaactgagtttgcagtcctccatccccattccattctaattgtacataattaagtaattactaattgccaggggttgtgctttatatatattatttaatcttcacaacttgttttatatgaagaaaactagtctcagaaatttaactatatagtatgtggtagagctggagttgatttgaatcgccaggtgtttgtgcggtctgggctcttgagcacagttctttactacttcacaaatatgttttactttgtggttcatagttattttcatggagagtttttagttcttctagtgttttgcctctgtcaaattactgccactatcataactattgccttttaagcttgaacaactataactatagttgatcagtaaggaaaaccttacttatctccttgccacgagttttcctttactatatacagaaaagcctaaagaaaataaagatcaccataatcaccagacattactgctgctaaaacttttcttctaatctccctaaaaaatgggactattttctgtctctctacacacacacacacgatttcataataatttttcatgttttgtaataacctctgcaccaggatttcttttctttttttttttgtttgagatgaagtcttgctctgtcaccaggctagagtgcagtggtgcaatctcggctcactgcagcctccgcctcctgcaccaggatttttaaaactgattttcatagaattgtaatattctgtaggctgttaaaagtatactgtaaattaaaatgcttcaaggtcaggaaagtttgggaagtgctgagtttattcccttttttttgcttttagattgtttttgtgttttactatgataatgatgtgatcaatatatttgtacatatatttttgtgcacagtattttctaactaaaggcccataagaattgtgtcaaaggatgtgaacatttataagtttttttgtaaatacaaacctatgatatacatacgtattaatatttatgtaacttcaaaataagattacactttagatcaagcttgtccaacccgtggcctgtgggccgcaggtggcctacggctttgaatctggtccagcacaaatttgtaaactttgttaaaacatgaggtttttttttttgttttctttagctcatcagctgtcattagtgttagtatattttatgtgtgggccaagataataattcttccagtatggcccagggaagccaaaagattggacactctgctttagataatataattttttatctgtttctcatgtagaatatatattatgagcattttcccatgttgtaaatgtttttaataacatataaggaaaatcttatacttccggttatatccctgttatgatctttatacaaaatatttttattacatttcattttgggttaccaaccttttgagttccttcttaacaaaaagcttctgggtaagtaggcagttgagagcagaacagtagctcttaactggaatggtgagaactcttctcagtgttggcagttttaggggacttaataaacaatacccttttctaccattcaaattgagccacttgaaagaataaagggaatcaggcagatggaggtctggtagtgtatggcccagcctacttggggtgtctctgtcctctcccatccttatattttagaacataggaactaattatgactacagtcataagctgcttgatgctgccagttactaaccttccccacatattttatcttttttttttttttgagatagggtcttactcctgtcatccaggctggagtgcagtggcatgatcatggctcactgcagcctcaagttcctgagctcaggtgattctcccacctcagccttccaagtagctgggaccacagacgggtgccaccatgcccggctaatttttgtattttttgtagagatggggtttcaccatgttgcccaggggtctggaattcctgggctcaagcaatctgcttgcctctgcctcccgaagtgctgggattacaggtgtatgtcactgcgcctggccaccctatggttaatttttgatcctgcttttatgacatggattttagcaggagggtatcaacatactgtacttttctgttgtttggtgtgtctttgttggcttcatttatctttggaatattgctgacgagtcccagaagctgtggtacagaactgtccgttcccattcatctactttcccatgtgaatccaattctgtttaagcatgtgtctttcagcgatgatgcctaaagccattcactaaatttagatctctgaagtctgttactaaagaccccattttgctaatatctctgggtatgccattactctaggagcaattgagattgagacatattttagttctctgctgtcaaatgtaagcctccaggtactgttcagctggagtttgcaggctgtagggctgttcacgtccattattgctttatgaggtgttctctgttgtttacagtttgtagaggctcatttaggaactctgtctatatgtccaggccagtcaaagccagatatctgtaactttaatttcatgtggaattcattctcaggcttcctagggctttaatttcatggacacagaagccacgcattttacctaacctctataaagtactggtattattagccactttgctaaatctctggtaatcttcatttgatcaggccccgaccctaagtttaaagtgactccctaaaatccagtcagtgtctgctacttacacctcacatttaaattgatctcttaacactgatgtttttgtttatccgcttgtgcctcctttaaattgttattttcccaaaggtcacattctcagaagtggtagcttggtgaggcgaatttaactccttgtatcaaaaatgaagtttgatggacctcaatggtcagtcatcttctgaaacacaagctcactactctggcctgacaaagtgccaggattgaccttggaaaagtgccagaggtgagggccaggccttcctaatcctgggccctccattctttagagattcagttggcctgttctcctaccaaaattgtgttaccctgttctgagccttaatgagagttatttatagcttctgctgtctcatgagaactgggtatcttaaattgatagctggcaatcctgctggcaagatttgtggctttataatttgaacaaccccagttgtttgctgttaaagtgtcctgacctcatctggtgatgcctgcttgaccagtatcccagatctctagatgtctatcaacctccttatgtctggccgttcttccactgtggatgctgcccttacattctctcttggggccaatctgattgttatactgtttattattgagaattttaggcctatagccatccatttgtttgtgggcgcatgtgtgtttttctaatatcttcttacaaaattaacagtgtgtgtatttaagagacaatgtcgcactgttttgcccaggctgcagtgtgttggtgtaattattgctcactgtagccttgaactcttggacacagtggtcctcctgccttagcttcctgggtagctgcgactacaggtgtgcagcaccacacctagctaattaattttttttggtagaaacaggatctcactatgttgtccagtctggtctcaaactcctgggctcaagccatcgtcttggctcagcctcccaaagtgctcggattaaccttgtggttttatcctaaacagcaataaatgaatggtattctaattctctgtgaagctaacttggctaggttgtctttgcctgagcttcttaacttgtccacataaataaatcactataatctggggttaactgagtattccttggagtttgcagggttctgaaagaacctaataaacacacagcttggtgaaatgtgagttatgtttctaaacttatgacctctaaagttatttgttgtttgtatgtaagaataagtggtggaaagataagcccccgaaaattctcgattagtaatttatgttaattgtattttttcagtatattattatagaaagacaggaaaggtaaaaggcaccaaatatgactttggctgataatatttctgttttttactctgaattcaaggtaaattagctattttgttttatttcttcttctttttttaatagggttacacatcattttggaatgactgtatatcatctggattacgtggctgtatgttaattgaattagcattgagaggaaggttacaactagaggcttgtggaatgagacgtaaaagtctattaacaagaaaggtaagaggagtgctgagtaacattctttttaaagaggttgtactgcttaaaatgtatgtttttactagtagccttcaaaaattaaagtggaagttgatattaaagttgtctttcttcaattgtatttccatatcttttttgcattcttggtttcctggttctttcacctacaatgagtaatgtaattgattgttaaggtaaccggccactggatcttacaaattcagaaagattctagacttcatttgcagcttttatttatttatttatttttaattttattttattattattattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggtttaaggtcaccgatcaacaggatcccaaggcagaagaatttttcttagtgtagaacaaaatgaaaagtctcccatgtctacctctttctacacagacacggcaaccatccgatttctcaatcttttccccacctttccccactttctattccacaaaaccgcccttgtcatcatggcccgttctcagtgagctgttgggtacacctcccagacggggtggtggccgggcagaggggctcctcacttcccagtaggcgcggccgggcagaggcgcccctcacctcccggacggggcggctggccgggcggggggctgaccccccccacctccctcctggacggggcagctggccggacagaggggctcctcacttcccagtaggggcggccgggcagaggcgcccctcacctcccggacggggcggctggccaggcggggggctgatccccccacctccctcccggacggggcggctggccgggcttgggggctgacccccccacctccctcccggacggggcggctggccgggcagggggctgacccccccacctccctcccggacagggcggctggccgggcagagtggctcctcacttcccagtaggggcggccgggcagaggcgcccctcacctcccggacggggcggctggctgggtggggggctgacccccccacctccctcccggacgaggtggctgccgggcggagacgctcctcacttcccggacggggtggctgctgggcggaggggctcctcacttctcagacggggcggctgccgggcggaggggctcctcacttctcagacggggcggttgccaggcagagggtctcctcatttctcagacggggcgtccgggcagagatgctcctcacatcccggacggggcggcagggcagaggtgctccccgcatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcagccaggcggagacgctcctcacttcccagacggggtggcggccgggcagaggctgcagtctcggcactttgggaggccaaggcaggctgctgggaggtggaggttgtagcgagccgagatcacgccactgcgctccagcctgggcaccattttgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcgcgcctgcaatcgcaggcactcggctagctgaggcaggagaatcaggcagggaggttgcagtgagccgagatggcagcagtaccgtccagctttggctcggcatcagagggagaccgtggaaagagagggagaggagggagaccgtggggagagggagagggagagggagagtcatttgcagcttttaaaagccataattttgaaagacttgacattaaaaactcagaagtgttattgtgcaatttacgcataggctattgatcttttcatcagattatgaatacttttcagatacctgtctgttgaaggtctgtgtaggtgcttctcttaatagaggtaatattggctagtttttagaaatttaacttcaacctcaatctcaaatatttaatactgtttttcttccagtttgttgttgtgtttcttgagcatggtgtttcaaaactagtttttttcctaaatcagtgtcctaatgaatctaaaagttttagatcagagcggaatgcatcttgattaataagctatagagaataatagttctgtaggaaagaacaccattcatgtatcttttttttttttttttttgagactgagtcttgctctgtcacccaggctggagtgcagtggcgtgatctcggctcactgcaacctctgcttccctggttcaagtgatttacgtgcctcagcctcccaagtagctggtactacaggcgtgtgctgccacacccagctaatttttgtatgttttgtagagatggggttttgctatgttgcctgggctgctctcgaactcctgggctcaagtgatccgctcgccttgggcctcccaaagtgcaaggattacaggcgtgagctatcatgcccagcccactgttttctagtatacagagttgcggtaaagtctggtgcccttctgattttcttttcctttttttttttttttttggagacagagtctcactccattgcctgggcaggagggtggttggtatgatcttggttcactgcaacctctgctttccaagtagctgggactacataggtatatgccaccatgtctggctaattttttttttttttttctgagactgagtgtcactctatcacccaggctggagtgcagttggtgccatctcagctcactgtaacctccgcctccctatcagcctcaagcgattctcctgcctcagcctccctagtagctgggactacaggcatgcaccaccacacccggctaattttttttttttttatatgtttagtagagatggggtttcaccatattggtcaggctggtattgaactcctgaccccaaatgatccacctgcctcccaaagtgctgggattataggcgtaagccactgtgcccagcctcctggctaattttttttgttgttttatttttgttagagataaggtcttactttattgcccaggctggtcttgaacgcttgggttcaagtgatcctcgtgccttgtcctcccaaagagctgggattacagacgtgagccactgtgccgggcctccttctgttttttcaatcttattttttttttttcctctagaagcatttgggatcttctgttatccttgttggttttctgaaattgtacgatatgccttaatgtgggtcattttaaattcattatgcattaattttttcagtctagaaatgtgtatattttggttttgaaaacttgtatttctgatatcttttgccctctttttctagaactctgtaaattggatacggacttcttggctactcttaaagagttgtcttctaacctttctgttgagattttattgtgactctcctgtttttgatttccatgagcttcctttttaaaaatcgtagtttgttttatggatgtaataccttcttttagatttctgagggtatcacacctcttttgaaaatttcctttatctgtattatatctgtttcttcagagttcttattttctctttttgatctcttctgtgttggaagctttctttcacgttatccgtgattgtctgtttatatttaggaatggttcccgtccccccaaaaaaagaagctaaataaaaatgatatgtttggatagaacatatttatttgtgaaccacacttactactgaatttttgaaaggaatttagaactaactcgagtcattgaaaagttgtaagcagaagcagtggaatgccatggtaagatttgtctgttagaaagatcagtgaggagaatggattgaaaaggctaaaacttgtttagggaaattagttaagaggcttaaattaatccaagtgaaaaacagccagattaggcagactagaatatagttgttcctcagtatctgtgggcgattggttctaggactcccctcaaatatcaaaatctggatgctcaagtttcttatataaaatgttgtagtgtttgcatataacctatgcacatcctcttctatactttatgtcacccccagattacttacaatacctaatacaatgtaaatgctgtataaacaattgttatactgcattttaaaatttgtattatttttcctggatatttttgatcctcaattggttgaatctatagatatggaaggccgactatattggcaagatgatggagaaaagtgaaacatttcagaaagatttagaggacagaacttcataagaaaaagtgattcactatacccaggctctggtgtccctgacataagatccgttgcaaacggatgtgcgtgggcgagctttgaggccaaattgcaataaatataaagaatgagtgggacgtaagaagtggtggcaatggccaccatatttagatgtaactttttctcctgaggctctgctttctttattttcttgtgctctctcacccttcactgaaagcatggtctagaatagcactgtttgatggaactttgatgatgaaaatgatctgtatgttcaatatggtagctactagctacatacatctatgagccagacacttaagcacttgaagtttggctactgcacattgacacatggtgttagtaaaaacatacactggatacactggatttttggtcttagtatggaaaaatatattaagtacctcaatttaaaaatacttattacatgttaatattttggttgtatttggttaaatcaaaatattaaaattaattttgcctttttttcttttaaaatataactactagaaaatttaagagcggggagggatagcattaggagatatacctaatgctaaatgacgagttaatgggtgcagcacaccaacatggctcatgtatatatacgtaacaaacctgcacgttgtacacatgtaccctaaaacttaaagtataataataataaaataaaataaaattgaagaatagatttgtgacttgtactgtggtttttatatttctgctggtcatgatgtcacagagatagatactgtatgtatatatttttaattttttataagattgacaaagtaaaggacactttgaggacaagtttaagagaggactctcagcattttaaaagtgatgttaaattggtggggcacgatggctcatgcttgcaatcccagcactttgggaggccgaggtggacagatcacaaggtcaggagttcaagaccagcctgcccaacttgatgaaaccctgtctctactaaaaatacaaaaattacccggatgcggtggtgtgcacctgtaatcccagctatttgggagtctgaggcaggagaattgcttgaaccctggaggcggaggttgcagtgagctgagatcacgccattgcactctaggctgggcaacagagtgagactccatctcaaaaaaaaaaaacaaaaaaaaccgtaatgttaaattttatgacatttaaatagctaacattataaaataatacaatacaatggatttaattttgatattatggaattttaactagaaacttatagcttagccaacaacgtgaatgaaggctatagggttctaatacttgtctacagcggtgtaacattttccctcccatctctccctctggatttttccacttttaaaatggattctatatctcaatgtagctttctgtttggaaacagatttttgctcttgtcgcccaggctggagtgcaaaggtgcgatctcagctcactgcagcctccacctcctgggttcaagcaattctcctgcctcagcctcccaagtagctgggtttacaggcatgcgccaccacacctggctaatttttgtattattagtagagaccgggtttcaccatgttggccaggctggtctcaaactcttgacctcaggtgatccacccgccttggcctcccaaagtgctgggattataggagtgagccactgcatccagcctcagtgtagctttttttaaaaaaaagttgcagtatttaaaaaatttatgtaatcaacgctattgataatttctttaagctttctgctagtcgggacaattttaaaagaaacctttcagggccaggtgcagtggatcattcctgtcatcccagcactttgggaggccgaggtgggtggattacctgaggtcgggagtttgagaccagcctgaccaacatggagaaaccccatctttactaaaaatacaaaattagccaggcgtggtggcacacacctgttattccagctacttggaaggctgaggcaggagaattgcttgtaccggggagggcagaggtttgcagtgagccgagattgcgccactgcactccagcctgggtgatgagcaaaactccatttccaaaaaagaaaaaaaagaaaccaagaaacctttcttacctctataatttgttagcaagttttaatgacatttgtttaaaaatttgtttcttcactgatgtgaaataccacctttataatataagattgagtatcctatatctgaaatgcttggtaacagaaatgtttaagattttggaattttctggattttggaatatttgtattatacttaagcattcctgacttcaaaatttaaaatccagaatgttccaatggatgcatgttggtgctcaaaaagtttcagattttgaaggagttcggattttcggattagggacgttcagcctgtactgaattcttaaatataatttagtcttatttctgggactaataataatgcttaaatgaatttctggatcacatagtccaaggttcggtgatgagtcagtgagtataaactgtcctagtatgttgctttactaattattgcacagtagcttttttttttttttttaagtcggagttttgctcttgttgcccagtctggaatgcagtggcacaatctcggcccgctgcaacctctgcctcctgggttcaagcaattctcctgcctcagcctccagagtagctgggattacaggcacctgccaccacgcccagctaattgtttgtatttttagtagagatggggtttcatcattttggccaggctggtcttgaactcctgacctcaggtgatccacccgcctcggcctcccaaggtgctgggattacaggagtgagccaccatgcccggccagtagcttgcttttcttttctctttgagatagtctcactctttcgtccagggtggagtgcagcggcgtgatcttggcttcctgcagcctctgcctcctgggttcaaatgattctcccacctcagctacccgagtagctgggattacaggcgtgcaccaccacacctggctaatttttgtatttttagtagagacagggttttgccatgtgggccgggctggtatcgaattcctggcttcaagtgatctgcttgcctcagcctccccctgggattcaggcatgagctactgagtctagccaattttcattcattattatatctaatctggttaggttaaatattggatttccttaacataaaagtaatttaaaatctgaactttgatactacatgaaagcttgaggctttaagcataatgaattatttatataattgtttgtttttcatttaatgagatcaactcagaaaaggcattcgtggatcctttcattctttttgctttctttttaggtaatctgtaagtcagatgctccaacaggggatgttcttcttgatgaagctctgaagcatgttaaggaaactcagcctccagaaacggtccagaactggattgaattacttagtggtaagctgctgtgaataaaccaaaaaccaacttctgtttaaaagattgcgaagtttaaatccttttgaaaggaacctacacaaaatagccagaagcttgtttagttatttaggcaaacttgaaagttatcagtcatagagtggggaagtaatggtttttataaaatttcattctctttaacaatactgaacagatatagaatgcgaagataatactcttagagctcccatgttctttatcaaaattaccacatgctaccttaatctggataggctaggttaagctgtggtggtaacaaaccccaaaacctcagttgcttaaaacaaccatttatttctcattcaggctgtaagtcagtcacaggctacctcatcctcactctggcagccaggcagatggagccactgccacctggagcagtatcagtcactataataaaaggaggaataccatagcacatcactctggctcttaagtttctgcttagaaatgacatgtggttcatgtttcattgatcagagcaaatcacacaatctcccctaacttcaaggagacagggaagtgcaaccttagggaggagaacgtgaaaagtttggctgatagcatggaggactgtgacgtttatattaaagttatttgtgtattaacatgatgtgagttttcttacagataagcagaatttataaaagtcctattggattattcttctgtcagtaaaagaggtttttttaggggttgggggactagtcaagtgaaacagtgggagtgggagggaacaaaaaaatctaacttgtgatcagttagctgtaaataactgctgtacttggaccagctgattttatttatatgtatacataaatatttttctttttaagagacagggtctcactctgttgcccaggctggagtgcagtggcatgatcctaactcactataaccttgaactaagtcctggactcaagtgatccacagcctctgcctcagcctctggagtagctaagactacaggtgtgtgccaccatgcctcgctgagttttttttttttttttttattttattttttggccaggcatggtggctcattactgtaatcccagtactttgggaggctgaggcgggtgaatctcctgagctcaggagttcaagaccagcctgggcaacctggtgaaaccctgtttctaccaaaaaacacaaaagaattagccagacatagtggcacatgcctgtggtcccagctacttggaaagctgaggtgggaggatcgcttgagcctaggagacggaggttgcagtgagccaagatcatgccactgcactccaacctgggtgacagagtgagaccccgtctcaagaaaaaaaattttttgtagagataggaccttgctgtgttgctcaggctggtcttgagctcctggcctccagtggtgcttcatcaaggcttcctaaagccctgggactataagcatgaatcaccatgctcagtctatatttatttgtttatttaaaaattaagtacatacactccatttttagctaacggcaataatgggcactttacacttaaggcaaggttcattattttttcttattggtaagaacgtaaacgtattcttgataaatttgcatttttgttggataaccctcttctacctctgataattttcctttttatctcattgagagtaactctgacttatactttcccccctttatgcttattagagttgtcttcagttgtaatttcttttgcaagaatcttttaaaattgctttgcccatttgatgagggcttgtttggttaaaactagattatattatcagcaaattcacttaatcatcacaaatacccatcacattgtcaatgctgtctgagttagcctcccatgtatgcctgtcagtgacatgcagccatctaacagagactcagggcattaatgtcaactctatatgttaaatattagtaaacataatgttttaaaatagaaatagaactgctaataacgtttatactgtgatggatcattttgtacattgttttcagagcactggcttaaccagtctttggatctttctcatgttgtgctgccagtgttggcccatgactgcttctggtgttgcaaattagaatttgtaatttggttcccagctgaccaaaagaagggtttctcaaagttgtggtgactttttttgttagatgtgttacagtgttaaagattctttttatggaatgtagagtgggctttgccttcactttcctgttactgaaatgcatcttacacttaacctgttaagtaacattttgtaaatgaagcttatcaatataaatgctaactgaacttggttctcacctatggctgctgttgcactgtccccacttgattaagcagtgaaaagatgagaagtctaaaagcttttctcacaagtatgtaaacacagttaggattttgtaaagcactgtctgtttggattagaaatttgggtaaaatgtgaaactaatacttagcaaggttttttaaaaaacaatgtcctgtgagttttagattggctgttgatgccagaacattgcctgtagcacttgagttgcttgctcttgacatacattgggaatgctgctgcttcagaataaaggaagggaatccagagtgggagaaggaggaaaaaggactttttttaaagttaaaaaaattaaaaaaaatctcctggcaaataacatgtaaaaagaagaaaataaaaaatatctatttcccacctaattgaaagtatcaagataccagcttgctgattttttaattgtagtaaaatatatataatgtaacttttaccatttttaccatttttaagcatacagttctttggctagcttgctgatttttagatttttaaaaattttctgttgcttcaatataatatgtggtatcaaacaccagttattgcaccaataatgacatatgtgctatgaaatttaaaatgtgctctcagactgaaagaatcttaaaatccatttggggaacagttttatacatctaataatttgatagaacagatgagagtttgacagtatggttctctgaaagttcagtagttcagagaaaagaaaaatccttgggaactttagtagttacaagaggaagtggagcttagattaggcctttgaagggtaagaatgagatgcaaagaaagaaatatacttgttcagagggattccttgccgtgaagccaaggaatgttttaataaagaacagtttctttacctggggtggaggatacccaggggctcattttattattatttatactgtacatgtatacatgttaaaactcttgataaattttaaacattttctaataatttaaaattagtatacataagtttgaggcaagtcgagagactacgtattttgtttgttttgttttgtctttgggacaaagtctcgccatcacccaggctgtagtgcagtggtgcagtcacagctcactgcagtcttgacctcccaggctcagttgatcctcctgccttagcctcccaagtagctgggactacaggcatgtgccaccacgcccagctaatttttgtatttttttgtagagatggggtttcatcatgttgcccaggctaagactactgtttaagaatagtttttagcttctgaaatcttaaggcatggttgatcagtttggtcacaaggaatcactacactgccaaatttatggccaaagctgcttttagttttgtaagatgatgtcaaggaagataagtgttctttgcagtgaaatgatttaggtacctgtcagcatgtcattctccaccaaagtgattgttgggcagtggacatgaataatctttgaagaacttttcctctccgtatttacttctcacaatttcctttaccaaaaaaagtaaactatgaatagattcattacattttaaatttgcttgtataacttgtaaagtcttttcacatatatggtgaataatttagggactgaggactaacagcatggatcgcagtaacgtcttttaatctagaattcaagaactattcatttatcaagcatttatttcaaagtatttaaaaagtattcacttttaaaaattgaagtagctaaatctttagaagctaaacttttattgcatcttctcctcagaaatccatctattgtcttcctatcccacttatactgatgtcttacttacgctaaactcaggtgtgactttattcttttgatttagcttagttcttcgaaaataaaaggcagaaattccagaataccaagatactttgaccacttggttattactttgtgccttttttctataccacaaatactattaaacaacatttgggatatttcctcacagttttagccttctgctcgtgagatttctttatttttctctaatacttgaggagatctgaataaccgtctatttgttggagtgagcacacggggtttaccctcttcccagggaattgctacaagagaagatgatagctgggtccctttttattgcttcctttgagtcagaaatgattgccagtaggaagggccagtcataagtggaatactttatttgaaggtggtctgtgtttaggctcttctaatttttagtagaaacattaaactgtaagttagtatactttggaattgggaaatttccacaggaacttctgtaaaatttactaagcatgtatttccactggttgcaatatgtaagttttaactaaggataaggtgaggataaaccttagcataagttcagtataagagacagtagtcataaactattaatcccacttaattcccatgagaaaaaaaaatattgtagaacagcattagagggatgtgtgtataggggagggggtgttttttttgggtggggagtggaaagctgcaaagagaagtttaactgtagatctctcagaataattcgtttcttgacttttttttcccctctgttgtttggcagtagatgttgtttggctaagatgtctctggagtatagaattccttcctatttgacttgggaaggtaaaataaaaatggatagcttgggagtcatttattctgctatacttaggttttgtgacaacataaacatattaagtcagtgataccaaattagagttgataggggataatacttctttgataacaacaaattattctttacataattaattaatcttaggattgaactgtagttttttaaataggcttttatgtaagtttggctgtttattattttatgttgcattagtttaaatttccctaagtcgtttaacacaatagttacccaattccagcctagtgtcttaggctgcctaacacctgccattgacattagaaaaagcaaaactcatactagtgaaagatgcagcagttatttattggtgggacattgggtttacacaattataaaaaaatggaagtggctgggtgcggtggctcatgcctgtaatcccagcattttgggaggcccaggtgggtggatcacgatgtcaggagatcgagaccatcctggctaacacggtgaaaccccatctctactaaaaatacaaaaaattagctgggcatggtggcaggtgcctgtagtcccagctacttgggagggtgaggcaggagaatgacgtgaacccaggaggcggagcttgcagtgagccctgatcacaccaccgcactccagcctgggcgacagagtgagactccgtctcaaaaaaaaaaaagggtggaagttacacacttttgaaagatgtgtgcctctactccagggcttattctattctgctgcctatgtactttgttgtttcttttgcctggaattcaggcttctctccctttcgtaggatgtggtgaatcctgctggatttcgagatttagcttgaagattctttttttctataactttcctatgaaataccccataacattaaaccagagtcatttcttactcctctaggcactttgttcattttgttcttatggccctattcccattttcttctggccagtatagttagttctaatatgtaatatattatgaatgttattttcacttgattttaaattcctacagggttagaagtatatcctaatgtttgtattctcagtacctaacaggattcttagaacattataaatactataaattctgccagaatgtttattctgcacatgggcaaataatagctaacatttactgagagcttaccatgtgttaggcttcgttctaagaacttgatatttaatcctcgtaatagccctatgagcttgataaatttgttactttcactttatagatgagtaaatggagaaatagattaagatgacttgcactaggacactagggtttttttggttttgttttttgggggtttttttgtttttgtttttgagacagtcttgtgcttgtcacccaggctagagtgcagtggtgcaatctcggctcactgcaacctccgcctcccgggttcaagcgattctcctgcctcagcctcccgagtagctgggattacagccacctgctaccatgcctggctaatttttgtatttttagtagagacagggtttcaccatcttggcttcccaaagtgctgggattacaagcgtaacccgccatgcctggccccggctaacttttgtattttttgtagagacgggatttcaccatgttgcccaggctgggactgtttctgttgactccccccttacccctagttttaggtcacttttttgctgctttgcaagtttagtgatttttttttttttttaacttcgatgctggacagtgtgaatgttaagtgatgaattttatggtctttctttaaagagtgttgaattttgtcttggtaggcagctaagttacttgtggatcaacttgtttttaattttttgtttttgtttttaaattgtgagatggagtttcactcttgttgcctaggttggagagcaatggcacgatctcggctcactgcaacctctgccctcccccggtttaaatgattctcctgcctcagccgtccgagtagctgagattacaggcaactgccacgatgcccggctaattttttgcagttgtagaagagatggggtttcaccatgttggccaggctagtctcgaactcctgacctcaggtgatccacccgtctgggctacccacagtgctgggattacaggtttgagccaccgcgcctggccgcttttaatctttattagggcatgtctagggtggtctatactctaggactggtttagccctactactaagatgtgaattttctagtattccttctgaatgtcctggtttttagtgaggcttttgctctctggctagttggcaatcacatttttcccagctctactgaactcttagaattgttcactttctggtaggtgttctttgcctagctttgtggaatttctcaccctaacacatgtagctttagctttcagcccaagactcaaggaacaccttgcagatttctagacctctttatctgtgtaggtcccccttctccagtagtctgctttgcacactgcagctgccttagctaccctgaactctgatctctgctgccttaacgtgatgggactgctgtgctctgcttgggttcttcctgcctgctctgctgcctgggacgtgcctctaggtggtaagcttaggcagttgtcaggctcacataggctgcactcaagtgtcacagttctgggctgcttttgactagtgtctgaaaacagttttttcgtatattttatggagatttctaattacaatgagagggcagctttaggaatgattacttcatcataggcctatgttgtttagtattaagtataggaaaataattgtgtctctgtccagttgaatggtaatatattttaagacagcaacttaaaattttaagatagtccgctagaactttctttgatgatgaaaatgttctgttcctgtggggtgtagccactggccatacgtcactattgtatacgtgaaatgtggctagtgccactgaagagatgaatttttaaattaatttaaatagctctatgtgggtaatggctcctgtaatggacagtgtggctgaaggttttctctcagtattagaaaatctcgaccttacaacgtttgcatttaaaaaagatgcctgtggttgatctttaacatattctaatttagaaaaatatagtttttttaagtataaaaatagttgcatgttcattggagatcatttggaaaatgcagaaagcacaaaaaaagttgagcacacataatcccaaagataagtaagattaatattttggtgtatttccttccagttttctataaagaagaacccactttagtgaaaaatcgtttggttttattttaaatatttctctctcaaaaggaaatatgtatggatggcaaggttaaaattgtgaaaatttgtatccttccagaattagctttatattgttatcaaataatagcatggcctaaacaggctttcctacctctataggctgtatatgtgtagcagtttcaggaataacatattaatcaggaagcttttttttttagtctattagttgcagactggtgtttaatagaaaacttatttggctattggctgctttttgacttcagctggaaggaagctcaaacataatatttggctcatttccacataagactaagggttactgactctggtctgaagactgcttgcagtttagtcgtctgagtgactcctgtggctgaggatgtgctgggtgcttagaatccaaaggtctggctaggcttaaggggttcatggtctagttagggagaaaaacatggcagattttcttctgtttttcttggggcaaaatcagattttactgtttaatagtacaaaatttttgcaaaattagcagataatactcatcatttctaacttctgaaatcttttgtttaggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctg

SEQ ID NO: 38219 - DNA, 269841 bp, Homo sapiens
tccggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaaaggttgccccagccgccagctccccgcccgtccgtcagcccaccagcttgcccacctggcggccctctcacccctccagtttcagcgctgcccggcgggccgcctgccgggcccttgttcaggtggcccgggcgcgttcgtttcctggccatttccagaactggaggctgtcaggagtctgaggcgggtgtgtggtttaggggaaaagaagccagctgacctggtagtgtgggggtggggggtgtagttgactccggcagtttctgggcctgcacttggcaatatctaggtgccctggtcttcataatgtgaaaatcaaggttttcaagcattgactgtgtggtccttgtttccttgcgtcccttctccccctcccccttaaagaggttaacagccttacagacttttttctagctacagtgctgctggaactttgattcattctttgtttatgggagtggcaaggagtcatttagatttgtttaaggctgggaaaaagagattgtagcgtaaacaagattatgactttaaccagagacccccaaattgactcagaaattggttaaaacttccttttgaatgaatgaaagtcactttggaagcccaccacagtacctggcactgtacaaagcaccatgttgttataaacccaaatcggcaaagttcaaaactttcccaggtgtgaagagtcaaatggagacccattggtttaaaaaaagcagcgttctcattctctgacaagcaggagaggtggatccgtaatgttaaaacccacttgagcagaagcctagatatgggttttattccttatattttatgagcccacacaaggtacctagtaaacacggaaagagttcttgatgaagcaataattgttttcatgtttttcagtttacacacctgcgggatttggggcatgctggtagccctttcccattcatctgtgtgctcatgcctaccttcaactactgtgtgtcccagactgcacttacacccccttacatctcctaatctggctcctggttacctttccagttatgcttgaaaaggtctccttctttaattaccccatcctgatccattactctgaataagtaggatctctaatcatttttgttctttcctattccattgatttttgtagaacattctccctaccttgcctaggtttccccttttctctttcagtctattgagacgcttcccacggctcagctgagttggcctcacccaaccaattcaggacaaccccacctggaaatgatttttcctctagaattctataagcgctcatttttatctacaattatttaacttagcaaatgtttactgaatatggatatgtatatatatgccaggtaccatgctaggcaattagagataaatataagattcagtctttgctgccagggagctcaatttagtgaaagagagataagggaaatgaataattctaacaccgtgataagtacattgtgtgagagttcttgtgacagtggtaggtgcgggaggggaatgggttattcacctttgagggatgggatgtggccaggtaatgcttcataatttgaggtaaactaaactttgagtatttgggtattatataggggtttctattgtttaatcattttaacctcaatttacagattaggaagacccataataaattacacagctggtaggagacagagccaggattcaaacccaggtctgtctgatgcctaaatctgtgctttttccattacatgtcttgcctttttctcacatcatctccctctttttatgcaagtacatattgaaaccaaaagttatataggacaaaacatatgaatgttaaaatgaatggtacagaaatcttttaaatgtaaagactgtgctcttccaaggcaaggagatggcaggtaggttagttagctcagctttgaatatgagcagagaagacagtctatagaaaataggcatggactctggattcaattcctggtccctgttcttacaggatatgtgaccttcgacacataactccaagcatcactttcttcaactaggggttgggttagggaataatattgaccacatggagtgttgtgaatatttattgaactaatggggataaagggcctggtacgtggtaaagtcccccgaaataaatagctataagatacaaaggtataatgcttgaggcatggttttagactggtgagtgagtttacagcctgagtcatgcaagtcattgcttcttttagcagggtacaaggacgtaaagttggaggggcggtaggggtcagagtcagtgagggcttgagtaccaggcaagggaggtaaattccagtttctgctaataacttttccagttaataaatacttcgaggatctacgattcatttcagcagtgccaagcaaaatgttagaccttggggatacaaaaagaagtaaaattgggtccctatcctgaggttattgacattctagtagaggagatgtctgtgtgtgtgcaggtgaaccataataaagtactgtgggttctaaggtagaagtccccaggaggtaccatagaacactgagaaggaaacactgatgatggtaggtaatgagtacttactctgctggtgtgatgttaaatgctttatctcatttttttctcgtgtgagaaggtgttattagcatcctgattttacagatgaggaaactggggcacagagaccttgaataacttccttgagtttatgctgctggtagagctgtaagatagaggggattatctgctgaacactgagatcggcactcttcattactacaccatgttgcttgttctttgtgatgtggatgcggaccctctggaaaggcttcagagagaaacttgcccttgagctgtagcttcagtgtgccagtcattgtgagacaggagggatcacgaggaatggaagtggcctttgcactaaaggagctcatagccttatctgttactttaaatgtttttcttttttggtgggggagcttgttttgcttattgacttatacctgaagacttcagaaacttttgcagttgagtggatttatatgattcagcctaagataatttgctggcaatctgttattctgatgtataggccttactgttacggacgcagttgtagatgtcaaattattatatgacaaggacttctgtcacgttacttgtttttttttttttttttgagacagtcttgctctatcacccagggtggagtgcagtggcatgatcttggctgactgcaacctctgcctcctgggttcaagagattctcttgcctcagcctcccaagtagctgggactataggcaggtgccaccacgcctggccaatttttgtgtttttagtagaaacggggttttgctgtgttggccaggctggtctcaaactcctgacctcaagtgatctgcctgcctcgggctctcaaagtgctgggattacaggcgtgagccaccattcgtggccacattacgttttttccctatgggaggtgccctgacttgtttctgtgagttcgaagtttttgtgaagttttttgactcagaagtcagcatatttcagcttgtgttaaatttaagaggcttagtggttaaatatgttacttaagagtcacagagctaatgtgtgatagagccacaaaaaactggccaaaaaagagtaaacaaatcttcattaaattattattattgttctgtttgagcatcttcctcagtggtctccaagtccgatgcctgttatgtactaggatgagtaggctgggccttgatgaactggagagcacgggcccaaactaaagggagcagttgctgctcagctccacttgcttgttgccatgtgaggaagtgggcccagtgtccttggatcttttgacactttttggaaaagatgctggaaatctggattttaatttattcttatttatttatttaacttttagagacagggtatcgtcctatcaggctagagtgcagtttcgtggtaatagctcactacagccttgaattctgggctcaagtgatcctcccacctctgcctccccaatagctaggactacaggcgcatgccactatgtgtagctagttttttttttttttctttttttgagacaaagtctcgctcttgttgcccaggctggagtgcagtggcatgaccttggctcactgcaatgtccgcctcccgggttcaagcgattctcttgcctcagcctcctgagtagctgggactacaggtgcccatcaccacgcccagctaatttttgtatttttagtagagacagggttttgccgtgttggccaggctggtcttgaactcttgacctcaagtgatccgcctgcttcaggctctcaaagtgctgggattacaggggtgagccattgcatccggccatgtactagctagttgttgcttttattttttttgtgggaaggagtttcgctcttgttgcccaggctggagtgcaatggcgcgatcttgactcactgcaacctccacctcctgggttcaagcaattctcctgcctcagcctcctgagtagctgggattacaggtatgcgccaccacgcctggctaattttgtatttttagtagaggcggggtttctgcatgttggtcaggctggtctcgaactcccgacctcaggtgatccacctgccttggcctcccaaagtgctgggactacaggcgtgagccactgcgcccggcctaatttttaaaaaaattttgtagagatggtgtctatctatgttgcctaggctggtcttgaactcctgccttcaaatgatactcctgccatggcctcccaaattgttgggattacaggtgtgagccactgcatgtcgtggattttaatgtatttagtttaaaaatttgccattaaaaattatgttgatcaaaacatatttgtgggctgagtgtaattctaggctgcctgattgtgaactccaacctacctggctgctgaaattttggtacctgttgttcagagcaggaagtatacaatacaatgttttgattattgattagaaatctcatggtaaattgccagtgtgagggggcattgtagcttgcgctgatagttttggagagtggcaaggtcaatgcttttattgtataatcaagctaaagtatagatctggctggtgagatgaccttataacacttctattttgtgctcttagcactttaaatgctaccagatttcttgtctcttggccctctccacaatagtatgaagtggtatggtaaatttgttaaatgctcttgtataccttattttctttagtcttcatagtcctatgagataggtagtattacaaagggggtaatcatcacctcttgagatgaagaaatcggcacccagtgaatcacagtttagtggaaagagcagttgactagagagggtgttgcatcctgaatatgcggataccactaacagccagtgaatcacagtttagtagcaagtgcagttgactagagagtgatttgcatcctgaatatgcggataccgctaacagcctttggagtttggtcacgtcacttacaaatcctcggatcttttttcctttttggataaataatgaggagtaaaattcaagtcttgctgaaattcaattcgtaatatcctatacttgagtatacttttactaatatacttttattactgatgcaaagtatactgaatgtgtaaaacttcaaaaaaataacattttccagttccctgcggactcattttaaggtactgtgttacaaataagtaccatttcagcagagaaattggtagaaaattgaaggaatggttttcttttcgggatgccaagctttctgtttctaattgatatgcttaaagtcacacaactgattactggcagactccagtggagatgactcaaatctaaaatgctgcccctcctctcttgctggcaggtcaggaaccactactcagctcttcatctgttctttattcattacttcctctgggaaaggcccttgatgggccaggtgctcccccagtgcatgcagtgcctattgactatatgtactcaagattgaaagggggcgtagagacacccagcacagtgagagaaatatggtcagggagttcccagcccaagagtttaatttatttttattttaatacccagctttcacaaggtgaaaattgaagaaatactggtcttgtagatacttgttttcattcatactctattgtataaggaaataacagaatataaaaataaagggaataaatcctgagcagtcattcaaaatttattaactctagttggcagcagtctagatatattggggaaatggatttaatataggcaacacaaaatttggactgaaagtagaatacagttttatgtaattgaaagtgagaaaaatgggagaaaccacttaaaaaacaaacccgaaactctagaaagaacaagaaggtattagaataactattggaattaagttatagtaattgcttgtgaaataagtggaatattatgtcacatttatgcctaaatataagcagtgttagattcttaatatcctatacgtgagtatacttttatgaatatacttttattattgatgcaaagtgtactgaatgtgtaaaacttcaaaaaaaataacattttccagttccttatggactcattttaaggtactgtgttataaataagtaccatttcagcagagaaattggtagaaaattgtttgaaggaatggttttcttttgaaaataaagcgagtatttaatctgaaccttagttactgacataaaggagactaacgaagaactgaagtgcagacttgaattttaagcagtgtgacatggggctttgggcagacccgcttggatttgattattggctttgtcagtctgtaagctggacagtctgcaaaatggggacagtaatgccaatctcacatagtccttagtgaggactaaatgaaacaatatatgtaagtaccttgtaagtactgtagtgcttctggagagatgcaggtccaggctgagcatccctactcaaaatattcaaaatctgggccagatttgctggctcacacctttaatcccagcactttgggaggccaagatgagtggattgcttgagcttgggagttcaagagcagcctgggcaaaataatgaaaccctgtctctacaaaaatattagccaggcatggtggcgcacatctgtagttccaggctgaggtaggaggattgcttgagcccagggggctgaggctgctgtgagccatgatcacaccactgtactccagcctgggcaacagagcaagactgtctcaaaaaaaaaaaaaaatcaaaatcaaaaatccttcaaaattcaaaacttttcgaactgacatgatgccacaattggaaaattctatgcctgacctcatgtgacaggttgcagttaaaactttatttcatgcataaaattattaaaaatactggctgggtgaggtggctcataaccagcaatcctgggaggccaaggtgggaggattgcttgagttcaggagttagagactagcctgggcaacacagcaagaccttgtctctactaaaaatcaaaacaattagcttggtgtggtggtgtgtgcctgtagtcccagctacttgggaggccgaggcaggaggatcgtttgagcccggggtgtcaaggctgcagtgagccatgattgtgctcctgcactccagcctggatgacagagggagaccctgcctcaaaaaagaaaaaaaaagttagtataaaattaccttcaggctatgtgtgtaaagtgtatatgaaatataagtgaattgcgtgtttagacttgtgtcttatccccaggatactgcatgatatatatgaaaatattccaaaattcaaagaaaatccagagtctgaaacacttctggtcccaagcattttagataagggatgccaacctctaatggcattcagggcataagacattcaggatgttaatatgatgtaataagcaatgatttgatggagtggtcataaaagagtgagactcattttcatgtctggatcatgaaatttgttaatttctgttgtgttttgtaaattagtgcacctacatactgtattgagagaaggactttaggatgctgtttttaagctattatgtgaattgatctgctgagtaacaagaaacacttccaagtgtttatattatcttttttgtgcctgtaactgctctttgttagaaaagggatattatgttatccccgtccccattttacaaatgccgaaactgaagcttagagaagtaatgtaattattaataaaaatatagagctaccgggccgggtgcggtggctcatgcctgtaatcccaacactctgggaggctgaggcaggtggatcacctgaggtcaggagttcgagaccagcctggccaacatggcgaaaccctgtctctactaaaaatacaaaaatttgccaggcgtggtggcacacacacgcctatagtcccagttactcgggaggctgaggcaggagaattgcttgaacccgggagtcggaggttgccatgagccaagattgcgccattgcactccagcctgggtgacaagagtgaaactccatctcaaaaaatatatatattttatatatatatatatatatatatatatatatatatatatatatatatatttatatatattatgtattatatatatttataaattatatatttatatattttgagatggaatatatatatacacacacatatatatacacatatgtgtgtgtatatatatatactttttgtatatacgtatagagagagcgagaacgcgcatgcgtgagtagcaaaactaggacttgacctttgttttgactcagagtactgaaaagcactattactttttttttggagttgggggtcacttttccatgctgctctggatttggatattgggactggccctgtcttgggactgtcattaattatggccctttgccttcatttaaacttaatgtttacagaaagttattattgattatattgtgagagtgtttgattataggtatagtgttatgatatgaagcttaaggatttgatgaaaatactaatactcattgataataaagattggtggtaagatggtaagatggttactcatattgatagtgggaatgtaaatgagtaaaacttttctggaaagcactttggcagtatttattaacaagcttttaaaaaaagttatgcatgccttttgagcttgtaattccatttctaggaatctttattaaagaaatcagagatgtcgaaagatattcgtgttcaaagatgttcactgcagcagtatttagcaaaaattagaaccttaatgttcaataaaaattagagaaatcatggaaaattcatagaatggaaataatatacagtcatcttagatgtttcagaagaattttagtgacatactaatatgctaaccatataataagtgaaaaaaggatatgacactctataaagtatggtcccaattatgtcaaacatgtatgcaaagaaaagaaataggtggtgagattataagacttgatatttttctcagttttagaaatgttctttgataaacaaattatttaaaaataaatcatagtttaaaattgatattaacaaatatgagtagagtcagtgaccatcattttaaccaatagttttcactaatgcaggtgattgtgaagttgtaaatggattgtattttcaagttagttttcacctcttttattttgcacttagaacatggtttcatatgtcctgacataaatgatgttactattcccaggaaagccttcttttcccccaaaagtcctatttaagacagtattctggaagaagagttgtattcgtattggtggtatcattatcccggtgctaccatcacctcttcagtggccacagggacaacgagtaggcctgtgacagctccgtctttactttcagagggagtccactcctatctctgtggagttgaggttggcctttggtagatagagatagtgagttgaatgcttacgtatttgggaagtgattttttggtatggaaaattatgtgtgttaaggtaaactgaggcataagattttagagtttatttgcacaaacagcgattcatgaattgggcagcttcaaatcagaagtgattctggggctccattgagggaaagtaagcgggggaagcttttgtaggaagactgtggaagtaaaacaaaagatttgattgattagttatacagttgatcactaccattggaaagtcctcagttacataagtttgttggctgcttctgactagataagcttaaggttttttgttttttttttcatatatgcatttataagacatatctcaagttttgcctatgtttgcaaatcaaacaaggttaaggtcatttataaggcctaactagttttgtctgcttgaatttttcagaccaggtctgatttttttgttttgttgttgttgttgttttatttgtttttttgtttgtttgttttttgttttttttttgtttttttttcgagacagggttcttgctctattgaccaggctggagtgcagtggcacgatcacggctcactgcagcctcaacttcctggactcaagcgatcctcccacctcttcctccccagcagctgggactacaggcatgcactaccacggcctcccaaattgttgggattgtaagcatgaaccactgcatctggccaggcctggtctgttttaatttattttaacaaatgtgaatgtctgtctcacttattttattttgtgagaagaagattgaagatcacgtttgtttggatttcagtttttctgatagcagtagttagtaaaaatatgagtgttaaaatatgatgaattgttgccttttactcttttctaattatcatatactttataattgaaatagtttcaggctgggcacagtaatcccaacactttgggaggctgaggcaggtggatcacctgaggttgggagttcaagaccagcctgaccaacatgtagaaaccccgtctctactaaaaatacaaaattagccgggtgtgatggcacatgcctataatcccagctactcgggtggctgaggcaggagaagcaattgaacccgggaggtggaggttgcagtgagccaagattgcgccattgcattccaggctgggcaacaatggtgaaactccgtctcaaaaaaaaaaagaaagaaaagaaatagtttcagcttgtacagttaagcatgatggccagttaggtttgtttttttcaaatgcgcatactgattctcttatgtacaatataaaaatgtgcatactgattctcttatgtacaatgcaaaaaatttaccgaagtatttgagcatatttaaattaggaaaatatcaggcaagatgtttcttttgtaaactacttctgtccaaagcattctgtatattatcagaatgaaaaatgacagcactttgtcatctgttcaaattgatattgcactctttgcaatgacagctgaaaaggcccacaggtgccatataaagaggtgaccatgttgtcatatttcatttcggcatccctctgcaaagccataattacctaattaggttgttaattaggagattagcatttcactatattgatagaatgctctttaccggcgtggggtgagatacagatttgtctgctctaatttataatctctgcctgttttgtacttatttatttgcttaagatgctggtatggggcaattcagtttacctgagaaacagtttacaagcgaatgaagctttgatcactggattaaagttgctgagttaaaatacggacacatccccaaaattaaaataaaaattccaagttggtataacttgtattattgttaacacagtcaacaaacacaataagaattcacattgttggtataaaaaattcaaaatacaaaaacttaagtctgaactatgacagagatttatctatcctaaactaggcaaaataaattattttaattatcttcaatgacagacctctgtcatttatacttgggacttataagaatatgctaaatgttttgaatgtatttaagaaactgaagcttggttaataacttcagaacaaatatattgagtcttcagtttagacttccttagatagtcatgcatcagggcttatttcatttgtaccttctgtccattagtctgtgcttggaacattcccttcccacagtctttgcagtactgaggggcttatggaatttgaagtatttcacagtaaccttcacttggtgagctatttggagtaagcacggtttctataaagtgtgtctaacattcttttgggagagggggcggggaaaacgatttccatacattttctctgtagtgtttgtaatttgcattatgcatacttttctgcctttttttagttaaggaaattaggagtttcagaacaatgttaagagcaccattcccactgaggtagtagtttagcttcttttgatcgtattggtattggcattcaaattgtagtaaatgcatgtgtgcttaagtcctttttccctacagttatgaagaactgcatttgttttatagccgtaattttcttaaaacttttttttttttggaaatggagtcttgctctgtttcccaggctggagtgcgatggcaccatcttggcttactgaaacctctgcctcctgagttcaagcagttctcctgcctcagcctcccaagtagctgagattacgggtgtgcaccaccacacctggctaatttttgtagtttagtaaagatggagtttcaccatgttggccaggctggtctcgaactcctgacctcaggtgatctacctgcctcggcctcccaaagtgctgggattacaagcatgagccaccgtgcccaacctaaaaaatttttaaaaattaaaaaaaaattttaatacaaataacagagaaggggtcttgctatagtgcccaggctgcacttgaactcctgggctcaagggaacttcctcctctgcctcccaaagtgctgggtttacaggtgtgagcccctatgcccggccaactatatatatatgtgtgtgtgtgtgtgtgtgtgtgtgtatgtgtgtatatatatgtgtgtgtgtgtatatgtgtgtgtatatatatgtgtgtatatatatacgtgtatatatgtgtatatacgtgtatatatgtgtatatatacgtgtatatatgtgtatatacgtgtatatatgtgtatatatacgtgtatatatacgtgtatatatacgtgtatatgtgtgtgtatgtatacgtgtatatgtgtgtgtatatgtgtatatatgtgtgtatatatgtgtatgtgtgtgtgtatacgtgtatatatgtgtgtgtatgtatatatgtgtgtgtatatgtatatatgtgtgtgtatatgtgtatatatgtgtgtgtatgtgtatatatgtgtgtatatatgtgtatatgtgtgtgtatatatacatgtatgtgtgtgtgtgtgtatatatatatatatatttttttttttttgaggcggaatttcgctcttgttacttgagctggagtgcaatggcatgatcttggctcactgcaacctctgcctcttgggttcaagcgattctcctgcctcagctgcccgagtagctgggattacaggtgcgtgccaccacgcttggctagttttttgtatttttagtagagacggggtttcaccatgttggccaggctggtctcaaactcctgacatcaggtgatccgcctgcctcggcctcccaaagtgctgggattacaggagtaagccactgtgcccggcctgttttcttaatataaaaatattataaggggcttctcatgcggatcccctggtgtggattagaatgttgtgtcgtgctctggtaggagaaactgctccagtgtgtgagggtttgcttcagcaaagccagaagttctgatgggatttctggtactaggattaacctccttcaactagaaatgtaggttagttacctttacacaggtcacgaaggtatatgacagttctctttttccccagaagagaagacttggaaactgccatttttgcatgaggaatttgatgtctatttgatgtaatcaacttatattacagattgtttaaaaatttttatggttactgttgccaattctgcttattaggtactttgttggtatccttgttttggaatcacctgaattagaaaaaatctaggatgtagcatggattctagccttcctgtgtttctatcccctttcttttttaaaaattgagatataattcgcataccataaaattcacgcctctaaaatgtacaatttaatgactcttaggatattcacaaagttgtataactgtcactattaactaattccagaacatttttgtcacctcagaaagaaatctcatattcattaatagtcactccacttttcctcctcctgctgctggcaaccattaatctactttctgtctctatggatttgcctgttccaaacctttcatatacaaagaattgacagtttgtggcctttgatataatgtaataattttcaaggttcatctgtgttgtagcatggatcagtacttcattcctttttattgccaaataatattccattgtatgtctgtaccacattttgtttatctgttcatcagttgatggacatttgggttatttctaccttttggttattatgaatactactgtgaacatttgtatacaaattttcgtgtgaacatatgtttttagttctcttgggtatattcctaggagtggagttgctgggtcatatggtaacgctctgtttaacattttgagaaactgccaggctgtttttcaaagcagctgcattattttacatttcctccaacaatgcataaggtcagcctcctttctgcttctattctcctcaggttctgtatttctctgctctgggctggaagcagccctaggctctaggaattccacaagacttttgtttaaataggtgggaaatgatccatttttctctgttcagccaggttcattctacaagcatgtgggtaccaggcatatatattgggcattagtgataggaagtcaaatgccctttcctctcaaggactttacagtccagcagtgaacttcttactaggaaatgcgaggtgaggggaaagtgaagaaagtaatagcttataaattcatgagtttacacagcatggatagctaacttcaggatctagccaaagattgactttttttttttccagcttctgttttttgtttttccttcaggctaccctttaactattgctgttccttggttttatccctaggttactgttcttcttacatattctccctgggcaaaattcacatctatggatttacctgtcacttacatgttgatgtctcccaagtttgctcagacctttctcctgggctctcaggtttgtgttttgatggatctctatttgggtaatccatagacatctgaagcccgctcattgtgtctgaaacataactcctcatctccccactacctgataatctgtttctgcttttgagtttatggttttatttgttggcactatcatgcaagccataaacttcccccttcttaatccttcacattcactcagtcaccgagttctaccagttttgttttgttttgttttgttttgtttttgagacggagtcttgctctgtcacccaggctggagtgcagtggcgcgatctcggctcactggaagctctgcctcccaggttcacgccattctcctgcctcagcctcccaagtagctgggactacaggcgcccgccaccacgcccggctaattttttctatttttagtagagacggggtttcaccgtgttagccaggatggtctcattctcctgacctcgcgatccacccacctcggcctcccacagtgctgggattacaggcgtgagccactgcgcccggcctctaccagtttttatctcttaaatattttgtgactgtttcttgaattcgtgcaaccatctttcactgccttcagatttcatcatctctgggctatcttcacagctttataactagtcttctgttttgaggaagtctctctgtaatgctagtcagcaactttgaactctgtgtaattttagttactaaatacatgttgttctgctgtttcttgcttcagtgccttgtccgatgctgtgtcttctacctcgaatgttgccttttaccccctctttgaaccttccaatttctcatctttgaagattcatcttagaccagggaataatagcaataataatagtaaagagttgtaatggtgcttaccatgggtcaggcactgaagcacataacatgtattaattcattcagtcctcacaacaatcctatgaggtaggcactgaacttacttccatttacagatgaggaaatagacacagaagttgttactttctcaaggtcccaccacgaatgccaggtccaggtttgaagccaggcagtccgaagattgtttgctttcagcctctcctatgcaccctctctcaacttctgccattcccttggcttcctccactgcaaagggtagttatcttttctttgcttctgcaataactcacacatggcctgatgtttttgttttaagcatttctgaaacttctgaagtttctgatcagggagccaggattatagatggtttaattgccagctctctctcttttttttaactattaaggtggctaagttggaaatgacttcttccattattgtgatcttagtctcttctgtgaagccttgtctgagtagccagtctcatttagatattttttctttgtgtctccatagtacattgtttctttgagatggacttttgctcttgtagcccaggctggagtgcaatggcgcaatctaggctcactgtagcctccgcctcctgggttcaagcaattctcctgcctcagcctcctgagtagttgggattacgggcgcctacaacaatgcccaactaattttgtatttttttagtagagatggggtttcaccatgttggccaggctggtcatgaactcttgacctcaggtgacccgcccacctcggcctctcaaagttctgggattacaggcgtgagccaccgcgcctggcccgtagtacattgttatagactcctctagcgttgctctcattcttcttcttctttttttttttttttgagatggagtctcactctgtcgcccaggctggagtgcagtggtgcgatcatggctcactgcaacctccacctcccgggttcaagtgattctcacgcctcagcctcctgagtagctgggattacaggcacccaccaccacgcccagctaattttttgtagagatgaggtttcatcatgttggccaggctggtcttgaactcctgacctcaggtgacctgcctccttaagcctcccaaagtgcagggattataggcgtgagccactgtgcctggcctgttttttttttttttttttttttttttccgagatggagtctcactctgtcgcccaggctggagtgcagtggcgatctcggctcactgcaagctctgcctcccgggttcacgccattcttctgcctcagcctcctgagtagctgggactacaggcgcccgccaccacgcccggctaattttttgtatttttagtagaggtggggtttcaccgtgttagccaggatgttctctatctcctgacttcgtgatccgcccacctcggcctcccaaagtgctgggattacaggcgtgagccaccgcgcccggctggcctgttctttattgtggccatttgtatacttgtctttaaccccttgcttgactgtaagcctcttgggaatagggactatgacttagcactttatacgcctaaccctcagcgtgtagtatgtagtcatgcttattgaatgaactgataagtctctgtatacccatacctagacttgtgtgtaaggagtggagtaagaagattaagatgaagtgagcttaagctggaaatgtgagacagcatattgtagtgattgggagcaggattctggagccaggctatcctgactccacctcttactagttgcgtggccttgggcaagtttgtgccgaagtttactgatttatagaacatgaagaataatagaatctacctcatagctttgtgaatggcaaaagtgcctttattttgtttttaagagatgagggtcttacggccagctaatttttgtatttttttgtagagatggggttttgccatgttgcctaggctagtcttgaactcctgtgctcaagcaatccgcccatctctgcctcccaaagtgttgggattacaggcatgagccaccatgtctgggctgagaattgattattcgatttaaattgtatgttgtggaacattctcaccctaattatagtattataagcagaatgaagccagttctgttgcattatcctcatgtttggtacactgtggtgatttaaaaaatgagatagtctagctgggcatggtggttcatgcctgtaacccccgtactttgggaggccgaggccggcagatcacctgagttcaggggttcaagaccagcttggccaacatggtgaaacccggtctctactaaaaatacaaaattagcagggtgtggtggtgggtggctgtaatcccagttacttaggaggctgaggtaggagaatcgcttgaacctgggaggtggaggttgcagtgagctgagactgcaccattgcaatctagcctggatgacaagagcaaaactccgtctcaaaaaaagaagaaaaaaaatgagatagtctagaaggttctgagaaaatacctagcaaagttaacacagttttgttaatagtaacaataatagccattatcatttattgagattatgaaagctctattcaagtgaaaatacaaagcaccattcaaagtcacataaaagtagtttgaggattatctgctggtttagattatgttgttgctgtcttttgttcatcaggagttgaattaatgagtttgatagttgacagcttatttattttccttccaaaaagatatagctagaataggaaaagtcagtaatattacatcttagatttatgtcgtgctttttagctttctgtaaatatcctttttaaaaaatttaagagagagggtctcactctgttgcccaggctgaagtacagtggctcaatcatgctcactgtaaccttgaactcctgggctcaagtgattctcccatctcagcctcctgtgtagatagaactacaggcatgtgcccccatgcctggttaatttttacattttttttttttttgtataggtggggtcttgctctgttgcccaggctggtctcaaactccccgccttaagtgattcttctgtctctgcctctcaaaatgctgggatttataggcatgagctactgtgcccagcctctattttgttttatagcagcatcactgtgaagtggataataggacacatattatggctatttcactgtagaggaaacagtcggaagcactgactctcctaaagtcatcccatagctagtctctttaacagtgacaactgttaactaatccatagcagatgtcactaatccatagcctgtgacagcaacgtggaactctagatgtggcaaaacactgtgcctttttataatctgtgccattttcattttctgttaatattagtttcttttatgataacactctgaagataactgtattgtttatcacctttaactcttgtagttattggaaccagtttatatactagcattaaaaaaaaaaaaaaaaaagatgggcatggtggctcaggcctgtaatcccagcactttgggaggccgaggcgggcagatcacctgaggtcaggagttcgagaccagccttgccaacatggtgaaaccctggctctactaaacatagaaaaattagccgggcgtggtggtggcacctgtagtcccagctacttgggaggctgaggcaggagaatcacttgaacgtgggaggcagaggttgcagtgagctgagatcatgctcctgcacctcagcctgggcaacagatcaagactgtgtctctcaaaaaaaaaaaaccaaaacaaaacacaaaaacggcagtaatgcctgttcaaatcagtcaacatggtttacctttgtagagagtgtaccggcaacatcttgatactattacaattcttcgtcaaaaaagagattcctcgtacctctgagtttgaattatggcacaggtgtggtagaggtcaaacatgcaatgaaattctggtcgagggaaaacaatgtgaagcgaaaacacccaaaaccttttagatgggctccaggataaacctctcccagtcacatcctccttttcctcctccacacaagtgactggaatggaatttaagagctgaaagtcccttcatatagttcagccatgctatttaacagacataagaacagatgaggtttaaagaagtcacttgtccaaggccgtgtagttaggtccctggaatttaggtttcctgagtgatctttgtggtaaagtgtgttgcttttctttctttcttttttttattcttttttctttttctttttcttttcttttttttttttttgagacagagtctcattcttttgcccgggctggagtgcagtggctctatctcggtccactgcaagctccgcctcccgggttcatgccgttctcccgcctcagcctgggagtacaggcgcccaccaccaccacacctggctaattttatttttgtatttttagtagagacggggtttcaccgtgttagccaggatggtctcgatctcctgaccttgtgttctgcccacctcagcttcccaaagtgctgggattacaggcatgagccactgcactggccgcttttcttaattgatatgtggttaccctgaagaccaggtaagtggaaacattactctgttgaattcttccacttgtttgagcaaacttcaaacgctgaggagctgatagaaggaaaataaatcttagattgtaatgggagacctatctattaaaccagcagcatggatgggggtcctttttggtaaactcaccggacagccccttgggaacaagaaagatgcacctgttgtctattcattccacaatgagctcttattgaatgccatccacatatactagaaactggcagcatagtgatgggtaagatagtcagtgtcttgagagtttagaagtttagaagagaaaaccaacatgtaaacagattattatttaaaaagaaatgccaatgtgatttgtttgcgatcttttatttgttctttaattcattcattccttaacatggcaaccagggagattcttttaaatgtgagacagatcattcacaatcctccagtgacccctcatttcacttggagtaaaagctaaaggccttgggatggcctgtaaggccctacagactcaccccagtctttcagatcttattatctactacttgctccttggcggactccttgctgctccttgagcagtgtgaggcatgttcccctctgcttggcagacctattccctggagtgtctacatggcttgttctctcacctccttcaggtgttaagtcagatgtcacttaagtgaggcattccttgactatttcatttactgttgcaactcacggctccaccgagcattatccatttctttctctgtgctatttttcttcatggcacttctaactcactatataatttacttctttgtcctgccatgagggcaggactttgccttctctgctgtgttttctgcatctagaacagtgcctggcacatagtaggcattcagtaaatatttgttgaatgagtaaaatcaacaaacacttagcaccttactaacaggcagtgtgctgggttaattatttggtagaactaggaactaagtgcagtgaaatgggcacatggagggagcaagccgggtgcggtggctcaggtctgtaatcccaacgccctgggaggccgatggggaggatcgctggaatccaggaattcaagaccagtctgggcagcatggtgagaccttgtctctgcaaaaaattagccgggtgtggtagtgcatgcttgtagtcccagctacctgagaggccaagttgggaggatcgcctgagcccaggaggttaaggctaccgttgagctggattttgaataatatgttaggaggtagtcaggggaagaagggtgaaaaggcttctcagaccaagggctaagtcttacggaatgcaacttgtctttattgtagttgtttgggctttggcgctccttagggtagactaaaacttcagaaaacagacttgaacttttttagcccttagaaggtttaagcatagattttagtagcaaagttctatagtttagtttcagtataaacaaaacagtttcgagggagttgaaaattaccacaaatttagtggcttcaaacctcacattattgtggggtttttcaagcttggcattattcatattgatatttggggaggtataattttttgttgtggatgctgccttgtgcattgtaccatgtttactagcgtcactggcatctacccactggctactaatagcagccatctctagttgtaacagctggaactatctccagatattgattgcttaaatgtctcccaggaagaaaaaccggcttccatttgaaccattacattatcgttgatggaatctgtaacaacttcacaaatgatttggggagagatttataccttaatgaagtaaccatatttatgaatctagaattgggtaaatttaaaattgttggttccttaaaaataatattcatatgactcactgtaatgatggtagaaataaaatgctattaaaataggttggactctgggtgatatagaagggtttaccaaggatgagatacttctgttggacttacaagaataagatttgtattggagaagggtacacctgaaataaaggagtatcattaccaaaggccagcacatattcagtgcagtcctggaagttgcaagatggggagggaagaggtagtgaaattgcattttagagagccttatgtgttatatgtgaagggttataggcttattttccttcactatgctgaattcattttcttttgctgcatgacaaattaccacaaacttatctgcttaaaacgatatgaatttatgatttcacggtgagtcaggagtcatggcttcagctgagttttgtgttcatgctcttaaagggatgaaattaaggtgtcagctggctatatagctcatctggaggctcactagggaaagatcttccaatctctctcaggttgggtagtggaattcatttccttgcggtgatatgactaagatcctccttctcttgctagtggttggccaggaccattttcagctcctagaggctgctctcaggtccttgccatgtgtagttccataacatagctgtttgcttcttcaaggccggcaagaagatctctctggcttagaattgctctcttcaggtggctaagatggagtcttatataatggaaagtaatcaaggaaatgactgtcccatcacctttgccatgttttattggccagaaagaagcaagtcagattccacccacactcaagggtaggggacaacagaaaggggcaagaatttaagccaggcgcagtggctcatgcctgtaaccccagcactttgggaggctgaggtgggtggatcgcctgaggtcaggagtttgagaccagcctgcccaacatagtgaaactccatctctactaaaaatacaaaaaaattagctgggcgtggtggcgggcacctataatctcagctactagggaggctgaggcaggagaatcgcttgaacctgggaggcggaggttgtgagctgagatcgcaccattgcattccagcctgggcaacaagagcaaaactccgtctcaaaaaaaaaaaaaaaagaatttaaaattctatctactgggtccaccctcagaagatccatgaaggcagtggccaaaagtctttatttttgctcagcagtgtatctttggtgcccagcatgtagtaagtgccttataaatatttgtcaaatgaatgaaaccaatgaatgaatatttggtagacaattgagtgctagttacagcttaagctcctaaaccggtaatttcacattgagaaacagtctagttcttttggcattatttatattcttcagtttaggtaaaactagtaaacattttgacccaagatcttaaagtaaaacgtaaaattgtttattttcacaagtgtcagtcaaatctattatgtcagagagacaacacccattggaaaaataatttaggggccacattataccgaactggcagatttcttgtaacagctggaaatgttggcaggtttgaagttttgggggtggtgggtggttaggttgtttgaagtttcacagctattgctagcacataaacattatttcaaaacactttgaaaatacagattgttttataatagctgaataacagtattttattctaacttgtgcttagaactttatagtttagtgtggtttatacttaacagttcttcaaccttataggaaacatcttttgagtaaaatttagagttttgagttgtccattgataaagtgccattttatctgtacaaaatgacatttctgataccaaagtctatgtttttccactagatccttgccattcaaactgaggttaagagagtcctaggatgtgccagggtgtagtggaagctacaaagtaaccatggtacattttcctgaagtatcaattttagtgatgtatttgaagataaacatttttttttcctgttaaaacaaacataggggaggggcacagtggctcatgcctgtgatcccaactctttgggatgccaaagtgggagtatcgcttgagcccaggagtttgagactagcctggggaagatgacaagactcttgtctctacaaaaaaatttaaaaattagctgggtgtggtggtgcttgcctgcagtcccaggctggggtgggaggatcacttgagcccgggaagtcaaggccgcagtgagctgtgatcacacaactgcactccagcctgggtgacagagcgagacgctatctctgtaaacaaacatacataggtgcagtgtagtataaaatagaatacaaaatatgaatgaattctaaaaataaatttcttatggtgtgttactgtaggtggctcccctaggttgtctcataccttgatttatggtcactgtcccatgcccttcaggtgtgtccgtggagaagtgtgagaatcactctaccaggttcttttttaactggatcttggcagatgtaagattctgaggcatttcgaggttagtggcataagacaagaaaaccagggatcagggttcctttgtctgagggagacatttgatagaagaagagactgtgcctcctggtaggttagtgggaggcttgtccctgatgacttaatcactcatggggcctcagcaggacagctggaatgacagagatggctgagcttctttctccccatagtcttttacccctgactttttcccataattcagaagtggtccagaagaggccagggcagaagctgcaagcgctcttgaggccaaggttcagaatttccacaacattccttcccctatattctgttggtcaaagcaaatcgcagtgtgagtccagattcaaggatgaggaaatagactccacctcttgatgggaggagcttcaaaaattgtggtcttaaaaaatctaccttgtctccttgggcaagatacttaactcctttaagccttagttttgtttgtttttagatctataaaatgaggatagtattaatgcctacctcctgaagtggctgtaaggattaaatatgttgttacatgaaaagtgattagtacatctcatggtaagagctcagtaaatgtcaactgttactgtttcacttgtgtttctgcctaatgaaagcatagctatccttaaatacttctgccttccttcctgaagtcttctgtgatgttcctgtctcttggaaaacatgttgtcttaatatctcatttggtggtgggtttatcttgctttatgttattgttccctatgtatatgacacagctcctctgctgaagtttgtaagtaaacttctggagggggcaggccagtatttatacaatttttcatttagtgctgagatgattttgtgaatgaatctcattcaaaataagataaatcatttctgttattttagtctagtaagcacttttagtcaaaatatggaaataaaaatgtaaaaagaagaaacaaactctccagatatatggtctcacaatttactgcttaatgaaattgggcatattcacatggagaagattttaattccctgagggggaaaaaagctcaatttttgctagtccaaaaaataaatgaagatttaatttagagttaaattggagttagagaaagagatttaaaagcaataaagtgttttattttaatggtcacttcaattattttcgaattccaggaggtatgaattctgagctttaactagatcaaaggatgttgaaatcttagttaaaaaataaaaaaagagggtctgttggtttttataaaggcaagacgttgtatataataaaaagcctttttttctcccctcacttgtaatcattccttgttgtggaaaataaatgtgagtgttcctatgacacgtttaaggactcctgtacaggaattagctttaacttgcctgatgctaatagtgtgaagtcggggtacagtgtggaaaggttaaaaaaaaaaaaaaaaaatctcgcatctgctgttacatgttgttaactccctcagcagacattaaatcatttcaagtacaataatagtgtgggaggtaaattaactaaccattaacagtcttataaatacacaattaacatgccagcatttatatggcacattgatggggcagcagtaatttttgattgggagtttgcagacctttgtgaagcctcgggctgttgcctattctgacaagttttcacagattgcaggtgagagatcagagggaagtgagcgggtagtgttttgagaaagtccaggaaggggaatttccttctaaccattggatagacgtgagcattgtaagtcgtattgttgcctatctcaggtccttagagactgaagaagtatagggtgggcttgtttgcttgtagtgagttatttgaagaaatagagtatttcaggtatagacttgaagtaaaggtacatgagtcactagggattttaaaaaatattccttagacgtaactagatatttaaagtaaacccttcctctgtgatttcaggtcaacaacgagataatcactgaagttcctttgttctgtgaaattttgtgacttttatttttttgaacaaccattacatgcactgattgtttcttgctgttgtacaagcactgttgttagtggaggggagctaagggtttactctactgcataacacatttgctctcttatgtctttcacagagacccatgggggaaatttctctcaggccttagatacaaatgagtacaataggcttttaaaaagtcgtgttcagctgggcacggtggctcacgcctgtaattccagcactttgggaggccgaggtggggggatcacctgaggttaggagttcgagaccagcctggccaacatagtgaaaccctgtctctactaaaaatacaaaacttagtggggcgtggtggtgcacacttataatcccagccactcaggaggctgaggcaggagaattgcttgaaccagggagtcagaagttgcagttagccaggatcgcactgctgcactccagcctggacgacagtgcgagactccatctcaaaaaaaaaaaaaaattgtgtttattatgactattgtaactttgtccctctttgttttgagaggctctgtggtgtagggagtaagatcccaagctcttgaatttgattttttatttctatgtattagctgtctggctttgggcaagtttcttaacctttcattgtctcagtttttttcataagccattataaataaagtttggaaatgagtgtatgtaaaattatccaaaattatattaagacgtgatgcccatcaaaacctagtaaaaattattcccatgtttagaacatgttcctagttaccacaggcaggtttcatgatcattaatgaatacagatgggtgtgtaatctgggaacagtatccaaagtgcatctgaaaccactcttagcacttagtagaaacttagtaaatatttgttgaatatttattcatttgaagtgtaaaaggagacccacctagtatattaaaaatgcctgggccgggcgcggtggctcacgcctgtaatcccagcactttggaatgccaaggcgggcggatcacgaggtcaggagatcgaggccatcctggctaacatggggaaaccctgtctctactaaaaatacaaaaaattagccaggcgtggtggcgggcgcctgtagtcttagctactcaggaggctgaggcaggagagtggcgtgaacccgggaggcggagcttgcagtgagcagagatagccactgcactccagcctgggtgacagagcgagactctgtctcaaaaaaaaataaataaaaataaaataaaataaaaatgcctgtgttggcctggcatagtggttcacgcctgtaatcccaacactttaggaggccaaggctggtagatagcttgagcctaggagttcaagaccagcctgggcaatgtggtaaaaccccatctctacaaaaaatacaaaaagtagccaggcatggtggtgtgagcctatagtccaagctacttgggaggctgaggtgggagaatcacctgagtctgggaagttgaagctgcagtgagccgtgatcatgcctctgcacttcagcctgggcgatgggagtgagaccttgtctcaaaaagaaaaaaaaaattgtgttattttgggacatctctttctttccttctactgtgcatggatatccctattgcttccatttttagtaaaacaaatctttatgctttaaagaacgtggtgttaaaaagtgtgagaaagaagctgtgaaaagtgggaaagcttaggcaaggtgatattatttatctgtggcctaaaggtatgtaaaaaggtctatcttattttattattattattatttttgagacagaatcttgctctctcgcccaagctggagtgcagtggcaatttcggctcactgcaacctccacctgccaggttcaagagattttcatgcctcagcctcccgagtagctgacactataggtacgcaccaccacgcccccctactttttatatttttagtagagacggggtttcagcatgttggcgaggctagtctcgaactcctgacctcaggtgatccacctgccttggccccccaaagtgctgggattacaggcataagtgactgtaccgggccttattatttttttcagatggagtcttgctccgttgctgaggctggagggcagtggcaccatcttggctcacctctgcctcccaggttcaagcaattcttccaccttagcctcctcgcccagctaatttttgtatttttagtagagatggggtttcacatgttgaccaggtcggtctcaaactcctgaccacaagtgatccgcccgcctcggcctcccaaagtgctgagattacaggtgtgagccactgcacccggccaaaagacgtctggctgtgtcagagaatcaagagttggtaacatccagggaaggcattcaaggcctgaagagacagcatttgtgaaagtgtagaatagcatttctaaaccttgttctgtgaaacgctgttatacattgatatgtttagtattcctacagaaaacaatatttatggatggaataagtttgggatatattgttactagattcctccctcttggagagtcataatacacaaagtacataatttaaaagctttgggaagtcctgtgatgaaacagcaagaagaaaacctctttaacttggttgaatctggtgtttcctagactttttaaaaaaacttaaaaattttaaattgtggtaaaatatacatggtataaatgataagtaaaatttaccattttaaccatttttaaatgtgtagttcattggcattacatacattcatattatggtgcaaccgtcaccactgtccatttccataacttttccatcttcccaaactgaaatgtacccgttaaatactttttccccattactaccttcctccagctcctagcaactgctgttagactttctgtcagtttgactgctttaggtacctcataaatggaatcatacggtacttgtccttttgcgactggcttatttcacttagcgtaatgttctcagggctcatcaatgttgtaatgtgtcagaatttcctgtgtttgaaggctgaacaatattccatcgttatataccacattttgttcaccctctaccatgtattgttaatcgctacttagtattgtgttgtttgtatgtgtcatggcatatgtgtactattgtaggttccttttagatttccagtattacaaattactctgagataaatattttacacaattatctccttagaacaaatcctagaagtaggattgcccagatagtattcatgttttatattttggtaaatattaccaaattaccgtctaaaaagtcccagttttcattccttcatattgtgcatgagagtgcccatttctctgaacccttgccagagttagatttttaaaaatctttttgatctgtgcacaactgatcagagagtacaatttgtttttatccgtgatatgtatgtccttgtcttggaaatcaaacatagcttcaaatgataatttgctgctctttgggagattttttaaaatattcttttgggttttgaaaagtagtcttgttagaataagttgaatagtgttccaaggggacaattttgaagggcacgttgaagagatgctcttgtattacgaaaaaaagacaatcctttatttataatcacacacttacacctggcacattcatatatgacttatctctacaacaaaattgaatagtccttggaagttagacagcaacatttattgaactcctgccatgtataacagcctttgttgccagaaggaatatggtgttatgaaccctgtccttgtggaacttatagtctaagtctttaagtacatgtaattggaggtaaaaagtgacatacacaataatatgttttctggggcagtcctgtgggagttccatatcagagctggtagggaataaatattttttgaatgaatcatacagattccttaatgtatgaagtcatagtgtcctaatagagaagatatctgctgctgttgaggcatttgttctgggaggataaagctgggaagttggtatgtgccttcagaagtgtttgcccattcctcttatcttcagaagtgatctatttccctagaatagattttattgagggcacttcagtatacttttgtcactttgccttttgccatttgactttttggtgctagaacacctattaaatatctgatcacttctcggccttttggctaagatcaagtgtattaaatgtgtgacttctcattaaagcccttgtttttgcaagggagaactattcagtatgaatttgaaagcacctgcctctctactggtgactagctgccttcctttcatgccaggaagatggcttattgtgattgctgtagaaggatgtttgcagctctgatctgtgatactatgcttccacaaatactctcatttataaataaatgtgtggtgtatacattttttatggttatagagaagtttgtatttttacaagtgaaatttaaatgctcattgttaatttcatatttttttctgatcaatatccttaaaatggtagattgacactaatacttcagggaccagatatctcagaaatttgatgcttaaaggaatcccatggtattaggagatgtactcggtctgtattagggtattaactttttgattcagggataccttactcacctttgcatttcccattagcctcagagtaaaataagtactcaaggaatatattaagaggaaaaaagtgaagattaatgtaatttgcttgattagagatgctcctcagttaaatttctttttaatctcagtatctttattttaagacccactttaagacacatcagcagaatgatgtgtttccagacaacaatttttaaaaccttagttaactgtaaggatttattagctagatttcctctctatgttccatttctagaagaaacagattacaagaaaatctggtgttataagtccttctgaaagtaagtatcttctaggactgttcctggaaacatagtcaatccagctttcatattccttgtacttctcaacaattttgcaggggcagggaagtcactcagatgacttgcagtgtcctctatcacaaaggaagcacagacttattttatgtgccacgaacttactaagacagatgggatattgacatattttaggactactttaagcaagaattgatcattgaaattattgattttttatcattattattaatagctaacatttatttaattacatgccatgtatttttttgagcattttacctgcattatctcctgaagcttccattttataaatgaaggaaaaaaaaaagggaggctcaaaaaggtaaagtattttgactgagatcttatagctaacgagtaatagggccagggtttgaaccctttctgtctctagggcctagtacctaaccgttgtcctgcaatattttctttgttgagtattttcacttaactgagagggtgctatcttgttactagaacaaatattattacagtgttttttgtatgttttgttttgttttgtttttagaagacagggtctcactatgtcacccaggctggagtgcaatggtgcaatcatagctcactgcagccttgaatgctggggctcaagtgatccccccacttcagcctcatgagtagctatgactacaggcatgtcccaccatgctcagctaattaaaaaataataattattatatatatatatttttgtagagatagagttttgattgtgttgcccatgttggtcttgaactcctggactcaagcagtcctcctgcctcggccccccaaagggttgagagtacaggtgtgaatcactgtgcccggcctcattacagttttaacaggactgaggaagcagtttttataattaagtttctaaaataagaagttgattgtatagtaggtaattttgattataaattttattttaaaaacacaggccaggcatggtggctcacgcctgtaatcacagcactttgggaggccaaggcgggcggatcaactgaggtcgggagtttgagaccagcctgaccaacatggagaaaccccatttctactaaaaatacaaaattagctgggcatggtggcgcatccctgtaatcccagctacgcgggaggctgaggccggagaatcttgaacctgggaggtggaggttgcagtgagccaagatcacgccactgcactccagcctgggcaacaagcgcgataccctgtctcagaaaaaacacaacaacaacaacaacaaaaacacaatactatcttgacaggaaaatatattcattgagcaacattaatttggtggtacatcatttttataaaacccctagtaactctgaaagcattgtctgtgcccttttaaacacttcacaatcatatgacaggaggggaaatgtaaactgatgaaatagagttttgtactttagcacatcatttgaggaaaatacaacttgttcccccatgaccttataaagtaatgagaagattgcatgatagtgaagggagaaagaaaggaaaatatattgttttaacagtagttatgtgcttcgagtggcctgacttgtaaggagttgctgtgatttgttttgcaagagtgcaagccttcctttctgattctatagagatctcattgactagagctgcagcccctagtgcttataaggatttcctttcagcttagactaaatccttttaagctccacagaacagggataaatgttgattttcaaggtggcattttactacactgaatgtgtctgaaaaatgattcagtcattttctgccttattcttaaatatttgctgtgtacatcatgtttctaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacaggtaaacattgtgttctagtcatgtcttctgagctttaaatcagtaaacagtcttatggaataatgcataatattggaataggcttaatgggggatgtttccgggtattaataggaacatgcatatgtcagactaagagtgagtctgagcaacatctccatctctgcgactgcgaatggagagggcctctagaatattattagaagtagacagaagggggatagtgaaaaagttggttaggagagacatgttggacatttctaacaagtcattgtgtagaaaggcaagtggactggctttgagtgtcttcacacagcaacattagtcccagtaggtagactacccggagacagatttcaggttgacataataaagagcatttaatacagagaggtgaccacccaaagagagcaggcacttcttgcccctggaggaattgtgggggagtggggaaatgggaggagacacctgagtatttgttagggctggttttagtaggattctatacatagggtgtgagattagaaaaggggcccctgtttttgatacttcgcctttattttcttaaattgatcaccttttgatttttctggcttgaaaacactcaactttggtatacacgtatttagtcattagctttaaaagcttattgcccattttcccacttatatttttttggtggccttgtttcaaggggaatgtgatgaaccaaggacttttttttttacttagacaaattatttagaatacatattgtagttctaatatgacaggtattctaggaggtaattttttttagataatcagaaaatataatcttcaaattagcagtaacctgctaactcccaggaaaggtaatggcaaggagatatagtagaacactgaaaatacttacatatttattttcatggtccaaatgtaaaacacacataaaggaatattggaggtagagctggatacaatttactgtgaaaggcacattcaagttttggttcagaattcagtatctgtgacataagaataatttgctctcatgatgaaaataattaatagcatttcccagtatctaaaggaacttttgtcaaaataggatttgagtgaaggtttgaatataatttagaaccattgattttcagttctctagttgaaactgacttccttgcaggttattgagatgatatcttatatgacaggttgaatgtatttcagtgggagaatgctgctaaattgagagctttatgattatattactttggctgtacccttcacatttattaattgcaattgaatgtagttttcttcagtgttggttagatatagtgacattgtcagaatgctcttcccagcatagtttaaatttctggtaagattattttcagtgtttccctaccacaatgctaaggcagaagtgtataatttcctatcttgaaagaggcggaaaaagagatgtatttattttctattagcaaaatgctgggataggaagctgaagattagcaagagaaaactgatttcaagagatggcatcaattgtgactttcttttttattgtggtctctgtatgcggcagttgttaagtgcatgctgggtggtatttctctaaaggatcagttcactgatttttgaaggttgatcagccagtggcaatataatcacaaatgcataattttaggtgactcttgttggaatttctttaggtagcacttagatgctaataattaattgagattgtaggttgtcttagtgaccaaagaatttactttttaatccatgcagcatatcttaaaattttgtaaaagaaaaattgttctttttaagatttgactaatgttacaaagatacaaatcatttattttactacctataaactgtttcagcccactgaagaaaagctatgctaatttatatagctttgacattttataattttcatgatttttagataaaggattttatatttaaaactttaatagtctagtctgagttcatttatctttaatttttgaaatgggtagagtaattcataacagtaattttattcctgtaatgtaatattcacttcagttcatttgtgcattaaaattcctttaagaccgttattaatgatttatataatgaaatgtcatattaatcacagaagttttcacattttattattctcttccatgttaatactatctttatgatctctattagtgttttatatcctctaatttcaattataaatcaagaatattttcatgtttttgttggtatttgcttttcaggggtgccacctttaaaattttatgactttttctctacatatgcaatataaaacatctttattcatgtaaaggtagttaattatgtctttgtttatggtaaactttcattgacaaacttacagttataatatttcttttcaagctcaaagattagaacgactccgaaaagagagacaaaaccagatcaaatgcaaaaatattcagtggaaagaaagaaattctaagcaatcaggtaaatggaaatgattttaattcttaatttgagatttatatatttagtttattatataagaacttttatttttaattcatccttttaaatcctctggacttagatacctctagtgttttgagctttgagctctttctcttgtgtgccttgaccctctgaagctatatgctctttagttcttggctttttggccacccttcactctgggtcacagggattgatgtgtgcaggggacattttttacaagctgtcatgtcagtatttttttctgattttttaaaaaaatataggccaaggagtaccctatgatttgatttttattattattattttttttgagatagtgtttcactctttttgcccaggccggagtgcaatggcacggtcttggctcactgcagcctctgcctccccggttcaagcgattctcctgcctcaacgtcctcagtagctgggattacaggcgcatgccaccacacctggctaattttgtatttttagtagagatgggatttcaccatgttggccaggctggtcttgaactcctgacctccagtaatccacccaccgtggcctcctgaggtgctgggattacaggcatgagccactgtgcccagccgatttttttttttttttttgagacggagtcttgctgtgtcacccaggctggagtgcagtggtgccatctcggctcactgcagcctccgcctccctggttcaagcaattctcctgcctcagcctcccaagtagttgggactacaggtgcacaccaccatgcctggctaagttttgtatttttagtagagatggagtttcaccatgccaggctgttctcgaactcctggcctcaagtgatccacctgccttggcttcccaaagtgctgggattataggcgtgagccactgcgcccagcccctgtgatattttggatgagtttccaggttacagatttctcttggcagttccaacctagacttttccttgccccattagtgggcctagtaacagtcttttttgcatatatgcaaattcttttcccttagtgtaaaaaccattatgttgctggtattattagcatttgctgtatattttcatatagtatgtgtataaaggctggccatattatatactttcaaagcttcagtctcagcaagaagaaaagacttggggagaaaaacaatttcagaaataaaatgctattaaaatattttatagtggttatatcatgtttcctagactttctctttttcttctcctttaaaagaaatatctgcagtctgtcttctgtatcctcccagcacctcccaatatcatatcggcatgtaatagatgcctaataaatatttgtggattggctccattgttacacaataattataagtctaataatattaaggtttattatactaatagcagcctctacctcgtgctctactaggtactttacatgcattacctctattgcagtgatcttgcaaggtgtaggtatcgttgctattgtttacagataagacaaaggctcagggatttgatgaacttgccaaagttacccaacatggagggaagtgtgataatgagatgttttgtgtccagctctgcctgcatataaaggccagtctctctgcgctaaatcactctgtaaagtgcttcttgatttctcatactatggttataaactcaagtatccttagcaggtatgattttcttcatgactgctactaagtgatgactgtgtagaaccagaagtcccaattacttgtttttcttacttatatctcattctgacttgcttgaatgcagtagttcttgaatttctctctagttttactctgaatactttcaaaatctcacgaggctagccccttctgttgatcaagttaatgtttctctttgttgtatttaatacaaactgaaaatactttatatcacttatcttattcacttttttcaaattttttatatatcttaaagcagttcttattaatctcttcttgatcagtgaatacagagcaagtttatttaagctcctctgtctctccagccaccctttatttgcgttcttcacttccatagcttaaaaaattataaataaaacgcacagtgaggccaggcactgtggctcacacctgtaatcccaacacttttggaggccaaggtggcagatcagttgaggccaggagtttgaggccagcctggccaacatagtgaaaccccatttctactaaaaatacaaaaaattagccaggaggcaggcagatcacttgaggtcaggagttttaagaccagcctggccaacatggcgaaaccctgtctcaactaaaaatataaattagctgggcatggtggtgtgcgcctgtaattctagctactcaggaggcggaggcatgagaattgcttgaacctgggaggcagaggttgcagggagctaaaatcgcgccagtgcacttcagtctgggcaacagagcgagactgtgtctcaaacccaaaaatacggtgaatagagtacatcaaatataggtgcatcagtcccttttacaatgtgagaagtaagttcttcagcttaaattttgatacatctaataaatagaggattttatttgctcccccacttattttttaaagtctaatctactttaatttttgttcattgtttcacagaatatgctggagaaatagttatgtcaccttttgctttcatttgtaaccatactgtccattgtagacatgtacttcttatacttctctccttcagtttccttctctctcttttctgtgtctcacggattttgataattgagcctgtggtcttacttctggagaagctcttcaatgtgtatgttcatgcttgaactgttattccctgattctggccagaccagcagcctgcctggtagtcattcctgatggttagagtgaaacttatcaatgcacaaaagaatgtctttggattctcccttaggctgggtcctatcattaaaccatagcttggcactctgggtgtattgaagcatgctagaaaagtggaatcagcagtccactaaacatctacctggcaaactgagcagccatcctttttttatacatctcccacaaacgtactctctcagcaagaaatgccacatctaaatctttttgatctttattgagagttttggatgggtaattatttattcattctctgcttttaagaattgggggtctcactgtgttgcccaggctggcctcaaactctggattcaagtgtgtcaacctcctgaggagctaggactacaggcacatgacaccatacccaacttcattccctcattctttttctattatttatgctttgctaaaatcctttcatttgtttttcttatctttgttttatttcattccccactagaagaatcatcattctaaacaggatgaccaccctggaagtattcttcttccacaattattctgtcaacatccagtttatcctttaagacacagcataagggcagccttttcatagaggagatagagggtttgtggagaccatctagtccatacctcagttctttatgaacttactgatccatgtgccatgagaccacatgataaatgaaataccttagagtaagatccttgtaatattcttgtaactaaaactgcatggatagataagaacatggtgtcatcagaagggtgctttgttaggaataatgtcatattaagatccaaatatctttaattttattattttaaaatggtattggtattttattctgtacataattagttattacccttactcattgaatcatttaacaagtatttctttcataactcctgtgtgcctaataattctgtgctgagctctaggaggactacatgaatcctctcctcaagaagttcgaagtctaataggcaaataaggcttcttatgcatgaagttaaataataatgcaaaacaacaatgtagcttatttatatcaattatttacatgtacctgaagttttgtgtaacttctattattggtttcttaagtaatgattcccaaatacaatggaggtataaaaatcagaactgcatccaaaagtgcatgttataataacattccctatacatttctaggcctcacctgtggaattcttgatttagtagatgggggttggggcccacaaagttatgttttttttttgttttttgttttttgttttttttgagcaacaaggctgtttatttcatctgggtgcaggcgggctgagtccgaaaagagtcagcaaagggtggtgggattatcattagttcttataggttttgagataggtggtggagttaagagcaatgttttggggtcagggggtggttctcacaaagtacattctcaagggtggggagaattacaaagaactttcttaagggtaagttatggttttcaaaaggtccctgggtgattctgatgagtaatcagctcagggtatatagtatgttagccactaagtttatttatttcttttttgtttgtttgtttttgagacagagtctccttttgtcacccaggctggatggagtgcagtggcacagttttggctcactgtgacatccgcctctggggttcacacaattcttgtgcctcagcctccctagtggctaggattacaggcgtgtgccaccatgcttggctaattttttaaaaaacatttttagtagaggcagggttttgtcatgttggccaggctgatcttgaactcctggcctcatgtgatccgcccgcctcggcctcccaaagtgttgggattacaggtgtgagccactgtgcctggcctatttcatcttcattcaaagccagtaaattagctgttagtatgtctcttttacaggtgagaaaactggtgctcagaggccaaataactttcccaagttacttgtaagtagtaagtggtgaagccagaattcacctcctggacagtttgaccccaaagactttatagtctttctactctgctctgctccctcccatatcattggcagaaaggagctgcttctgaagctttgggtattgaggagtctttggtgttctcttgttccgttctttttcttttccttttttttttttttttgagagtgagtcttgctctgttgcccaggctggagtgcagtggcacgatctctgctcactgcaacctccgcctcccagattcaaatgattctcctgcctcagcctcccaagtagctgggattacaggcatctgccaccacgcctggctaatttttgtatttttagtagagacggggtttcaccatgttggccaggctggtctcaaactcctgacctcaagtgatcttctcgcctcggcctcctaaagtgctgggattacaggcatgagccaccacacccagcctaccatgataaataggacattcttcctcatacctttgttattggtcttttgtaaataaatctgttattttatttttatttttttttattttttttgagacggagttttactcttattgcccaggctggagtgcagtagcatgatctcggctcactgcaacctttgcctccaaggttcaagtgattctcctgcctcagtcctccaagtagctgggattacaggtgcccgccaccatgcccggctaatttttgtatttttggtagagacggggttttaccatgttggccaggctggtctcgaactcctgacatcaggtaatccaccctcctcggcctcccagagtgctgggattacaggtgtgagccaccgcacctggccgaaatctgttattttaatatatttgttttgtatcccgctgctccctaaattcttatagttctagtatgttccatgcataagttctgatacacattctcatcttctgaatgctatagtgtgtgctttttcataaagctgatgataattaaatttccaggctatttatttttttagttttgtgtttgttggtgaagtccaactgtttatattcgtcaggactttttagttgcaaataacaaaaagcagcttgaaggagggctctcaagaagtatagtctgcctgatgaatggcttgaaaccagaaggaagggctctcatgacttcccccatcttgtcttggcttctttctgcgcatctgctctctctgtcctcccttcctataccctaccccagcaactttttctacttctctggtccagacttattcattcaacaaatatttattattaaaaaataataaattattccttcaacaaatagtgaacaagacaaagtccttgtcttcatggggcttatattcgattgggggtagataaacagtaaacataatgtgccagaatgggtaaatggcatggagaagaatatagccaggtaagggggataaggaatgctaggcagagaattttgctattttgtgtagggtggccaaggaagggctcattaggaaggtactgtttgagtagagatctaaaggaagtggaggagtgagtcatgcatatatcgggagatgagtgttctaagaggaggaaatagcaagtgcaaagattctgaggcagaaacgtgcctggtgtattcaaaaaatagaataacaaggcaggatgcctgttggttagagcacagtaagcacgggaagagtgggatcagagaagtcagtagtggggttcctagttatggagggtctggtaaggaattgtattttttctctgaggtgatttgatcagagtagtgatgtgatatgtgacttcttttcccccagtttaaatttccttaaaaaaaaactttttattgtagaaaatttcagacatacacagaagtagagagaatggtttaatgaactcccttcactcatctgccagcttcaacaatgaacagtacatggctggtcctgtttgatttatacattttactaccagccctcccagattatttttaagcaaatcccagctactatatgatttcatacctaaatactttgtatttttaacatataaggaaactgtggcactactactcttcaaaaaattaatattattttaatattctctatatcatttaaaattatttatgttaattattataaagaaatgtttaataattacattgaaaaacatttaaaataatttctttataaagaaaaattttatttttatttttattttttttaagacggagtcttgctctgtcgcccaggctggagtgcagtggcacgatcttggctcactgcaagctccgcctcctgggttcacgccattcacctgcctcagcctcccgagtagctgggactacgggtgcccgccaccacacccagctaattttgtgtattttaagtagagacagggtttcaccctcttagccaggatggtctcgattttctgacctcgtgatccacccacctcggcctcccaaagtgctgggattacaggcgtgagccaccgtgcccagtcaggaaaaaaatttttgttttgaaacagggtcttgcactctcaccggggctagaatgcagtggcatgaacatggctcactacaacctcaacttcctgggctcaagtgattcttcctcctcagcctcccaagcagctgggactacaggcacatgtcaccattcctggctaatttttgcattttttgtagagatgggattttgccatgttggccaggctggtcttgaactcctgggctcaagtgatctgcccatcttggcctcccgaagtgctagaattacagtcggtgagccacagtgcctggccaagaaataattatttaatattattaaatatccgattatcgttcatatttccctaatcatctcaaatttttcttttttctctattgttttgttcatgtttggatctaagatccatctactactttggttaatgtctcattttttaatctatagcttctctttcacttttttcttataatttatttgttgaagaaattgggtcatttgctgggtaacaaagttatttaaaataattcccctctttgtagttaatctgccaagtcattattatacttaggttcatgtatttcattttgcctttgtttttagaggttatgcttttaattttcttttataattatttaaaacattgacatggcttcaaagtcagaaacataaagcaagataaagtcagagaaatctagcttcactttctgttcccttcactcttttatagtcatttttaaaaaggttttttgtccatttaaaactatatataagcatatttatatttatatcccctttttagattaaagatagcatactatacatactgttttgtacaatactttttttatttagtaatatattccgaggatttttctggagcaatatatagagataagcttcattccattttacagctgcataatactctgtgatacgcatgtaccagtgccaacccatgccccggtgagggatgtttgtttgttttcaggctttgcttttgcaaatggcaccgcagagaatagttgtatgcatttttttttaagttttgttttaccagtgtatctaagtggtattgttgggtcagagggtaaatgaagatgtgattttccttgatcttccgaattccgtttcataggactttcgctgtttcatgctcccactggtaacatacagagtgtctatgtcctcagagcctcaaatctttagatttttgccaatctgatgaaatgtagttttaatttgcatatctcttatgaatgtggttgagaatctttccatttaagagctgtttacatttctttttctgtgaacatttcatatttttgtcttatttttctatgtgtgttgttcagtgtcttctttacttttagaatatttacatattaggaatattgacctttattctttcctaatttatcatttgtctttttacttttttcccatacagaagtgttttcttttcatgtggtcaggtttatcaatttttctcctcattctgaagtttgtaacttgtatttcaaaagactcatattggcggctgtgtcaggaagaaacaagggttggggtgaggaggcaagggcagaaacagtaaagcgggttttaaggtgatgataacacagcgttgctagcggttgccacggttctgaatagcttttgaagtgtcggttgatgggtaggatgtgagaagtcaggatgactcccaggtttttggcctaatagaactgaattgccattaactgaggagactgtgggagtgggagctttggggaaagatcaagagtttggttatggataggtaacacttgaggtgcctggtggacatccaagtgaaagtgtccagtagaaagttggatgtctataatttcagggagtgtttagggttagaaataaccattgagaggtactagcatgtagaagatatttacttggggtttccctttttatttatttactttttttgaggtatgctttacattcggtgaaatgtacagatattaaatgtacagctcagtgacttttgacagacatatacatttatataactagcatcccagacaagtatagagcaattctgtcaccccaaaaaagttccctcgtgcccctttttagtcatttcactccccagaggcaagcattgttctgatttatgtcaccacaatttagttttgccccttatagatggtatttaaaagcatacgactggatgagatcaccagtggcgtgaatgtagattgagaagaggtccaagtgctgtgccttgggaaatgccagtgattcaagggagaaatgagatgaatcagcagagggactgaaagaagtagcctgagagacagtataaaagccagatagagtggagtcctggggaccaagtgaaaaaaatgttaaaacaggagggagtgaggaaccgtgtcaaatgctgccaagacatcttgtaagatgaggattaaaaattcaccaacagatttagcaacaaagggatcattggtgacctcgataaaagctgctttggtggagtagtgtggcctgaatatgcctacttggagtggatttgattgaatggaagtagagggactggacaggaagaatatagacagacattttaagaagcagaaaaatatggtagtaaccagaagggagggagtatgggatagagagaggattttttttttttttaatgagcagtgtttcagtactgtgtgctgatgtgactaattcagtaagagaaaaattgacaatggaagagagagaagagaattgctggagagctgttcatgagttggcaagagggatgggatctagtgcacaagggaagggctggcctaaggtaagggcagagggagttcatcctcgctagtaggaggacaggcagatagaagagcagatgagagcatgcaaaagttctctttggttgtttctattctccaagcctcgacaaaggaggaagaggggaggaggtgttaggttgaggagagaggtctgagtgtgaatgtctgagaatgaaagggttaatcatagcatcacattgcacctaaccctattggtaacagctgtgtgaagtctatacattacttatgtttgggattcctcagtttcttcatggagctagtagtaacatctctcttaggatctgtgaagactgtgactgtgccaggtgaggaaaatacctagtattgatcctggctcataatagatgcttaataaaggatcatttctttcccaattgtaagcatgaaagtggtaatagattacaggtagaaaagtacttcccatatttaaaatattactttaattgaattatagtctaattcctcttcaaatctgtgtttaatatgttgattatgtcgaactcctgtgctccagtgatcctcccaccttgcctttccaaagtgctaggattacaggtttgagccacggtgcccagctgcagttacatttttttttgaaagttctaagtgactctttcggagctctgttctctctcttggtttaatttgactatgctaaagtggaatggggttgaacacgtctattgcggattttaaagtctcagattgatttatttaaaaactttaagtgtggacatttcttcatagccgcttatcatctagctaccgccaccttgattgatattccaattgatttagagaattaaatgatctttgaaaagttacggaacttgtcttggttcactaatgaataagaactgaagattcagatttaataattttaatctgaattatttcaatcattcattcattcatgcaacaaaatttattcagtgtctaccttgttcattagtgccctaatgtataagagccttggtcaggtgcaaattctagttctgttacttattagctgtgtggtccagggctaatcaaaatattctaagcttgtttccacattgacaaatctgagataacgctagtatctacctcataggcttgttatgaggattaaatgagatatattgacttgctaaataaatgttagctactgttactacacttgatcttagccaaaaggccgagcagcaataaatgttagctactgttattataaatatcctttctctttttctcctcttcatctttggcatcaagagtttgtacaaggtgcaactggagagtgttagagaattaatatgcagatcttgaccttgaagaactagaattccaaaatcacataatattacaggcaggagggatctttgagattttctagtttgacaagcccagaaaggtttagagaagtgtctactgtcacatagcttgccgttagtagcaaagccgggccaaagctcgggtctcctggctgtgagtgctcttcctataaaatggctcctttgttactttgtctgattcttccccctcccttaaccccttctctttccaaattgactatcctggcctgcacgttcttccgtgctctgccttttcagtgcacggtatattgtggggctttctgcatgtatccgacctgaacatgtctctggatgctccttccttaaggttctaaggaagactttttagggaaggtggacaagttgtctctgtgtaatcacaaagatgtttttcttcctcttgtatcacagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaaggtaagtaaaaatgagactttgtccctttaagtaaaactgtaattgagtggagttgttgttggtattattattagatttagggtttcagaaatgctttgtagaatatcagttgacagttatagaatgtcacttacattttctaagacttgatgtaaaggtatgaatttgggttcagtattgtttccacagtaatatatttgggaggattaaaacaaaaacagtcctgtgctctttcattctctctttctctgtgtatagatatctcaggactgttgtgttttaatcctccccaacacacatatatatatgtgtgtgtatatatatgtatatacatatgtttatatatatatgagagaaaggggagggggaggaagggagagagaaatatatatgtgtatatttttaatccgttttatctcctaagtatacttgagaagttggattagttagattgtgattaatcaaggtctaattgtattgggaaagccttgaaagtggttctgggaggcaatttgcattgtcttggctgattattataactgtagaaattgtttgattattataactgtagaaattgttgagatctgagctttatttcagaattctaggctattgcttgcatttcagtatttcactgtagggggatcttgacacttgctatggaggctaactttgttttttgcctgtttgtgctaagtttgctgttatgaaattaaagtgtgtttgttttccttttagaaacatggccactatttcaggtggatcctagtttcatatgcagcaccccttccccaaccccctgccttcttgtgtctctgtgctgacctgagcagggccttgttcagaagacagtagcggttgatttttgtatttattgccatgatgtttgctgtctggcagtggtgtggggtgctgagtgatagctctttgcctggaggtattgtgtataatttgtcttacttcagcgccattgcagttaataaacatacagctttttgcttatgcttgatttttttttttcatgagctggttctgtcacttgtcctctttgagcagaggtgttttctcttcgaaagacttttacttcctacaattcagcaggtttccgtaggtttcagtaagcatgtatggccactggcacatgaggttattgatgtttctgagggataagagcaaaaactagaaacaaaatgcataagtaatataaaggtcctaatatgctctggaagtttcctccaaagaacttctgacagcacttttagtaagttatagactgtattgatgtaaagcttctctttcgtctgcccttgctgctttctcctgttttgtggaatgtagcatggagaaggaagttcccccaggggacaggaatgtcagcctctggaaaatggcgagttggactacataggatttaaaaaaaaatactacaatgattcatttagacatgtgagaagttattcttgggattagggtaagcagttggaatttatttgcttccattgcctgataccatctcattgtttgaggatgtaatttctggaatagttgatgtgtgataatgtgtttatatcaaaaaatagcacagatcttttaaaatactctataattctctttataccatagactttattgttaattacttaggttcagatttgtcacaaggttgtgaactctgcttggtgtgtatatatctaacttctgaagtaccagcgggaaaataaaaagtaaaccatctccttagtcacaaaggaattattctcgctagatgtgtgtttacactgaaggctctcaatgcttttgtcatagcaagtctatttgtaatccacgaaggatgtgagtgcagagcagtcaccattatgcattgattaagaaagatttagatattgataagtctatcttatgtgatgctattgtattattatcttacatattacaattgctaaaatacaattaaacccttgttctcatctgttatttaatattgatgcatttggcagatatgtaatgaaaatggctaatatttgaaggatattgtactgtacatattaaattagtctttctttatctttgtgaaatgcgtcaatatgatatacaatgacatctcaatgattaatagagaattatacttgagtcaagcctttttgtaacctagaaattaaaatgactattcaaataacacctcaaaatgatcaaattagcattttgtgattgcataataatgggattgtagtagttataacagcaccatggctgcctctagagttaagatcatgtcaaccccttgataataaagccttttccgtgagagttgactcttaataatttccagattgattcctcccataaatcatctgacgttcagcactaaatttttgttactgttgtaacttaaaattattttattttttttcggctcatatttaagaaatgaaatgagtgtcttgttttaatgattcactgtcttgtcattggaacaccatgcttttagcctcaaatgtaagggttttctatgtattttgatactccagttttttcttttttttacaaagatttgttaaagcctctaaaatatgtacagtttttttccccctccaaatattcacaatgcttttcttgggaataactcttgccttatttacataattaactgagttgcttaggtctcttgggcaaatagtacataattggggagagaaggggatggggaagagtttggggtctaattaaatatgctaaaaaactacttaattatgtattgcctcaagagactaactgctgtgaaatcctccttaagattaaactagtgttagatctgaagaaaggattttgcttttgctatggctttactgttacattttagtcaagcaggcacatatagtgttcttaacagttcatgccaactggattgttggtttttatgattctgagggtgagcatctcttagctgttgtgctaaattaaagtgaatatttccaagtaatttttggttcctgtagctggttaataattttataaaaagctttttaaaacagtggttggctaataattttttaaggcatgaaattgagagggaaaggctgtacttaggcatgtgccttggtgtaattttgacaatttttggggtcaggtttatcattttgatattatttctttagcaaattggtgatgctctctgtgatctgttttagagtctgggtctggattatcaataactgtttactgatcatttgaaaaaagttcaaggttgatggccaagcagttttagggcatgctttggtcagatccgcaaaaccagcctcagccatctgcctgaattcttaagcattgttgagaacggaacctctgaatagcctcgttaacaacacaaaacctctattctagaggttgagacaattggaaaacttcttgtgccagtccttctgatttcactggatgtgggaactgttggttgtgacaagaggttgctttgaggtgatcggggagtgggctttgctgagaggcaagtagacattcagcactaatttacgtgcctcaaaatatgtggattttctgccctgtttctccacccgtttcagattaggttatgttttaagaaggaaatctaaccctatccattttatgccatatcactttcttgagactcttttgctagtacattatcactattctggtcaaattgcatttgcagatattatccttaatagaccatcagaagttcaagtacccatttcctgtcaatacagttagtaataaaaaaaaagggactgattagcaagttgtgtcatctcagtcagttttttcacctctgaaaggagatgggtgtgagttcctcacaagcctcatgagaccatcaaataggataatgctaggatgaagcatctagcacagtgagaggcagtgtcgtttaataaagcaacctattctgtagtaaagcctccattcgaatccccatggctccacttacggtgtgacttcagtctagctacttaacctcatgaagcttggggttcaggacacactaccccaaaatgtggcaccttggaatattgaatatcataagctgaaggaacttgagaaatggcaggaagaactctgatcttcccctgcccttctcccctaagcaggtcacaaggccctcatgtgagacatgttctccctctgcctggaggaaaggagcatcctcatctcctaagatgaatcttaaagaacagggtttgcaaaatttccccacagtttaccacactgacttcctacctttttcctatcatattttccacatgactttccacttttcgtcaaacttaatataaaaaccctcagatttaaccgacagtttcttgggtcttcgttttcttatgaaggctctatgtcatgtaaaatttcggttaaataaatttgtgtgcttgtcttttgttactctgtttcttgttacaggggcctcagccaagcatttataagggtagaaggaaaaaatgtttcttctctacaagttccagtcctgatctgtgaaagaaatgatgacagtgtatcttcctcaggaggatgaaatgagcaggatgtgtttagcaggacgtgtagcacataggaaacactcaacaaatatcccacttctgctgctttctctttgtaaagggatgacacagggcactgacgatggggcagtgacgatgtctttcccacgtacttcattatgtggttgacaggattgagtgagagggaatgtgtttttaaaagccaggattttagaatagtgtcgtaaagaagaagtacagcagagagggtgaaaacggtctgcatgttgaagttcagggagtccagtggggttttggtccttcactaggaagattgagacaagtaattacttcctttgggtgggtgggggattggctattttttttaaacttttggtgagaaaatggttcaatattggtgatcgcttggcagtttctaaaatgttaaatatcctactttttgggcttagctaaatactattttctaaatataaggggaatgtttgacttgacaagtgcttgaaagagcaaaccagttctggttcatatagacaactgtgactttgatggtgttaacttgttagaaagtaaccatttctctattagaaactgttttaatagggaagctgcagagagcatgggggaagggataattcatgagtgctaattgcttggctgttaattttcataagtgttgatagaagcagttccttaaattaaactttgtttaaaatgtatcaggggaaatattccacaatgtcgagcctgaagtgaaaattaatatgaatgctgtggcaattaacacatactggttaatagcttttagcagcattttgggatgatagtccttaaatacatttttgcatgctgctcttgtttcagcattgttccagtctatgtcggataattatgaacaaatgttttctacaatcattggcattaaatagctctcttcaaagaaagtcacttaaaactttgcagaaaagcatgaagccaccgagaaatgttgcaaactcagaaaaggtcagcgaattgaaatcacgtaaaaagaaaaattgcccttagtggaaaaggcacctcatctgaacttggaaaatatgctattcttgtgggaatggtcccttctaatatgttaaactacgtttgcttctggatctctttcccaaagaaaaaaaaatgtagcctgggctttttagtgttggctgtgtttctagaaagcagcttttacttaatgctgcctgagctgaggcagtggccttcagcctaagggtcttctggccttacttccttctcctttacccccaacccctactcaactggtgggggtgcgggggtaaccatgaatgaagaaagaagttggctgcataatacggaaagtccaccactgctcctttcagtaagagttctccagggctttgcttgcttagtgcccagtatgagataaatctagagtgactatattttgaattaggagctgttcgtctcagttgttcagtggcttcatttacatacttttgttttgttttgtttttttgagacagagtctctctcttttgcccaggctggagtgcagtcgcaccatctcagctcactgcagcccctgcttcccaggttcaagtgatttctcccgcctcagcctcccgagtagctgggattacaggcgcctgccaacacacctggctaatttttgaatttttaatagagatggggtttcaccatgttggccaggctcgtctcaaactcctgacctcaggtgatctgcccgcctcggcctcccaaagtgctgggattacaggtgtgagccactgcgtccaacctacatactttttaaaagaaaagtctcaacatgattttagcagttattctcctggctacttatctctgtgactgtattttgctagtcttcctttcatagatcagtttttgttagtctattctatttctaaaagaagatggagtttagatattcactaccatttacatattctggtatatagtatagaaggatcgccgggcacagtggctcatgcctgtaaccccagcatgttgggaggctgaggcggaaggatcacttgagcccaggaggttgaggctgcagtgagctgtgattgcaccactgcactccagcctaggtgacagagcaagatggtgtctgaaaaagaaggatcaaattcattaaagacatctctttgtgagattatttcccccttaccattatattaattctctcctgttgctgttgcttcatgttatactgaaaatcccaagggaggacattgggatttttgtcttgatggtcagttcgtaatgagttaaataggaatcacaacaaaatgttttcggcattctacttctcatagaagttaaatcctctatgctgagttcttaaaactaacttcttccaccctgagctctctgtctaggcctcatttctgcagttagctgtgaaccttgccagtctgtggtggcttcctttgttgtggagccatcttctaaaaattccatgaggtagaattcaccattggcttaaggcttttcaaaggaaggcagactcttgccatggaaagaacatgtttgtcaggcttgggttaaaatcttttgatctgagagctaaagggtgagtaagaactagctaagaaaagggggaggagaaaggaacagaaggtctgaggcaaggggaatttggcaattttgaggaaccaaaagaaagttgtgtgactggagccctagggtgaagtagatcgtggtgaaaagtgaagctctgggggaagaccgggtatgattggtagaggtgttctctttaacctcatggcacggggaagccttgaacaaggatttaaatggggaggtgaggtaatcaaatttgttttgaaaagacccctggggctgtgctgccgagtatatccctgagaagggtttgtgaggatagagaaactaatcaagacattttttgcagtgctctgggtgagagagtggtaacttgggcttgcttgttagaatgaagatggagtgaatgaattcgagagatatttagtagtaggcaaaagtggtaggatttgatgatgtatgcagagaacagggttagaagggggtttgaaggatgatttcctggtccgtgtccggcttgtggagctggatggataatgaaaccatccctgagttaggaagcactgaaagagggcttctccctcaaagaacgaggccataattttactatcttgaagatatctctccagagaaatcaaatgacagcccagggtcacctagctgggcatagaatccaggtgttctaattctcaaagattcttattttcttcttttctttttttttttttttttttgagacggagtttctgtcacccattggcagctgttttggacctgctgactacagatcatagactgttaccatgtccttgaagacactgtacatctttttgggaggtggggtatatcctattgtctggtttgtgtttggggaatctgaggcagtgctttttgaggtgagagtggagcaaaaagcctcttttttgttctcgcttgtcagccagccttgaaactggccaaggaattgccttcagacgttagtcaccttccagacacttcctctcccatcagtcacttcctctcagatgacagggatgtgcactcagatgcccagcctgactcaccaggccattcagaggagaaaacgatagggtaattttattcttttattttcgagagagtaattttaaatgaggcagatgccaggtgtcatttaagacgtgttgattgtaattgttggaggttaggggactaagaggtaaacaacatggacgtatttttgttacaatgagattactgttgttgtactaccttctcactacctgactaattaccaggttagaagagggaatctggttggaatgaatatcgagcactgaggtctagcccaggagacaatccttgtaggtatggaggggactagggatggtgtcattttacattcagccttctcatcctggggtactttgctctgcatggtttgcagtagagagattgtcttctccctcgaagaatgaggccatgattttactatcttgaagacctctatccagagaaatcaaatgacagcctaggctccacctagctgggcatagaatccaagtgttctaattctcagagattcttattttcttattttcttttctttttttttttgagtcagagtctctgtcgcctaggctggagtgcagtggtgtgatcttggctcactgcaacctccgcctcccgggtttaagcgattctcctacctcagcctcccaagtagctgggattacaggtgcgtgccaccacgcccagctaatttttgtattctttctagaggcggggtttcaccatgttggtcaggctggtctccaactcctgaccaggtaatccgcctgcctcggcctcccaaagtgctgggattacaggtatgaaccactgtgcccagctgagatttttattttcattaatggggttcatacaaaatggaaacttgatttccaggactactaggccatgtgttagaaggaacactgacagggaatcagaagacttgagtgttagtcctggccatgcagttccttctctctgatgtaggacaagtaatctctcatctatgagccttgatttctgcgtgtttagaatcaggaatgtggcttagatgacctcttggattctttttggctttaagattccagagttttgtgattagggaggtgattgacatcagtgagatgtaggggggtacagatgggaaaactacaacttttgaagagttaatcttttgtgtatacattggaactttcctcttaattatcctaacagaacagtgatctagggagtattagctccaggtgagggaacaggctgagagagagaaagtgaggtgctcaaggattccccactagtgtgtggcagagctggtattcagctcctttttctcctattccagtaccacagctctttttcctagactcttgcagtcgttgttatggcgaaaacaaaaacagttaacatttgaaattttttaaaatttaaaaacaaaagtttttcctttagcagtggacttgaaacctgacggactgcttcagatctttttatcagttatatggattgggcaagttactgcatcttgttagccttaacttccttacatgtaaaaaaaaaaaaaaaaaagatattgggactggggaaggggaatgctttcacacgtagtaactggtgtgtgcctcacaaatgtttgtttatttccattgatttttctggtgtgcagagtggattcgttcacacatctctatccatcgaatacatcatttactaggcacccacactgtactggctcatttcaaacatttattgcataccagctctgcaccgtgcactgataaataaaatggggctgactgcccttggggaacttaaaagacaagagcggccatatggccatcaagtggagaaactatactttacatgaatgatcgtgcccagtgctgaggactgtgacagtggtccatgacattaggtgcacctgaccgagcagaggaacagaaccacgaacaacaaaccagagagcaaatgtgatgggcactatagatgaatagtagatgaatactgtctacggctcggatctgagccagtttcttatccttggtgtggttgtccgaatttcagttgtattcctacaggccagggaattcagctttggtcactcttataatgaagcccagaatggtactctccacatagaaatgtggaagtttttaaaaatggcagtgataaatttcaaatgtcattattctttgaggcttgcaactacatggcagtatcataagagctgtgttttattagtatttccactttactttctgttaaactgaagtttaacacctagacaaagatacatgtaagaaattttacaaaatacatgtaagtttaggaaatttgcaaaatatgctgctatgcaaccaaagattaaattgatttgttatatgtgcatttagctacaattcattttaattgtccgtatgaagttaaaaagtattagtgtcagataaagattcatcaccagagcgtgatttaaggctggtgctggagaacgcaggcatgtgttccggcagatgtttgtataaggcgctgtctttcctgacagcagttaaaaagtatggttatagtaatcaaattgtggtgcagcgactctgaggctagggccagattgaattaaaatagatataagatttatgaatagcaatagctgtgataaaatttcactgccttcttcaacaggaaggactttttccactgtggaaagaagaaaatctaataaccacttttctaaaactgtggttttgctgactttcattttctcttcctaattatggtatcaaaacaataacttgctgggttcttttttcaaccatgatgacctttttttcctctttctattttattaggtttctagctttaaaacaagtctttttaaatgatgttattgttttagtttagaaacaaaattcataaaatctagcctatgagatttaagcccccttttaaggaaggttttatcattattaccatagctccattttattgagtcttattttgtaccaagtcctctaatggacttgatatgtagcaatttgttcagtcctcataacattccttactgttgtacagagaaggaaactgaaacttcacggaagggataaatgatggctaggctttgaagctaaatttgtgagactcatggcctcctgatggcattgtattagttttttgttttgttttgttttgttttgttttgaagagacagggtgttgctctgttgtccaggctggtctcctgggctcaagtgatcctcctacctctacctctgtattagttttaaatttattctatcccaggcatttataatactaagatctctagtcttttcaccacccaaaggctttgaggtggttctcagattgacacaggaaaagcatttctttaatattcatgaagtatgtaatttaaaatatggggaatacctttgtgtacagttgatgtaatatttgaggagcccatttttggttagcattttaatacttctcaagatatcattactgaattaatgttaagggcagctttgttttatcacaattatctcaaaaaatttttaaaaattttatttagtggcacctatggggaataattttacatgatcggaactctgccttccaggtgtttgcattccagagtcagcacactgacagggataaacaagtggccaagtaggcagagggtagttgacattgtctcacatgagttgattataatgcatttattctatatggatgtcaaggaaacttggtacttttttttttttttttttttttgagacagagtcttgctccatcacgcaggccggagtgcagtggtgcgatcttggctcactgcaacctccacctcccagtttcaagtgattcttctgcctcagcctcccaagtagctgggactacaggcacctgccaccacgcctggctaatttttgcatttttagtagagacggggtttcaccatgttggccaggctggtcttgaactcctgagctcaggtgatctgcccgccttggcctcccaaagtgctgggatcataggcgtgagccaccgtacctggccaatttggtatctttttaagtaaaattagcttgagaaagaaaaatctatgtttgtcattgaacctgagttgtctttaaaactccattgtcatctgcgttctcactgagcttcgtttctcaggtgttgggggaaagtgtgcatgtgttttacttgaggctggccacagtggaaggactccagtcacatccttttgtgaggaggctggggttggggtttgcctctgtagctcttctgcaaagctagggggcttgtatttctctctgcctgggcagaggcctgctcttcaggtcccccttggctctagtgtccctttcagctcatctcctttcagcctttcccctcccctttttcttttggtgacggttactttttatgcgcagacacaaaggacccagaatgaatttgtttgtcttcaaaactctccttgtagtggttttgagattcctttccacctcctacatgtttgaggggctgccacattatgactgatgattgcgctatgtctaacatgctcttgaatatattaaaaaaacacatttttcatattcaattagatatacagagaaaaatgttaatatgtaattttgatctttaaatgcagttatgtagaactagaaatggatattatctctttaaatgagacagcaagaataggtctgttgaccatgaataatttttgtcagttttgctaccccggcagatccttcattaagcgttcagcattaaattaaaatagaaccagtttccaatagtaattaacttgagtatattgggaggctattattcacattaaagtaaccttttaatagctctgcctttaacttcactgcaggtaatgactttaaagagcacttattaaaagagaaatggtaatgagctttaataaagcagaacaacttgaaaattaagaaccattttctatggaaaaggatgtataggtgtgacttcgatattacattaatggtgctaataattctttatctggtctcttaacattagcagtgattgcaaagggacaattgtgttgcaaaaattaattttgccattttgggttaaaattgtgctaatgtgaaattttctgtttcatgtttttttttcaaggactcttactactacgatagatgagttgcctacagtttgtaattttgaacccttattatgcaccccatctttaatgaaaataacttaaatgggctaacgtaggttgtcttggaccatcctggtagttcatacattagacacctgccttaggaggttatgaggtgattagtaaaatgtctatttttctcctgaaacctatccttctaaggacatcccagtggagatccattgctttctgatctctccattcccctcttaacctcttttggggaaggctgaatgcttcctgaatattccactttttaattggagctctaattgagttaaggcttgttcttaaatttaagacttgatatttcctggctacctatccagttgattgtcttgcaaaaacatgcttatttctgcttatattttcccagaaattttaagatgaagcaaaaatgaaacaacaatagtatagaattgtttgcctttcacattggagagagattaaactggaagcatttcccatgttggcaagaccaaaaattggcgaagttttctggagggtaatttggtgatatatatcaaaagcctaattatatatatgtccttagacttggaaaaaacacatctaaaaatgtattcttaggaattaatcagaaacgtatatacaaatgtattttcattgtgtattactgaaacactggaagcaacctcaatgcccaataatagaggattagttaaataaattatggcatagtatccacctaatgaatattacataatgattgaaacaatgacatctatgtcacttcttgatatagaaggatttgtataatatggtgaataaaaagattaaaaaatagcatgtataggccaggcgcagtggctcacacctgtcatcccagcattttaggaggctgaggcaggcggatcacctgaggtcaggagtttgagaccagcctggccaacatggtgaaaccccatctctaccaaaaatacaaaaatcagctggatgtggtggtgggtgcctgtagtctcagttactcgggaggctgaggcaagagaattgcttgaacccaggaggcagagtttgcagtaagccaagaatgcaccattgcactccagcctgggtgacagagtgagactccctccccccaaaaaaaaaacgctgggcgtggtggctcatgtcagtaatcccagcactttgggaggccaaggctggcagatcacctgaggtcaggagttcaagaccagcctgggcaacttggtgaaaccccgtctctactaaaaatacaaaaattagccagacgtggtggcaggtgcctgtaatcctagctactcgggaggctgaggcaggagaatcgcttgaacctgggaggaggaggttgcagtgagctgagattgcactgctgcactccagcctgggtgacagatcgagactccatcacaagaaaaaaaaaaggcatatatattatatttttgttaaaattgataccagtaggctggaggaggtccccaaatgctggtgggacctccaccccaacctgtgtccaggctcttgataccatcgtgagaatgaattcaaggatgaatcagaaaatagtgaaaatgtggagatttattgcaaagggaaaagcacacattaaagaaaatgcagcgtaggcatactcctgcatgtgcaaggggatttggggttgctacctttatgggtttctttaactgaggggtagattattcctgacaaaaggtgaagatttctcagaactgtgttaccacctatttttacaccaaatatgggtgttctcagaactgcctggtgctggtgggtgtgtgatttagtatgttaatgagcatataatgtggtcctagttgaaacctaggtcaaatccagctccatattgggtctagttggtcttagtcagctttgtccatactctgtttttcaggatcttaccagcccatagcctttagtcatgtgaaactgctgcctggaatttttattctcctgtgtccaccctatattattcctgtctgaaaataattatattcacatagaaaaaagtatgaaaggatgtacacaaaatgtaaagagattacttctgactttagttagcaatttaattttttttttctttttcttccttctttccttttttttttcttgagacagtcttactctgttgcccaggctggagtgcagggatgtgatcttggcttactacagccttgacttcctgggctcaagtgattctctcacctcagcctcccaagtagcttggaccataggtgcatgccaccacaccggcctaattttttaaattaactaattaatttgagacagagtctagctctgttgcccatgttggagtgcagtggcatgatcttggctcactgcaacctctgccacccaggttcaagtaattatcttctctcagcctcccgagtagcttggattacaggcatgcgccaccatgcctggctaatttttgtatttttagtagagatggggtttcaccatgttggtgaggctggtcttgatctcctgacctcaagtgagctgcctgcctcggtctcccaaagtgctgggattacaggtatgagccaccacgcctggcctatttttatagagacaagagcctcactatttccctaggctggtcttgaactcctggcctcaagtgaacctcctgccgtggcctcccaaagtcctgggattacaggtgtgagctgctgcacctgcatatttagcaatttttattccagtaacttttttttctccctaacatgaatgtattgctcctttaattgtcacaataataatgaaacagaagatgttcatgtgggaagttataagaaactcacccagttctgtttagagaaaaactgatgggctgtttttagataaagttgattctgctttttaaaacaatgaaatgtcattattaaaaaccagacatctgtcagaatctgtgagtgctgaaaaaaaatgtaaaaaccatacagtactcatacttgacatcttaaactatatagtaattatcttttcttgattaagaaaagccattgactacttgtttgatatttttattaatcatagattcagaaaattttgaatggctattatgtgtagagtataggcactaagggaaggaggggaaatgagaactctgtcctcaagattaacagatgaagataataatagtgtttactgttgaccaaatgcttgctatgagccaggcagcatgcatctaatctacacagcatctaatatacacagaaatatgatgtgtggattattatttctatgttgagatactgggtctgatagagattaaacaacttgcctaagatcacaccctgctatacggtagggccagctttgaatccagattatcttacttttggagtttatactatttcagaagaaccacatgtattaaaagaaatatttccacacattttatttgcttgtcaaatactgtatatgttagtagaatattagagtctctaaatttcccaacatgttgcataagaaaataatagcttcagctttttccagcttggttctagaagagtactcaactcagagaccagggttctgttacttaccatgtcacttgctttctaagtgtctttgacttagaagactttgactgcatcatcttacctttctgaggctaaattaactagtcagtaaaaagagtgagaatggatgaggtcatagccatcattagaattacatagtattatggtcattatgagacattgaggaatatttggagacttaagtgttcaggtttgctttatgagaatactgtaggcaaggtagatttttcattcatcaaacatttatttaatgtttgtcttgctcctggcagagtaagtggtctcgggggtgcattgatgcaagggtaatccctgtccctcaaggagccagttcagagtctgagataaacagaatgtggccgggcatggtggctcacgcctgtaatcccagcactttgggaggccgaggcgggcggatcacgaggtcagaagatcgagaccatcctggctaacacgatgaaaccctgtctctactaaaaatagaaaaaattagccgggcgtggtggcgggcacctgtagtcccagctactggggaggctgaggcaggagaatggcatgaactcaggaggcagagcttgcagtgagcagagatcgtgccactgcactccagcctgggtgacagagcgagactccgtctcaaaaaaaaagggataaacagaacgtgatgatctaaggacaggatgatttggaagtacaaaggagtcatgcctatactgaggtcttagtaggagaagttagcgagtactatgtccagctttgaagggtgaggagaacctggctggaatctttgactgagtttttcactgcctgccttgaggattctgcccccatgcgcctgtctgtgttcaagtatatctccccagaaggagaaataagcctctcactgccctcctcatcataaccttccatgcagctgtctgtccttcctagaaacctataaattctgattcaggtcttttgtattagaaaccagatactgtatctgctgccatgtaaacttctttctcctggaaaattcctaggtgttctcttaagagccaactcagacgtcacctcttctgtaacatttccttgcctcatctgagagtggcctcctcctctgtacttccacaacaatcgtctctttagagtacaaatttgtctcttcccgtgcctctctcccccacttccctgtgtacatagtgcccagcatagtgttcagtaggtattaggtgggacggagggagaatttaaacaattttaatgataacgaatataataatgacaacaagcatatattgagaattagctatgtgccaggcacaattctgagtgctttgcatgcattgattaattctcaaaacagccttgtgaggagagatgataacccccgcagtgagaggtgaaggagactgaggtatggggaagttaaacagcttgccttaggtcatacagctaagaagtggggagtctgcaatttgaacctaggcacagctccagatagtggttttttgtttgttttgttttgtcttgtttttttgagatggagtctctctgtgttgcccaggctggagtgcagtggtgcattctcggctccctgcagcctccgcctcctgggttcaagcagttctcctgcctcatgctccccagtagctgggactacaggcatgcaccaccacaccctgtgaatttttttgtagttttggtagagacgaggtttcaccatattggccaggctggtctcgaactcctggcttcaggtggtccgcccgtctcagcctcccaaagtgttcagatagagttcttaaatctctatatttgaagggctcccaaaggtcttccacttgttattgtgaggttaattctcagccagatttttaagtggctccatgttttcccgaaggggttggccccaaaggtggtgatcgttccttttgccctgaggttttcataaaatccttttgcaagtgaatatttgcagctgtagccatttgagagacaatgatgtgcttagggacagagtgcactattctcctgatgacagaatgctttatgtgctgcagtcttaaagggtgcaggccctgtttcctcaggcccgaatgattgagggacatgagtgagagtaagcaaattgcagtttaatcttgggcagatcgaggtaatttgtacagaatagtgtttagacttggctgggagaaaggatgttgcttgtagaaaaagcagaaaaatattaaagtgtattttgtgtgcaaaacaatgggtctttctgtgaaatcagtaatatccaggggattattttcaaagaaggattgtttccaaagtgagacttaagccagaattgactggagtacttttcttctatttcaccactctctccccacagtgtgtgtccctaaggtcagccagtgattccttctcagtgtctgtcagatttgacacttctcagattcaccagtcacactcttgtttcaggaccaaatcacagcccatttatattacaggagcaccttccaggctggtctctctgcttcatgtcccctctcttttggtttgtcctgttcattggtggccagattaaatactcccactgcccttccaaggtagcaaaactaaactcctccacttgacaatcagagccctttccctcagacactttccaattttaattcttattgttgagttcagttcaaccattaagtacccattaccagctgggcgtgggggctcagacctgtaatcccagcacttcaagaggccaagactggtagatcacctgaggtcaggagatcgagaccagcctggccaacatggtgaaacccgtctctaccaaaaacacaaaaattagccaggtgtggtggtgcatgcctgtaatcccagctacttgggaggctgaggcagtagaatcgtttgaacctgggaggcataggctgcagtgaactgagactgcgccactgcactccagcataggaaacagcgagattccgtctcagaacaaaaaataagtacccattacctacctaccttcctattgtgggtatgctactttaatacatcgtttctcatttaatccttgtaataggccagagatttttttattcttgttttctaaatgaggaaactaagaaacagagaggagaaaaccccacagaggaactggcctgtaggtgaaaaataattatttgtgaaatgaatgaataaaagcaagccattaagcaagtttacacagtacttaaatctgggtcagtctgattccaaatcttctgttatcctgagtcccagcgtggcctcacctcaactgttgtattacctgacagttctatgaccacaagtgatttctaattttttcatacatctggcccatttcctcatttttttttttagaaaacagggcaaaacccattctctttagcactttgatacttgaaccaccttttatctgctcattccttctgcgcttgtgcatcatttacattatactttttttatttttatttttattcatttatttttttgagacagagtcttgctctgtcactcaggctggagtgcagtggtgtgatctcagctcactgcatccttggcctcctgggttcaagtgattctcttgcctcagcctcccaagtagctgggattacaggtgtgcgccaccacatccggctaacttttgtatttttagtagagacagggtttcaccatgttggccaggctggtctcaaacttctggcctcaagtgatccacccacctcggcctcccaaaatgctgggattacaagcgtgagccaccgtgcctggccagtttgcaataaatttaattagatattgacttgtggcatttctaatcagatcatctgcatgtatgtatgtcttcttagctagacacgagatttttgggctaaggtgtgagtgtggtggattagggtaagacagggttgagtcctagctttgccacttattctctgtgtgaccatgagtaagaagttagcttctcttggaccctttgtcctctccctccagccttgctggtaggagtggtgcagatcacctggcagatcatatgtaagcaaatgctgctatagtcattggcacataacagatgaccaaggcatgtttgttgattcattttctcagttaattcatgctgttttagttgtgaatggtctggtagtagatacactggatgcacctgccctgtgttcattatttggtttagaattttctcctcaaggatggtgattgttctggcactattagattgactttctcagttcacatgttagagaatatgcagttatctggcaaaagccacagttacagagttgttaggtatggaggaattttgaattatctaatttgtctctattgtatcttgatatatatgcgttagctttttttcctatgtattttcaaaccagtacttcctagtgtttttaaagtgtttggtttcattttttgctttcagttttattttttttctcttctgtatattaatatgtccctttcaggataactttcatctgttctaggcaatgacacctgctattaggtgttttctgcctttggcttggtccacagttgtgctcatcttagaaccagcctccttttttctgttgttcagcagcagttccccagggttcactctgacacaaatcagtggtggaggaagacttgggaatagggaatgtggtctctgccctggagccgtgtgtcctttaggagaaggcacttcaaagcagcagctgttcccattacaccagccgcagctgataccaggagttcatacatgtcccaggttgaactgagctgctctagttgagccatatatgagttaacatgtctgttaacaatttctatttagtttaatttagtgaaaacttatcaaccccctactttctgggtcccatggatacagacatgaataaactgctacgcctgctttgaagtaacttgtagactggtaggtatgcaaatgacaataaagaagcattaagaaatttctgtataaagacttaccttaaaaatcagaatttcatgattgtatctctcttcaagccatagatgcaaaatcatctttacatcatttagcatgatttatagtgtaggtgtagttttgcattctgcttttttacctgcttttgtgttgagtttttcttgtttgtgtagaatgcaaatagtgtttagattacattcctttgggcagatatttcagttcactagtctctttctcagacagggctgcttcatgaacggtcttgtggcaaaaggtagggcgcattttagcaaatagtagagcagtgatctctgttggcaaaggtgccagatcagcctgaacatagggtggaaggcttttttcttgactttttaattgagcagcagctggggagctaagaaagaaaaagatggtttgggaaatggagagaactcactgatagttcatatctaggagctttaatttaatttgtagtattgggaaatgtttctaatcttctgaaaaggggcttgtgccacaaacgatgtttgaggtgaatgggtctgttctaagttctgactgttggtgtagacgtttaagagcatctggtaaatcagagggtaggattagcaggacttgaggactacctggccttaagggaacagtaggcttcacagtaggaaggctgacattgctggagaatagcgtgccatcgaataagtggaaaaagagtaaagattagtgcccaagagaatgagtccatcatgagactggttagctctatttgttgactaactggagaggagatgacatttccttccagtagattgagatggagaaaagcagaagactagccatcaaaagtgtggattactgtcccagcttctgttctttccttgttgtcattccttcacatgaactctttgagagtcttcacctgaaaaaaatggggacagtctcacctacttgatgcagttactttgaaggttaaatagaagatgctcgtgaaagtagtttaaaggctgcctactgttattctactgttttatattaagcattatgttttgagactttgactttccatctcccctctaaccctttatcaagcattgtctggatcatatgccaaggagaaatttaatccatacctaacttcaccagtactcagtttgcccacagaaaatgggttcgttaagctgtgtaaaatttttgctagttggaagggaagtgaaactataattgtttcagtgggattttttcctcccccaaaccttgtgaaaaatgtattcatgtgttttatgagactcccccacaagtctaatttgatgacaagaattgctgttattgctaaatttattacacgttcacctcttttccctgagtgactcattattgagtcctagaaatgcaactgtgtttttgtttaggaggaggttgtggtaagggagaacttagggatgacttttaaataagagaactttgtattatatttatctgtctggaggcaataaatctgtttcagcagattaaatacagacttctttataaagccttgttttctcaaacctcttatcagcagcacttggcagtaatcacacctacggaaacttgtaattttcctcaaggaggtgacactgacagaattaaaaatgaaggagcccccctgaaaagcaagttcattacaaattaacagtggtcttagcaaagcagtgggctaaggcgtgtcaaatagcgatatggataaagaaacccagcattttaaactgtcagagctgggagcaaggctagcctgagaacaaattaatcacatattgtcaaggcaaagttgcatcaaattaacacatcggattccagcatattaatgtcagaatgctttcacctgattattactgcaaaccattgccactctttgaatgcaaagatataattaaattgctaaatagaaagtgcatataatatctccacatgcatttaggatgcatgagctgaaaagtgcacatcctaggaagtgacagattctatttgtaggggagaaactttactttttttccccttttatttacttgagagtactagagtatgaaattagaaaagttagttatgttattcatattctatatgaattagatgaaatacaggtttaatttaactgatttgctacactgactatgagtacataattacctctgcatttttctggaagagaaatgggacaatgttgcaaaatagtactttgcatcaaaattgcccattacacataatcctggtggtggattcgtcatcagaaagtgcttaggagaaactagattggccattctgacaactgtcttttatgtaaggattactttctgtctcagcttaatctaatatgtgttctattatatttaaaataagaattcaggcagaagcccagctgtggttgaccttttggctcaaggaggcagcccagcaggaagaacttgctttttattagtccctgtttgtcccaggtgatacttgggccaggctttctgacttgctgtctttgttatccacaatcagccttgctgtccctgttactcacacttagatttggctactctccctgtgtcctctaccaagctctgttggcgctgtgcattgaaatcttccttaaatctcacttctttcatgaagtctccttcagcaactcacacttcatagacttctcttttcagctttgggattgagcggtcttgcatttacaacagctcacttagcagagctaaagggcttgtaaattcaaaaaagggaagtagtgattgctaggagccaccatgggtttcctcagaaccaagcagggcagaacaagcccatttctttcttggatagggttgttagctagatagagggctgtggttaaaattctttgttctgaatttcagtaaagcatcaatttttgcatagtattcttgcacgcaagctggagatattctccagtcacattgtggtcaggtggactttgcacctggctgagagacgaggcacagagtggtgattaatggatttatgtcaaactggagagctatctttcgtggcaagctgtaggtctcttgtgtgttcattgctgtcagggacctgaatgagaacattgatgataggctgatgacacttgtggaaggcagaaggctgggaagaatagcaggcatgtgcagtgacaaagtcagggactaaagtggtcttgacacaccaaaatgatacttgcacttaagtcataagatgcagtcatttgtgtatgggggtggcagtggaaaaggggaagaggaagatgaggtttaaccaagtagcacatgaaagaaaaggtttagggtcatggttaattgtaacctcagtatgattcagcagagccaggtagttagaaggaaaactcatgcattcatttctcaaatatttcttgagtgcctgtatgtgccagggacttgactaatgctgaggatacaatagtgaatgagatagtccctaatttaatggtatgtgtaatcttgtagggaagtcagacaattataatatagcataataaatgctatgagaggaaaagtttagtatggtgagtttcttcttttttttttttctttgagacggagtcttgctctgtcacccaggctggagtgcagtggcgtgatctcagctcactgcaggctcttcctcctgggttcaagtgattcttctgcctcagcctcccaggtagctgggactacaggcatgtgccaccatgcctggctaatttttttgtatttttagtagagatggagtttcaccatgttggccaggctggtcttgaactccttacctcaagggatctgcccgcctcggccttgcaaagtgctgggattacagacatgagccaccacgcctggcctagtatggtgagtttcttagaggaaggacacctggcctgggcttcgcatgggagaatatcagggaagactccttagatgacccctaagccaagccttgaaggatgggaggaggttaggcaggaggcttctaggtaggtgaagtgctggtgtaaacatctgaggtgagagatgctggtaaattctgggcaatgaaagtagtagggtatgactggaatgtggaggctgagagcagaggaggtgagagacgaggcttgatcaagaagagttttgatttgctcctgctagttgtatttggagcaggaaactgacatccttacgtctgaataaatcaccatggctgtggttagcaaaagtagggaatttagtgtggtgaggtatagtaagttctgtacaacagacatttacaactataagtgtctattcagacaagtgccacaaggaggtggtagagactaggaaccgggtggggcatatgagttgggctttacagaatccatccagagaagatgtgaacattgcctgaaaatagtagaagggttcttgggtagaagatgctctgcatggctctgccaggctggacagagcaaaggcagttgtcttcattcattttatgttgctataacaaaatgctggagactgagtagtttataaaacaaaaaggtttttatggttcacaattctgatggctggaaagttcgagattgggcatctgcacctggtgagggcctcaggctgcttttactcattaaggaaggcagatggggagctggggaatgcagagatcacatggtgagagaggaagaaggacacggggaggtatcaggctttttttttttttttgagacaggatctcactgtatcacctaggctggagtgcagtggtgtgatgacagcttgctgcagcttcagactcttgggctcaagcagtccttctgcctcagcctctcaggtagctgggaccacaggtgcatgccaccatgcccagctaatttttaaaaattattttttgtagagatggcgtctccctttgtttgttgcccaggctggtctcaaactcctgggctcaagtgatcaacccaacctctttttaataagcagctgtctctggaactaatagagtaagaactcacttctcagggaaggtattaatttattcatgagggatctgcctccatgatccaaacacctcccattaggccccatttccaacatttgggatcagatttcaacataaggtttgaagaggacaaacatccaaaccatagcagaggtgttaatcatctttccatgattaagggttcagtgttggctgtttgtgtcctaactccctagacttgcattgacataccagggctgctgcactgctttgggccaaagatttcctcatctgtaaaataataaaccatacaatatgtgaaggccagagatagtgttttacaaagcacctggtatggacttgtgctgagtaggaatctagccagttattgtagaatcgagttattggaggctgggcatggtggctgatgcctgtaatcccagaagtttgggcggctgagactggggaatcacttgagcccaggatttcaagaccagcctgggcaacatagggaggccctgtgtctgcaaaaagaaaaaaaaaagaaattagccaggtgtggtggcacgcgcctgttgtctcagctacttgggaggctgaggcaggaggatcggttgagccggggaagtcgaggctgcggtgagctgtgattatgccactgcactccagcctgggtgaccgagcgagagttcctggacccttgactgtctcagagattactagagttaggtgtcactgattcctggccttgactgttatgtttctactttgtaggggttctaaggccttagttgaccctaggctcagtgtcccctgcctctcagtgcacttccatcctacttccccacatagtttgtgagctgaagcatacaaactaattttgatattcatgtcatttaaatatgtttataaattgtgtgtttacaaaagccacatttattatactccaaggacatctaaaagtgacattttgtgttatacatggccttgtctgcttcgactagtataggtgtttgggagtgaaccatgcctgcatttccgtgtcttcttttcttttttatttttcagttaaaattgtcaaaaaaacacataaaatttaccatcttaaccaatgttaagtgttcaatatggtagtaactatatgtacgttgctgtcaacagacctctcaaacttcagtcttgcaaaactgaaactttatgtccattgaacaacttcccttttcctcttgcccccagccctggcagctacttttttactttgtttccaaaagtttgaatgctttagatccctcataagatatatggtagtaatactggaatcatgcagtatttgtctttttctgactggcttatttcacttagcatcatgtcctcaaggttcatccatgttgtagcataggacaggatttccttcttttcaaaagctgaataatgttccattgtatatacacaccacattctctttatccattcatctttttatggacatttaggttttcacttcttggctattgtgaataatggtgtgctgaacatggaagtacaaatatctcttttcagtacaaatatctgttttcagttcttttgcgtgtatacccagaagtgggattactgaaattatatgcaatttgtaattttttgaggaacctcacattgctttccatcgtggttgcattattttacatttctaccaacagtgcacaggcttccactttttccacatcctttgcaacactttttattttctggtgtgtgtgtgtgtgtgtgtgtgtgtgtgtgtgtgtgttttgacagtgaccatcctaacaggtgtaagtatggtacctcgttgtggtttcaattcgtgtttctctaatattagtgatgttgagcatcttctcatatgcttgttgtccatttttacatctatgcaagtcctttgcccattttaaattgtttttgttgttgttgttcttgttgttgttgttgttgttgagttgtagagttcattatatattctggttagatacatgacccctgattagatgtatggtttgcaaatattttgtcctgttgcataggttgcctttttactctgttgttttctttgctgcacagaagtttttgagtttgatatagtcccatttgtctgtttttgctttgattacccatgcttttggtgtcatattccaagaaatcattgttacatccaacgtcatgaagttttctcccttgatttcttctagaggttttatagtttcaggtcttacattaagcctttaatccattttgagtcaatttttgtctgtggtgtaaggattcaccttcgttcttttgtatgtggatatccatacaaaagaatccatacaattcattttcccaatgccatttgctgaagagacattttcttgtcttaagtgacttataatgagaacacttttcacaggtgtaaaagtgacatttagagtgtatcctttatgtggctcttgatgatctgcatagtgaagcattttatttaaagtgccccttttcccaccttgtcacctgccctgtcttcttgcccattccatcttgcccattccattttctgtcatatcttgtgggttgtgtgtggtgttcttctgcctgaaatgtcttcctctatagtgaattgctgtttatcctttaagattcagctcacacatggcctcctctgcctcctacaagttcactaccacaagcagtccttatgacactccattgtagttatatatttatatgtcctttgctctcatagaatgtaagctgtgtgtggacagggcaatgtccagtttatctttctaacaccagcaactccacagaccctaacattcagtagtcactttgcacaattaaatgaagtggccgcctttgtcgtagagaattataaaatggtacaaggcaggatgcttcagtttgtatgtaactaaccaagcttctgtctcctcatttctaaaattaggaagtgaattagttctctgaggtctcttctggctccaacagcctatgaaaacagtgggaattcttacctgaatgctttcagagcttcgttcccacatatcccacaagatctaccgtaaagtaggataaaatcgtaactttttggagggtgagatggggtggggtttaaggaattatgccattcaagagtcagatgaaaagctgggcacagtggcacacacctgtagtcccagctactcgagaggttgaggcaacatagtgagatactgtctcttaaaaaaaataaaaaagagttaggtgaagtgtgctggcagggccttcctaatgtgttccggttccagtggttccctttctcagtgcaggccaggtgttcccatcccactctctctgccttcactattcccatctctaaaactggaaagattagagagggtcttcactttatatggttcactatatgtgtgtttaagggggcaatgaatgtatttttaaaaaatattttaacattgggaaatgaaaaattaatttttacataaaaactttaaagccttaaaaaactggctattggaaatgtgcccaagatagaggcatttgaatggcagtggggagggtgtgtatcatctttggggtagtgtgaaattttttaagttatcagaaggcgtcatggattacaggtagtcatgaaacattgcagtagtttctgttctaattttctgtgattttatattgatgacaatttcacagaaggcttcagtgggatgagtcctactcattgttacatatgaattgcacctacagttttgttggcttgtttgattttttaaattgaatcctgactccaccacttactagctgtgtggtgaaaaaaataagtgataagaaaatcacttttctctaaaccttagttttctcatctgtgaaaaggatatgatgatagtatcttcttttataagattgtactgataattaaattagatacataagcctcttgcatagtggctgacacatcataaatcttctatatatgttagtaattattgttaagtattttggacatgaatattaatcacacctctctgatctgactttggaaccttgagagttagatgaataaatcagaaaaatggaattaaatgtatctactttattattggtaaatctggttaggatgtgcagccctaatcaggcttccttaattccttctccactgagtctggaccagcactctccagtagaactttctatgatgacggaaatcctctgtgtctgcgctgatcagtgtggtagttactggccacatgtggctgttgagtacttgaaatgtggccagtgtggtgatggaattgtgtttttaatcttatttaatttaaatttaaatagccaaatgtggctagtggctgttggacagtgtaggtctaaacattggcatgactcacccaacaagagattggatctgcataggagacaagcttactagaattgctgtctcatacccttctgtgccagtaatggggtcagagggagctagagcccccagacctgtttccagaaggctagccagggccctgaccccaacatgctgaacacacagaagcagttgctgagcaggcacttttgagagagcctggaacaggtgaggccatgccaggtaaaaagagaagtgttctttccagtatttctgaaagtgtaaaaagacctattttatgactaaagctcagaagcctggtagagcagttttccttacctagttcccttacaattctatagaatagatagaatagttcctcttacacttaacagtgactacaggttgtacaaagcattttcttaaaaataaaatgtagacgttcagtccttaatgatatggactttttatattttgcttcatactacaccttaagtatgacttcagtagttttttcttatgtgctttcttgccatataattggacaatccaaatgtagcctatttttcagacagaagaaggattaaaacttgaaactaaaaataaaacgttttgtaagcttttgctgtgaattcagtctgacctcagttttttgtttttttattgtttgtttgtttgtttttgagatggagtctcactctgtcacacaggctggaatacagtggtgcaatctcggctcactgcaacctctgtctcccaggttcaagtgattcttgtgcctcagtctcccaagtaactggcattacaggcacacaccaccacgccaggctaatttttgtatttttagtagagatggggtttcaccatgttggccaggctagtctcgaaatcctgacctcaagtgatccgcctgccttgtcctcccaaaatgctgggattacaggcgtgagctgccacacccagcagtcctacctcagttttattgaacatggcttttgttaagcttataaaaagccagctgctgctctgcagggttggtttgttttgttttgtttttttgttttttgtttttccctcaataattgtgtagtttcatggcgtggaatgttctgttgtccaccagcaactgagtgaattagaaatgacagtattttggaatcaaaattttacattttggaatgtaaattctctcccttgtttttttttttttttttttttttttatttatttattttttttttattgataattcttgggtgtttctcacagagggggatttggcagggtcatgggacaatagtggagggaaggtcagcagataaacaagtgaacaaaggtctctggttttcctaggcagaggaccctgcggccttccgcagcgtttgtgtccctgggtacttgagattagggagtggtgatgactcttaacgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaggaatttttcttagtgcagaacaaaatgaaaagtctcccatgtctacttccttccacacagacacggcaaccatccgatctctcaatcttttccccacctttcccgcctttctattccacaaagccgccattgtcatcctggcccgttctcaatgagctattgggcacacctcccagacggggtggtggccgggcagaggggctcctcacttcccagtaggggcggccgggcagaggcgcccctcacctcccggacggggcggctggccgggcaggggggctgacccccccccccacctccctcccggacggggcggctggccgggcggggggctgaaccccccacctccctcccggacagggcggctggctgggcagaggggctcctcacttcccagtaggggcggccgggcagaggcgccccttacctcccggacggggcggctggccgggcgtgggggctgaccccccccacctccctcccggacggggcggctggccgggatgggggccgacccccccacctccctcccggatggggcggctggccgggcggggggccgacccccccacctccttcccggacggggcggctggccgggcagaggggctcctcacttcccagtaggggcggccgggcagaggcgcccctcacctcccagacggggcggctggccgggcggagggctgacccccccacctccctcccagacagggcggctggccgggcggggggctgacgcccccacctccctcccggatggggcggctggccgggcagaggggctcctcacttcccagtaggggcggccgggcagaggcgcccctcacctcccagacggggcggctggccagggggagggctgacccccccacctccctcccagacggggcggctggccaggcggggggctgacccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggcacggctggccgggcgggggggctgaccccccacctccctcccggatggggcggctggccgggcggggggctgaccccccccccacctccctcccggacggggtggctgctgggcagagacgctcctcacttcccagatggggtggctgctgggcagagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggtggccgggcggagacgctcctcactttccagactgggcagccaggcagaggggctcctcacatcccagacgatgggcggccaggcagagacactcctcacttcccagatggggtggcggccgggcagaggctgcaatctcggcactttgggaggccaaggcaggcggctgggaggtgtaggttgtcgtgagccgagatcatgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccaatcaggtgtggcggcgcgtgcctgcaatcgcaggcattcggcagactgaggcaggagaatcaggcagggaggttgcagtgagccgagatggcagcagtacagtccagcttcggctccgcatgagagggagactggggagacggagaggggagaggggagaggggagaggggagagcctctcccttgctttttaatttttagttgacatgtaataattgtacatattgggccaggtgtagtggctcatgcctgtaatcccagcactttgggaggccaagatgggcagatcacgaggttaggagattgagaccagcctggccaacgtggtgaaaccctttctctactaaaaatacaaaaattagccaggcatggtggtgcccgcctgcaatcctagctactcaggaggctgaggcaggagaattgcttgaatccggggggcagaggttgcagtgagccgagatcacgccactgcactccagcctgggcaacagagtgagactctgtctcaggaaaaaataaaataaaatataaaataaaagaataataattgtacatatttatgggggtacatagtgatattttgatatgtgtatgcaatgcataatgatcaaatcagagaaattcaaatatcacaaacatcatttctgtgtcctgaacattcataatcctttttttatctttttgaaaatatgcaacaatgtaacaatgttgacatttatgcaataaattataattaaccacttaccctacagtgctgcagaacaccagagctcattcctcctatctagctataattttgtactcatgaaccagcctctccccatctccccatacttctcccagcctccaatacccacaattctactctccacttccatgagccccagtttttttaagctcccacatatgagtgagaacatgtggtatttatctttcagtgcctgacttctctctctcaacataatgtcctccagactcatccatgttgccagtgatgatgacaggcttccattcttttatatgacaatagtattccattgtgtatgtataccacattttccttatctgttcatctgttggttccacttcttactctccttcttttaaaaataaacaatggttgcacttctaaacttttcagttgatacccttttgcatcaaatatgttcaaattattaaatagtagccttaagaacccatgtatagttatggggtataagaagttgttttaatgaccatggaatttgtatagtgaggatattgcatatctaaagcagccttcagttaggtagaggctgttaatctaaacatacacatttgaattaaagcatctttgttaacttcttatctgactttattgttatttttggttcagttgattgaaacatccttgaaaagagcttggaatagtaaagcattaattaagcatttactgtgtgtttggcattgtgctaagtattttatatacattatctcatttaatcctcatatgaacttctgagataggtagtattgctggtttacagatatggaaaattctctgtacctgttttctcacttttaggctagggttagtaataatattactaacttgattgtgttgatgagaattaaatgagatagtacatgtccaccatgaagtaagcactcaataaatgatagcacttttgtggtttgtttttgtttttgttttttttttgagaaagtgtcttgctttggctcccaggctggagtgcagtggcatgatcacggctcactgcagcctcaacctcacaggctcaagtgatcctcctgccctagtctctggagtagctgggactacaggcacatgccaccacacctggctaatttttgcatttttggtagagacggggccttaccatattgcccaggctggtcccaaactcctgcgctcaaccagtctgcccacctcagcctcccaaagtactgggattaaaggcatcagccaccgcatctggcctgatggcactgttgttattcttatcttattatttaatttcatgtgttaaataggtgatacatttgtatggttcaaaaatgtaaaaggtaaacatgtctcactccctcctgtccaccattcatgtcgtccctacccatacccactttactaggttgtatatcttctagtgtccatatgaaaatatacttatttttctccccttttacacaacatgtagcatattgttaacacttttctcgagcttgcttttttcatgtaacaatgtgattggaaatctgtctctgttagtgccagagaatttctcatcccttcatatagctgcatagtattccattgtttggaaatactgtaatttatgtaactaattctctgtcggtgaagacttgacttgtttctaatcttttactattacaaacaacgctgtggtgaataatcttgtacatatggcattttgtgcatgtgcgattatatgtgtaggataaatttcaagcagaattgctgggtcaaagggaatatgcatttgtaatttttgtaagtattgccaaattgtctccttcgggattgctccaattacactcctaccagcaatgtaagacactgcctgtttctccatagccttgccacagaagttgtcagatgtttggatttttgccagtctaatcaataaaaaatgaatctgtataattttttttttcgctctgtcatccaggctggagtgcagtggtgcgatctcagctcacttaacctccacctcctgggttcaagtgattctcctgcctcagccttcagagtagctgggattacaggtgtgccccaccacacccagataatttttgcatttttagtagaggcgaggtttcaccatgttggccaggctggtctccaactcctgacctcaggtgatctgcccaccttggtctcccaaagtgttgggattacaggcgtgagccgttgcacccggcccaaatctgtataattttaaattacgtttctcttattagtaagattgggcttctttttatttaagaatcttgacaggggtattgttaactgctcagatgtgttggattcttgaactttttcttattttctaagatttttttaaaaatatattgagattagcctagtttattatgtatcttgactttgttcatggagtttttttgtttgactatgcactaattttttttttattgtagcgaaatatacattttttgcctctatagcttctggattttgaattaatcaatgtggagaaattttttttcaaatgtcttgcatagttttacattttcttcctaggtatttgtagttgcagttgtaaataaggtcttattttctgctatgttcgtatatatgaaggttcctgatttctctctgttaattttgtattcctttatgttaccaaattctatgtagtagtttttcatttgttcttttaggattttcacacatataagaatattgttaatttgcaataatatacagaataaaacgcagttttttttttttttaaatggagtcttgctctttcgcccaggccggagtgaagtggcatgatcttagctcactgtaacctccgcctcccgggttcaagctattctccaaaatgcagatttttgtaaacctctttgatttccattttgtatacctgtgactttctcttttccgatgttattgctgttgtttatgttatcgctgccaccaccatagtacttgtcattaagctaaaagttggcattaggggaatgttaactccctctttaaattgcaagatgtaaatatctctaaaatgtgactagcccatgtttatactaagcagaagatagtaagacagttttttgtttttgtgtttttgagatagggtcttactctgttgcccaggatggggtgcagtggcatgaccaaggctcactatagccttgaccttctgggctcaaacaatcttcccacctcagcctcctgactacctgggacagaaggcatgcaccaccacatccagctaatttaaaaaaatttttgtagagatagggttttatcatgttgtccaggctgatctcaaacttctgggctcaaggcattctcttgccttggcctcctgaagtgctgatattccaggcatgagccaccatgcccagcctaagacaaattttcataagtaagaataaaggtgcgggggtggatgaaaatgtctttgaattcttctaagtgaccctttactgcattgcttatgagaatctatattaaatagctgtttgtttgttgttgttttatcataattgaaaaacatatttgaggtgtatacacgccactgcacatatcaaacaaatttgagtgactataggtcttttctgtctttgaaatcacttggtattcttttttcttccattctgaaaaataattagtgctttacaatacaccatcagattatatatttgtgttttagtaataatcttgcattttactaaatatagaccaacatttgaattagcaactgaagttagaacttgaattaagcttagtaggagtttgagattttattttcctgctttcttttccttgattcattgtagtcccataatgggtaatgggttgtctttaacattcagcctattgccttttttttttttttttttttttttttttttgagacggagcctcactctgtcacccaggctggagtgcagtggcgcaatctcagctcactgcaacctcacccttccaggttcaagcgattgtcctgcctcagcctctctagtagctgggactacaggtgcgtgccaccacacccagctaatttttgtgtttttattagagatggggtttcactatgtaggccacgctggtctcgaactcctgacctcaggcgatcctccctaagttcttaaaggaagttgttggttgcttgggagtaattgggtgcttttcctctcacatatgctggaaaagttatgaagcttctcatgagtgaattagagaaatgggttcatttgtaaatatttttgttttaaattagaaaaaattaaatactgagtagacatagaagatttttaaagtatctccaaggtataaacagttgtataatagtcactcatgtacctatcacccgttttgggaggaagaatattacttttatttttgaagtcccctccgtgtcctccttgctccctgaccactcacagatgtgtctttaattcccttgcttttccttatagctttatcctgtatatttgtatctctgaacaatatttttttaactttatgtaaataaaattgtactttaagtgttcttctgtaactttttcctcttaacattacgtcccatagattcacccatattgatgtctgtagctgtagttaattcattttcattgtatgggtactctgcagtttagccattccactgttgatggacatttcagttgcttccagttattgctattacaaataatgctgtttataagtattttaaatgtgtaagaattaccccttggcagagacttacagacttttaaaaagatttattttattttgagatagggtctctgttgcccaggctggagtgcagtggcatgatcatggctcactgtggcttaggtctcccaggctcaagcaatctttccaactcagtctcagtagtagctaggacgctaggcacttgccaccacgcctggctaattaaaaaaaaattttgtagcaacaggatctccttttgttgcctccgctggtctcagattccaaggcttaagcgatccttctgtctcatcctctcaagttctgagattacaggcatgtgccattgtgcccgatctacaaacattttggccatgaatcatatgtaataagaaatacattttggggtataacatgaaagttttgatctatgcatacattgtggaatgattacattaatttaattaaaatatctgtcacttcacacacacacaaatagaaacacataacatgcatattaagtgcacatatagataaatgatatatggaaactattttcatagaaaaatacttaacctttactaagtacaaatgcatgctattttttattctaatcaattctattttatttaattttaaaagaaaagattggttgaaattggctaaattgatttcctagccctcaggaccatggtttgaaaactttgttagggaatacatgcagatggacttacagggtcatgggatctatgtgcagcttcagcttatagataatgccaaactgtcttacaaagtggttattcccatgtgtgcccctccagcagtgcgtcagtgttgtgctcccacatcagacttagttttttctagtcttatgggtgtgaaattgtatctcattatgattttcatttgcatttctcagaatataattgaaattgaacatctttttgtgtgtttattggttattcatgtttcctcttctgtgtgaactacttgttctaatcttttttctattttaatcaatttcttcctgatttgaagaagaaatttgaatgtatgtttggatactaaccatttttatgtattgggtagcaactgttgtagattctcctggtttgtgacttgtcttcattctctttttggtgctttttaatgaacagaaattcttgtttttaatgtattgaattatcagtcttttgcttcattattgctttttgtgttctaagaaatctttaccctcaagattataaagttattttcccaaattgtatttaaagtttttatagttaaataattaatccatctggaactgattttttgcatgtgtggtagtgaggtagaggtctgatttctgtttttttctgtgtggttaatcagttgttgtggcattatttattgagtcccacctttccccattggtttgtcatgctcgcttggtcatatatcaaatttccctatgtttgtgctgctcttcctggacttttctgtttcaattgtttatttggtttttcctgtgctaatatcacactattttaattactttaaatgtaaagcaatttctggtaactgataaatcatgctccttcaacctccttttctcttttcttttcttttttttttttttctgagacggagtcccactctgttgcccaggctggagtgcagcagcgtgatcttggctcactgcaacatccgcctctgcaacatcaagtgattctcgtgcctcagcctcctgagtagctgggattacaggcatgcaccactacacctggctaatttttgtatttttagtagagatggggtttcgccatgttggccaggctgatcttgaactcctgacctcaagttatccactcaccttggcctcccagagtgctgggattacagacatgaaccactgtgccaggcctcaacctcctttttgttatttgtgagtgtcttgtatattcttaacctattgccctgctacacaatggctgatttttttttttttttttttttgtatttttagtagaggtggggttttgccatgttggccaggctggtcttgaactcctgacctcaggtgatccacccacctcggccttccaaagtgctgggattacaggtgtgaaccaccatgcccagccccttccatatatacatttttaaaatcacttgtcaagttaaaaaaaattcctgagattttgattagagttggattaaatttgtagatcaatttgggagaattggcatctttaccattttgaacatgatatatcatttaagtgacctataatatctttagtaaaattttatcattttctccatggaagtcatatatatatatagtttgtcattgttgttagattgattcacatatacctattattaaatatatttttaaattctactttcaagattttatttaaattatagtgtcttccggtttgttgctggtatatagaaatgtagttgatttctttgacattgatttaatgtcagtaaccttaataaactcctataacttccattaacttataccttttttggttttctgtgtagttggtcatttgcaaataatgatagttttatttctaatccttatactttatttttcttgctttacagagctgaaaatttaaaaaattctttttattgcttcacaataccatgttgaaaagaaattgtcttgcttctgatatcaaaggaaatgtttccaatatttcaccatttaggatatttcctattttagcagatgttctatgttgggttaataaaagtcctttctgttcctagttagctacaataattattactttttaaatcatgtacattcaactgtactgaatgttgaatatactgaatttacctatactaccatatgatttttctccttaatctcttaatatgattattattattattatattttgagacggagtctcactctgttgctcaaagctggagtgcaatggcgcgatcttggctcactgcaacctccacttccagggttcaagtgattctccctgccctagcctcccaagtagctgggattacaggcgcctgctaccacacccggctaagttttgtgtttttagtggagacagggtttcaccatgttggccaggctggtctcgaactcctgacctcaggtgatctgcccaccttgggctcccaaagtgctgggattacaagtatgagccatcacgcctagctttaatatgattattatattgatttatcatcttatgttaaaccaacctagtatttgatacaataaactcagctttggtcatcaaatattctagtttttatatcttgctgggttggtttgctaatatttatttaggatctttgttcacaagtaaacctggcctgtaagattattctcttacactctcaggtttggatatggaggtttttctaaccttataaagtgatttagaaattgctcttttttggccgggcctggtggctcacgcctgtaatcccagcactttgggaggccgaggcgggtggatcacgaggtcaggagatcaagaccatcctggctaacatggtgaaaccccgtctctattaaaaaatacaaaaaattagccgagcgtggtggcgggcgcctgtagtcccagctactggggaggatgaggcaggagaatggcgtgaacctgggaggcggagcttgcagtgagctgagatcgcgccactgcactccagcttgggtgacagagcgagactccgtcttaaaaaaaaaaaaaagaaattgctctttttcagtaaggttaaatagtatgggtaattctagcattatctgttctttgaatgtttggcggaacctgctaataaaagtaaactattgttgtcacaggttgggttctcctgggaagcagtctctgaaatggagattaacatgcaggaaatgtattagggagtgttttctggattagcatctgtgtggaaaagggaggaaaacagaattgggtagagggaggagttgggactgtgatgcagtcgtaacaaggcctcacctgacaccatggagtactctgcagctggatggaccttcacagttgtcccaagttagggtaagggggtcaggcctcttacattcttgcatctaacctatcattggattctgagtgtcgtgagaaggaggtgcagtcttggcaaggtgactctgtcagccagcacaattgcaggaaaggactaacagctgatagccatcagccagcattccttccagcagttgggaaatatgcgctttattcctgaaaagagggaatctgggtggtacagtccacccttggtgctgcttgggtttactggcttcatgttaagttctgggagcacaccttcaggtctgcgttggacttcgtttctttggggaaatttatacaaagagggttagtataatgatctacagtcctgtttctaccactggtcttgaggtcatgactaacactcatctgtctcttcaagtatttattctagtcctgtcaaccttggttagttagcatcttggctggtctaggtcttaaatggtatgatgacccagatccttatgtctgagggcccaagcctctgtttacctttctcaggatgtagctgcttcatttgtccattaaccactaaaattgggtaaaagtaataagataccccaatggatttactggctagatgtgtttcttcctgcctccattgtgtaacagcctcatgttcttttgatgagtgtcagtcactcctgtgaggatggtgactttccttcttgcctgatgtcccttggcatgaggaacctgggctgcagccatagttttaacatttagtggtacttctgctgtgtctcccagtggaagtgttctccctttgggaatcaggatctcttaattgatagagcctctatttacccaacagaattaaaaacataagttcattcacataaagatttgtacatgaatgctggcctgttcaaaaacactgcaggacagatggcttcagaaagaatagggaatcaggaaatagacagtgcgtttaggaactcagtttattgtggttctacaacaactgattgttagtagataagtttaatttccaatcttactccacatgccgccccccattaaagagctaacataaaaattttaaatttaaaaaaaaactaaaagaatttgtacagaagctgtgacactaccagttatttgaaattcgttgagcatggctgtatgcccattaatataggtcaccttttataaatattatatgtgaacttggaaagaatgtgattttagctgctgttggttgcaatattctaaatattgtcattaggtcaagactgttacaggttgagcattcttactctgaaaatctgaagtttaaaatgctccaaaatctaaaactttttgagcgcttataagtaactcatgtatcaaaaaataacagaaatcagaaaatatttagaaacaagcatttcctttggagcatgatcaaaggaaatgctcattggagcatattacattttggatttttggattagggttactcaaccaataagtatagtgtaaatatttcagaatcttaaatatgaaacactcctggtcccaataattttgaataggggatactcaatctgtaaatctgttaaaattttctttacagatatttttgtccaagccatcagttagacagaaatacgcttgaatttcctgctgttgatagactgtccattttttcttgttaattgtgactattttttctttgtatattgtgatgttatgcttttatgttcacacaatttcagaattgctattttttcctggtgaattgaaccatttgtcatttgtgattaactctagtgaagttttcctccctttcaaatagttacacctgctccatttggttgatatttgtctggtatagatgcaatttcattttgatgttttaagatacagatcttctttcctatttttcttcttttgcattcattgggctttctgaatctgcatattagtgtctttcatcattctggaaaattctcagccactgtcttttcagacattgcctccgaaccagttattcttttctcttcttctgaaactctagctacacctatcagaatgtgttattttatccttctcatctcttaatttctctttcttatttcctatctctgtgtctctttgggttgcattctaggtaatttcttcaactcatatcttcctaacagattctctcctcagctgtggaacccatatgttgcatttccaattttagttgttgtatttttaatttctagaagtctgattttgatcttgtaaaaatctgcttggtaatttaaaaaactattacgaaaagtgtagtaattttattagtaaaagttcagtgagcacccttatgtgtagcacctgtattcagtaattgttaacattttgtcatatttgctttatttatgctttatttaatctttaaaagttgacattcactcctagcgacattctcctactcaaccataatatatcacaccttggataatcttttatagtctcttgcacttactccacatttttgcttacacatttattttatattttgcttctgatcatactgttaactccagtctttctgggcctatttcatgatgccttctatgttttgtgatttggagatagaacaaattatttcttgcaaatttttctgttggaattatttgagtcatttaggtttttcccaataggatctgcgtttgcttctacctagaacctgggggcactaccacctcaggaccactttaaattcttggcttaaaatctttctggtccatcaaataatacgaatttgggatagaaatttcatatgaaggttcgtttatgtttataaagtctgaggaagaaaataattttgggggaagacaggcagttttaccttgctggaggtcagtcgggaaaccttaattctaatttactctcacatgtaggtctttggtggtggtgggttgtgaggagggtatcacggtcttattataggttatagatagactgttccctatagcctgctgaccaagaaaactgacacttcatgtcaccttgtttggcaagtaccatcattaaggcaaaattatgttctgtttttcattctagattctcttttcacttagtctttgtgcttttgtgattgccttaaaaagttgccaaccagtgtattgagtcagataaaatagctctttttatatttcataaatatgtttaactgttttctgtttgagggttggtcaggatacatactttgccatatggttgaaatacaagtcctatagtaaaatagtttttagtgtgttgtattaaatgctgtgggagaggaatatatattacagaatgaagagaaagagtttgtgtttacacatatcatggctctttatttcatgcaaatgttgattcaaaatgtaagaagatgttttttcaaataagaactttccctccaaaaaagcttttcaaatatattggttttgggaagaattgttgtcaagttaagattgtggtcttttgagtcagtcagaggcgggtttccatctgagttatcttactggctgtgtgacctttaacaatttctttcacctcttagcagtttatctgtaaaatagggtaagtgggggctgttttgaagatcaaaagagagaatttatgtggcacactcagcccagtgccaggcacagagtaaatggtagccatttttaattttagttattctctttccagaaatgttcaagatgctgttaatagagtgttaaatgtgaaacatctcacattgtacatggagtagtgtaaaattgaatgtgggtttgggagaaactaccaaaactaccaaaaagagaaaaacgagaaaggcactcagggtcagaaaatgaggaaaacaggatgaagcttggcaggccaggcccggtgacaagtgcctgagttagctattcaggaggcagaggcaaggggatcacttgagctcgggagttcaagaccaacctgggcaacatagtgagactctttcttaaagacaaataaacaacatactctttcttaaaaacaaacaaacaaacaaataaataaagaagcttggcaggtgaaacaaagccagaggctgtctgcttcccttagcattccgagagtgggatttcttaaggattttttctgttccagctcttttttgtatatgtcctgttcatttagttgagcatatatatccctacccctttgggtcaaaggaagttcccacttgctgtggttcaagggagctgctttgggtactttaggggaaggaaacttgttcccttctatagagacctcaaagataggaattttcattcccatcagttcagcaagtaaccattttgcatccccagaattctggaagtacctaattaaaaaatgacacagttgcatttttaatagacaaatttacaattaacaggaatttaaaaatatataacatgaaacatcagcatgtttcaggtagtataagcatttaggtttttttctctccctcttgatatgactcagtctaattcttgtgtatcttcttagttaggctccactgtagggcagtattggaaataagagggaattgtgtaacccacctccatctaaccttttgctctctatttttttgcatgcccaaagacaggagaagtatgtcttattcatcatctttgtatatttctcttggtactaatattgtcattttggttttttagtaaaggaaattggcttatttgaaacgtttgatttaatcctctgtggaaatagcggtttactggaaggttaaggcagccggtttgggctcctctcagagtctctgtgcaattgttggaaaggaaaccccagggaaacccctgagcgcaggcgtcggaaaagcagtggctgcgcagaagacaaaacactccagatgctttatcaggtgctgtctggagagcaggaataatggtctgaaggcggaaatgctgatgtctccactttcccaacttagtacaaatatcttctttatctttggtggattttggtgccacagcggcggccccaagaagccctaaatgcaaatgtgatggcttttagaattttggctttgaaagcctggcatttgggggttttcttgacttgaattctctttttaaagggagtggattcagagcatccactgtcagtgccatttcccttgctatgatggcttgttcactgtttacatcaaaggattcaggaagcaagagatgtgaacataaataaataaatgatcagactaacaaataaataaaaagctttgcttcctttgtcacattgtgaaaaggcttgactgtaacataatgggaacacagcagctatttgattaaaacttcaggacttttctggaaacttcgaagcatgtctgctactattctttttttctttttctaataacactatgacatggggtaagtagaaccctagagtgccatggttgcagtgggactgttggatgcatcatcctcccagtcactacaggcgctggcgtgacataccctccctgctggtgcctgtctgcccattgacatggccatccttcggaagcccacaagttgatttgtaacttgtttgctctttgcccccatacagtcttattaaaagcaaagtcactttgggaggccaaggcaggcagatcacaaggtcaagagatcaagcccatcctggccaacatggtgaaaccccgtctctactaaaaatacaaaaattagctgggtgtggtggcacatgcctgtagtcccagctacttgggaggctgaggcaggagaatcgcttgaacccgggaggcggaggttgcagtgagccgagatcgtgccactgcactccagcctggtgacagagcaagacactgtctcaaaaaatatataataaataaataaaaaataaaagcaaagtaagcgactttgcagtggggaaggcaattttaagtgatgagtaagaactcagactctggagttagacatccccagttagcatcctcgcttcactagctgtgtaactttgggcatgttgcttcatttctgcaagcttccatttcaactctaaaatagaaataattgttgaatctaactcagagttgtttgagattacataagctaatatggatgtcaaatgtatggggtgatatctgacctatagtgtttgataaatattagctgctgtagtgttggaatgaagagccagtctttgaaaaacaccctttatatcttgcttgtcttcctttgataggagtgtagttcattttatttttgagaattctcagttatttctccagcccatgatatttattgtttcagtcgctataatatttgttgaaaccctatgaaattgcaatttttgtaggtcataagtgattatcagcagtttcatatgattcagtttaatgtaatagaaactattggagtgtttgctgtatgccagagtatctactatgccatttcattcattctttcaagcttccctttaaagtatgtaatattattccagttttggcatggggaaactgaggcttagaaagatgaacagacttgcctgaggttacacaactagtaagtagtgaagctggaattcagacctaggtctctccaatccaaagcgcatttatttgctttccactttctacccatgagccgtctcagacataccctcccctagctccatgcccctagctccatgaaagtcagagaaactacactgtttcttctcgattgtagaagattcgggttttcttcagtagggtgaacataatgtggctgtcctgtgttgatgaaccttttgtgcttttgtctctccttttcgcatcaagagcacagcatctgcagtgttggctacaatcaccttggctctttcagaaaggcatgtagagaatgaaaacaaagaacctagactctgccttcaacccagttttcattgtctggtgcagtttctcatggccataatatttgagcatctgctctattcagggaatgtgcgaggacagtatctcagtttccctataatattgaagataggggctaaaatcctttataggggaggaaactgagggtaaatgggatcacatgacttagagaaaggcacaatacctgtcagagtcaatcttgcttaagggtctaggtcttttctactataccccatttcttcttcccattcatagaaatcttaaagaagggatatgaggacagccctttctgcagaataatttagagcatattttggtatgttatccctgctgaatttttcccatatactcttttcctttttctttaacccttttcttttccttctttcttccccccgcctccctatgcccttcttccctccctgccttcctctaaacataatgaagtttaaaagattaggagaccacttaatgtatttcctgaaggaaattgggttcttgaaatattcccatttgatttttttttctggcactaaaaattatttctaagtttaatttgctttcagaggaattatcgtcttataaaatatgctagctgctaaaacagattgaattcctatcaatttcaaagagagtgatctcctcagtctttgaatggagtattttaaataataggatttgaaaataattgcttaatacctgaattcaagatgacaaaacatgttttgagttctcaggaaagcctgtttaatgtagctccctacttattcctaaatcaaccaactttcttattcactccatgaactgtgttggtgaaacctcttattgcagctggaggttgcactttattcctttgttgttccattgtttcctttagggtgagggagaataattaaggagaacatcttttctgagcagctggagccaaattccagctgactgcagcacctgcaaagttgacacctctgcctctgggtggcagggtgggatgccagccgtggagcctgtgacaatgggttccgaagtgcagagatgcggccgtgcggtaccactcctgcccttctgtgagcttcagatggcagtaataccagtgaatgcaaagtgtctgttttagactagagggatgatttgtgaaacggtggctatttatttaattaatcaccagcacaaagccataaaacccatattttaaaaatccctgttagtttgccatgtggttaatagattggggcacattaaaaagtgacacagtgatgtattaaaaatgttccacctaaggttccttcaggaaggaatggaagctgtctgctttcagatactgaagtgtaacctgccaggatttgacctgtctgaagttttaatatttataaaggcatttatcttttgaatagcatctttattaggacttctcttcttggaatatttcaaaataaaaaatgtttgtagcataatgaaaagttataattaaagtgaattttgctacagtttctcttaatgatgaggaactatattttctcgttaaattatactatgtttactatgcatagcagtatcttttataccataggttattttctgtttgtaaataaaggagtcatttaattaactaaataataaatgcaatagtatttttgttcccactgtcagcattgcattttgttttgctgtggtgttattttactatcgaataggaacggggataattggtgtacttgctcagcctcagctcaggtgagttgtcatttctttatagtaagaataaatgtctaattgacttgttcaagagatgacattggcattaaaattgagaagagatggcttagattgtaacaactggtagtgtttttttacacacacagacttcttgttgattttcagtacacacaagcacgagtacgtacagtccctcttgcactttcaatactattgggagataaatttggtacatctgtgctgttattcattctttattaacaacatattattgaaattatcagtgttcctgctaaagcaagtttaactatgtaatgaaatgttttctagaagaatttgaaatcatgtatgaaaatgtgttgctcaggtgaatgcttgtaaggaaattgtgcagctcttaggattgtgtttctctgctgtgttgtataattacctgctctggtagaaggggagctggaataaaacatgagtatgttaatgcagcctggagctgatgtggtggtgatgattacaatgcagataaagcatttctcataactgccgttgcctactggagcctttgaaacatctggacctttaattgaaaaatagtgtggtgctgtgcaaggcagacatgctaagtgaagtcactaatttagaatacaaaaatataattgataaagtgttttatttacattgtatttaaatattcatactttgttatgctttgtataacagggaattactgggttaaattttcatgaatgtagacagtctaaatgagataaattaagtgaaaatgttaatggaattttacattggaaccagaaggcagtttggtccaggagagtgtgtacttttgcatctatcagagccttttagggaagcaaataggttaagtcttattctttgagtgttgcattttagaattaaccatcagttggtaacagcattatatttctttcttgttgttgtaatcataccttgttatttagttaaaaaaaataaaatgtttcttggcataatggtaaatggctgtaatggcaacattattgcccaataaaccaaagccttgcccacctctcggggcaggttatcagagtctgcccaagagagcagaagagctggtgaagggcttgcaattaacctttgtcctgtgttcgcagcaggggaactgacctagcagccttccgaggaaatccaatttaatttaaaatgaatttgaaaagacaaattagccatatctattttaataagataaaatcttgactctccctgtgtctggtttagttaggacctcagaggaggttggactgactaagactcaagatgaacacaaggaaaatactgccagggggctgagcagaaaccccggagactttgatacatgagtgacttgtcagtttctgcaagtgaacaggtcttgtgctgcccatttctgcagataattgcaacctgagatggacctttgtctcctcacaccctttgcttgtgttggagctcgatgccatgttgatgtcatgtgcttgctcgcccatctctccaaggaccacattgttattttcctcttttgtcattattagagcacaattgggtactgccacctgggtagccagatttagtaacagatacacctcacgattactgatgagcctcataatccgagtacagattgtctgtggcctggaagttggtgcttgaccactgcttcttgaaactgaatcagacagaggctgggtgcggtggctcacacctgtaatcctaacatgttggagtgccaaagtgggaggctcgtttgagcccaggagtttgagactagcctgggcaacataattgagactctgtctctataaaaaaaaaagaaagaaagaaagaaagaaagacgcaagtgtggtggtgttcctgtagtcccagcttcttgggaggttgagatgtgaggattgcctgagtttaggaggtcaagtatgcagtgagccatgtttacacctctgtactccagcctggacaaaagagtgagaccccatcttttaaaagaaggagagaaaacggaatcagagggttctacctggtttggttttgtttgagacagggtcttgccctgttgcccaggctgcaccagctgagggttttggaacagcctacttaacgaacagctctaagagggaatgagcgatcctcacaggactgttgggcatattaaatgagataatgtatgaaaagtgcttggaccctgataggtgcccaataaatgacagcagcagtgacctgccagttgcagagagagcttgtggtgggtgtgcaagggctgtgtacagacgaatgcactttctgtgcctggccccgtctcccatcgagactgtcagctttgtagctggctacttttactttgtgttgctttgctgactacctaattgaataatttgtctgacagtttgtattatcctgtggatcttgctgtcccctcagttttagaaataaaagttttctgccacttactgctttcttggtgatgctgtctggaagacgcggatgaaggcccgataatcagactttttgggctgcttctcagttgtaaattttgttgatagttacaagtgattctttccaacaggaagcgctgttctagataattagtaatttatctcttctttcatttgctgatgtttatatttctttcttttctttttgagacaaggtctccctctgctgcccaggctggagcgcagtggtgtgatcacggctcattgtagcctcaacctcccagactccagtgatcctcccacatcagcttcccgaatagctgagatcacaggctcacaccgtcacacctgtctaatttttaaatttgttgtagagatggggtctctttatattgccttggctggtctcgactcctgggcccaagtgatcctcccaccccagcttcccagagtgctgggattacaggcgtgagctgctatttatatttcaacatgcatttgcaaactgtgttaaatgcagactttctcaattggctctttgcagttgtatcacaatgtaaacaaccataatatattttctgctgaggaggagcatccttctctgtcaccagaggtgtaggttctttgtgttggcctttatgtgttacatagagtaacaactatcccagttatttcacgtgtgcattttgaggatgaaagtgaatgttgtaattgaagaaatgtgaacctattgtgtgatgtttttacattgtttgctaggaggtgcgtcagggacttgaattaattataattactgaagagacgtacactgattgagcaaataaagtagtaagcgcatttatgccaaggccatctaattaaattctaactttggataagctggatgtgcatgaaagattaattttaagagatttttatgactttctaaataatgatacagtgaaatttttgagttatatcattaaggaacattgaatcttaaagtgataaaacacttagttacgaacctaccactgtatagaaatttgtggattttttacactatttaaaattaaggaaacaattttaatgtgaatagtgacgtttaaaatttttataatgtttaattgactgaaaccctgcaagaaatgaatatgacatatgcgcctggattatttccttcaatatttatgcaattttacattctcaaaatacttcgctatctttgaaattaaattgtcctcggggtagttggagggttataccaaaatttccatataatttaggaaggtgataatggctgtactataaccttttttagagatacatcatctagtaatggagtcaaatatacattctccattgagttttaattttaagagttgatattaaatcttcaagactcattatattatgataattgatagagtttaaaacatgtaactcttctttatggtttaaaaaaaaccaatttttacttttaaagcatattgattttattatataaatgatttaataatgaagaggtccctaaacttatgctctgtgatggggcttagttcatgcagattacctttccctgataatatcatcattatggaagctattgtttgtatagttaaatgcaaagcactgtgtaacattaatgatctacagaatcccatcatggctttgaaaattcgaagtggacattttacatgcttgaagatggctagattatacctgtgtgagagcacattctgatacatgctgtaactgtcccaaggctggatgagaagagaatgtggttcttctctcaaaataattaagatagagacctttccctgttgtccctacttctcaatttcatgtttgcttgaaggaacattttgtccaaaaatctgcctggtctgagtaacagcttaaattacaataataaggaataattgacatttgtatgatagtttgcagttcacagaggattttaacatgctttgttgtcactttatacttcctgataatcttttgaagtagatggtcttatctctattttatgggagaggaaactgactttaagagagattatgggcttacccaaggctgcacagctcaaggctggcagggccagagtccagatcagttcagttgactcagcaaacagaagtctagcaaatgtaacttatgttggtgaaaactgccagtatcaagaattgctttctgaatttaggtctttgagaaaatgattgtttctgatacggagtggactggccttttttttttttttccttcatacttccccccatgttttatgaaatgtcttacctacatttgaacatgaatgattgctagtttttcagttgatatcttgaaataaaagaattatttgaggctattaatcaaacttcatttgataacagattgtttaaaccaatagttgctaggcattttctttcccaaaaatgtcagagcatcaaaatatagagggtttgttttaagtagagaaaaccatttctgagagcagcaacctcctttcttgttttgagtccaggactaaagatttacatttgcggacaggcgcggtggctcacgcctgtaatcccagcacttgggaggccaaggcagccggatcacctgaggtcaggagttcaagcagccacgtcacctgaggtgaggagttcaagaacagcctggccaacatggcaaacccctgtctctactaaaaatacaaaaaatagccgggcgtggtggcaagtgcctataatcccagctactcgggaggctgaggcaggagaatcgcttcaacctgggaggtagaggttgcagtgagctgacatcacaacattgcactccagcctgggcaacagagcaagactccatctcaaaaaaaaaaaaaaaaagggacttacatttatcatagatgttacagaaggaaaagttacaaaatgccattttctgtgctgtgttgtactcttgaaaggattatagcctggcttattccatggtgtttagtaaccaagttttttgtttgagatactaggtatatgaaagggtgtctatggaggtagaggtagatttgttcaaatttcatgagggttagcactaagactaatgagtaaaacttgcagagagattgcacctcagtggacataaacacattttagctggcaaaactgtttgccaaagactgaagaaaaggggctacttcacatggtgacagggacatcatcagtgaaggtgttcaagagaggttgtaagacaatcatttgttgatatttcaaaggggatgacccttcagatttcttgtagtttcaaaagtctatgaacagcaatatttttttttaagtctattgatataaaagtagataaaaagtaggaaaaaacatcataataaccagtatttcttgagcatttactgtgggactaggcacagtaataagtgctttacatgaagtcttttttttttttttttgagacggagtttcattcttgtcacccaggctagagtgcagtgctggctcactgtaacctccgcctcctgggttcaagtgattctcctgcctcagcctctcgagtatctgggagtacaggtgcctgccaccacgcctggctattttttgtatttttagtagagacggggttttgccatgttgaccaggctggtctcaaactcctgacctcaggtgatccagctgcctcagcctcccaaagtactgggattacaggtgtgagctactgcgccggcccgtacagtcttattgaatcgtctcaacaattatttaaggaggtacttttattatccacattttgtatgtgagaaaatagtgactcacagagcttaaataaattgtccaggcacacatagtaagtggcattgcttataattgaactcagatctatctgatgccccgacttgtgctcttaatcacactgtactgcctccctagtttctattagttatagcaaggatcctggaggtacccagatcagaacttgaccttgttaaagaaagagtggcagttgacgttcttaataataaaagcttaatggaaccaaggttggtgattcagaggaaattaatgagattttgtcaattttattttaagcttaacttgtcagaaaatacagtgtccagtgacaaactgtagaaatgtttttgacaaattaatttgactacaggtaccagatcagggaaatgttaatttaatagcctttaagcattccagatttattgaagattaagatagcactacaaagccaagcccctatctctgaatggatttgtcatagaattttacacaaaatccatttataaattcagtattaccattttgaatgtaaaaaaaaagttctttttgtgagtccataaagccagaattttattaagatcaaaatgttacaattctggtgtttgggttttgttttttttttttctcatgtcgaccctctttacttcccatagcccgtaaaacctgaattagaccaatttaggccagattttgtttgagattattacttctgatcaaatgaagtccattaattatcattagagtagtgctcatttgagacccctgtaccaagtctgcctactatgttattaaagacaagaccattggtagaatatagcatcctttggtccttcttgaggaagttgggataaaggtactgatggaatagaactgtagccattcttttcagagaatggctcttttgaaggctgcaaataactcttttatcaatttgcatcattacatcgtctggatacactgatatatttatttctgcattaaaattacacgtaatgatctgcttgtgcagttgttactaatggaataatgttgcctgctttttgtctctttaattgcagaagctaagctgtctatcctttctctgtttcttttccttgggagagaaactgaacacttagcagcagtttagatctgatactcaatttattactgggaaaccttgatattaaatagcaatgctagccaagcctttagtctgtaagacttaattcagctaactcacttgatatggatatttctttttttcttttcttttagagacagggtcttgctctgttgcccaggccaaagggcagggggctcaatcatagctcactgcagcctcaacctcccaggctcaagtgaacctcccacctcagcctcctgagtagctgggactacagacatgtgccaccaggccaagcttttttttttttttttttttttttttttgagacggagtctcgctctgtcgtccaggctggagtgcagtggcacgatctcggctcattgcaagctccacctcctgggttcacgccattctcctgcctcagcctcccaagtagctgggactacaggcgcccaccaccacgcccggctaattttttgtatttgttttagtagagacagggtttcactttgttagccaggatggtctcgatctcctgacctcgtgatctgcccgccttggcctccaaagtgctgggattacaggcataagccaccgcgcctggccttttttttttttttttttaagacacatttattcagcgtcatgatcagactgttacatttagcaatcaacagcatgggtacaaaaaagaaatctacattaaaatcctttgttggaatgctttacattttccacagaagaaaaactaaaacaacctgttatacaattagtcacaaatacagtcctcgagttttttgcccatacacatgagtatttgtctaaaacatgtcttctttgtagcagctaggccttgccaccactgtgcttggctgagttcacaaatctgttgtaacctgtagcttcgctgtcacttctctggctctcctctcctgttaagctttgtttgctggcagtaattaaaatcttctgccactgctgtagctactgctgctactggaactgccatagccacctcggttttgtggtttgggaaagtactggcttccaccaccatagctgccagagcttctgcctccaaagtttcctttcatcatgggttcaaaatttgaagactgattgttgtaattgccagaatcattgtagcttccaccaccctccaaaattgcttccatcagtaccaaatccattatagccatccctactgccaccatatccaccaccaccatggttgccaccaaaggcaccacaaccactgaagtttcctccatgaccaaagttgtcattcctaccgaagtcaccttcacgaccaccaccaaagtttccagaaccacttcgacctctttcgctggatgaagtattagccatctcttgctttgacagagctttcctaacttcacaattgtggccattcacagtatggtgtttttgaatgacagtcttatccacggagtcgtggccatcaaaggttacaaaggcaagtccccttttcttgccactgcctcggtcagtcgtgatttcaatcacttcagtttttccacgctgttcaaaataatctcgcaggtgatgttcttcagtgtcttctttaatgccaccaacaaatatctttttcacagttaagtgggcacctggtctttgagaatcttctcttgagacagctctctttggttccacaactccgatccaccttgtgtggccttgcattcatggctgcatccacctcctccacagtggcataggtgacaaacccaaaacccccggaacgcttggtgttggaatctttcattaccacacagtctgggagcgttccccattgctcacaatggctcctcttgctctcattggttgtttcaaagctcaaccctccaatgaagagattccttagctgttccggctctttaggagactctgacttaggacggcagggagaagagagactttaacgatgcttccttggcgtgtccacaggcagaaaggagtaagctgacaaacatagcatgatatttcttaattcaagattattttgaactgaatcccatctgtattcttattgcttctcctactttggaaactatcaggtatatgattttgaaattaattttatgataagcagctaatgtatattattttaattaataggatcagctgagaaaagctgctctagataatgttttaattcatcagcatgttcaaatacatacatttcaattctatatctgttcacattctgtgtattagaagttattttagatttttaagtttacccattttatgagctaattattaattgggtaacctttggttcatagtattgatatttcataattggcctagagacactttttaaaagactgagcttttccagtatatatcacaagttacaaaacattcatagtctttgacttagtaatctacttctagaaatattttcacatttatataggaaaatgtttatgagattatttataataatggaatattgtaaacagcttccatttctaaaaatgggagaataggtggtaccaccatatgctataatataatgcaagtgtttaaatcatgtgttaaaagaatattaatcatttattccatcagtatgtgtaagtaactatgtcgggccctttgttaggtgctggggatatttcagagaggaaagagtgttcctgaagaacaggggctgggaagtagaaaaggtatagctgctctacctgggatagagaattggtaggtccggtgggtccattctgaaagagagtctgaggagtccttttgatttagccagctagcatgaaacccctgctgtgttctaggctctaagagaatacaaaatggatgaggctatttttccctttatgtaattcacagctgaatgagagagtgtggggaaggaggtggtgagggtagttacagaaaaaagtgaaactgtaagtctgtgcaaatcaaattgttaggggaggagagaagagggaatttatttcgtcttctaccttcttggaagaggtgatatttgaattgaaggacagaagaagagctatgtttcttgatcagtgactttgtggcaggcattttagatacatcttatttgctttccaagtgagtaaatacaagttctgagaggtgaggttactttcccaaagtctaaggtctagcagctaaggaagtggtaaagccaggattccgacctgggcctagctgaccccgagtctgtgctcttaattactgttcagtgtacatcagtaatgatatgagggaccagattgcaaagggcattaactgccacctaaggagttggaatgctaccactaggccatcctgtgtttccacatgactggcatggtctgtgatttgagaaaaatcacattggtggcaataaggaaagaaagatttggaggggaaggatttttaaaaataaagaaatagttggagattgctgcagtggtctcgctgacagatgacaaagctgacgaagcctaaactggggcgttggcaataagcatgggaaggagagagatttgggaggcatttcagaggcatttggatggtagagtgtgagacagaaagaggaattaggattcctagcttgcgtgacagagtagatggtgaaagccttagttgagatagagtatagaatgacagacatgccagtgaagaagaaaattggtgttggatatgttaaatttcagattctgactgcatttgcaaagccatcaggtcagggagaggctgtgggatatgaagttgagtctagttggtcctcatgagttgcatttgtgccaagaaagttttgctataggaagtacttttctgtttgttctcaaacctgccttgggggcatttcctgatttaggagctgctctggagaatgttgttcaacttcaaattgtcagctgattgtgaatttattacctttttttttctttttctttttgagacagagtctcgctctgtcccaggcagaagtgcagtggcatgatctctactcactgcaacctctgcctcccgggttcaagcaattctcctgcctgagcctctcaagtagctgggactacaggcgcacgccaccacacctggctaattttttgtatttcagtagagacggggtttcactgtgttgcccaggctggtctcaaactcctgagctgaggcaatccatccgtctcagcctcccaaagtgctaggattacaggcctgagccactgtgccttgcccttttctttttctttgataaaaattacttaacctgccatagtaaggtatctgagttatatatatttttttctttttttgagacagtctcactctgtcacccaggttggagtgcagtggcatgatcttggctcactgcaacatcttccttctgggttcaggcgattcctgtgcctcagcctctggggtagctgggactataggcacatgccaccatgcctagctaatttttgtatttttagtatatttagtatttttgtattttaccatgttggccaggctggtctggactcctgacctcaggtgatctgcccgcctcggcctcccaaagtgctgggattgtaggtgtgagccaccatgcccagccctgagttatattttcttttttttctttttttttttttgagttatatttcaacttactttttccaacagcctgtcacagcacatagtatgttcctttttttttttttttttttgagacggagtctcgctctttcgcccaggctggactgcagtggtgctatctcggctcactgcaagctccgcctccagggttcacgccattctcctgcctcagcctcctgagtagctgggactacaggtgcctaccaccacgcccggctaattttttgtatttttagtaggacggggtttcaccgtgttagccaagatggtctcgatctcctgacctcgtgatctgcccgcctcggcctcccaaagcgctgggattacaggcatgagccactgcgcctggccagcacatagtatgttcttaatgatgcctacttgatcccttaacacaggctacatttttgaaatcgatcctctctttccctcacctaaaacttttaagccctgaatggtactcttattctttttatctcctttttagtttataatatttacaattttgtttctaattataaaagtaatacatgtctattatagaaaatacagaaaactataaaccagaaaattaaaatcactgataatcccgtgtctcagagggaactcctgctcaccttttggtgtattggtatagtaggtaaatacaataagcatctttttcttggttaaggttctgttgcatggaagggtacatttttatatctaagaggccttcactagccccctttagcctgggttgcttctgggctctcttgacagactggactttccccttcttaaaactttcgtgacattgtacagtgagaccttcagcaaaacagtttgatgagggtctggtctgcattgtatgtcagtggactttgtcttcggagcccagcatcatgtttcagctggtgtttgttgaatgcatgagagaatgagaacataaagctaagccagtttccctgtggcaacactttctctgtgttgcccgcttccctgtgctctaaatatgcctccatttccccagtcctgtatggtggaacacgtaaattgccatgcagtgaaactgtatgatatgatctttgtttattgctagttgctttttcatatttagacatctatggaatattgcttgccttgatgtgtaatgaatacttttaatccttcggtcaccgtttttttaaataagttaattactttctattatgttgatggattgttttatgttttagatgattccttctaaatattgcaacttagggactattaggatagagctaactgccaccaccttgagctttttcagaagacagtctccttattaaaaaatatgtaatttcagtgtgcaaggcacttttcccatcatcatttcctcaagatggaattagaagattaaaaagataaagtgcttcattcatttaataagtatctatcatattcattccgatagtttttgccccactttctattttactatgaaatagagggtagtaaagagtactgtactctttagagtaaatagaggagtatactctgtgttactcatatgagtaccatataactatctgtcctcatttcctaaacagtggtgactgcccttcagtcaactgacagtggcagggtttcctggagtctccatctcctaactgctctcctcgagcagctcctcaggcaaagctttcctcaggtttgtagggaaaagaagagggagacgattttcaagccttgaagagtaggaattgattacatttagagtaagtccagggaaagaaggcgttggtgtttacagtagggcctttggagtcaggctgacatgaggtttgagtcttggctcttccaccttggttattgggtgttgagcagatgactgtagccttgtaagccttggttttctcagctataatataaaggttacgccaggtcgcagtcactcacgcttgtaatcccagcattttgggaggccgaggtgggcggatcacttgaggtcaggagttcgagaccagcctggccaacatggcaaaatcttgtctctactaaaaacacagaaagtagctgggtgtggtggcacatgcctgcaatctcagctatttgggtggctgaggcccaagaattgcttgaacctgggaggtggaggttgcattgagctgagattgtgccactgcactccagtttgggcagcagagcgagactgtttaaaaaaaaaaaagttatgatagaaccctatttcttagagttattgtatgaattaaatgatataattaggcaaacatttagcagagtttacttaacagctctcagtaagtgctagccctatgccccgcccccctttttttttcttgagacggagtttgactcttgttgcccgggctggagtgcagtggcgccatctcagctcattgcaacttctgcctcccagttgcaagcaattctcctccctcagcctcctcagtagctggcattaaaggttcccaccaccacacccggctgatttttgtagttttagtggagatggggtttcaccatgttggccaggctggtctcgaactcctgacccaaggtgatccacccaccttttcctcccaaagtgctgagattgcaggtgtgagccaccgcacctggcctaaatgctagctcttgttacaatagtcagtattattagtgttcctgcagtacccgttcttggcctcatgtgaccttgtagtaagcttgagtaatagaaatgggtcgaatttcaacacagacgccctttctggcatactgctctgcatctctaaagcatcttacagtttatgaaggacattcacatttgtcatctcgttgaatcttcatatcttgagagactgtgaatcctatagctccttagttctagtgcttccagaggaagaggaataaacagaaataaaaagagagagcaatgacaagcaactgatctgggtctgaaaaggagggtaatatgagggctatcaaccgactccagaaagattcccactgtttgcattgtaaccctttgcctgcccgacaaggccaaaacacttgttatttagtgaagtctttgttagccattgaaattattatttcagagctgaaaaccacacaagggaatgtgtgcttgcccacgtgtgtttgcatacgagacagagagtgcacacgtgcaagagagggacagcgagtgtgggtgcatgcattatgtaggagaattatttttttggtagttgctttgtaacatacagatgaggctgagggaataaaatcagtcaatctaatgatggatgctgggttgtgtgcaaagtggaattactctaaaaatgttttttaaactgactttataatttcctttccctgtactgacctttttcacctcagaatgatagaattatagagttaaagatggaaccgcatgattgctcaagtccctccactttcacctatgaccaggaaatggatccatagaggaagggcaagagggatggagaaaactaacatttactcagttcctactacgtgtcctggcaggcactggagtcattcataaattcattctgtagttcaacagattttttcctcagggtcttctgtgtgccaggtacagggccaggcattatgtatggaacagtaaacaaagcagacgttaacattgctctcaaggaagttcagaggaaacttcgtggagaaagcatacactaaagatgtacataaataaatcatctcaattgttaagcgctctgaaggagatgaacaggacatgtgtgagagaataactgcaaaaggagtgttaacagtgacagctgagccctgtataataataattaataataagtaataataattctcataagggtcttatgataggtaggtcctaccattctcctcattttacatatgaggaaacagaagcatagagagattaagtaacctcccaagggcacacattagaggatgaggagtcacgcatgcaaagccatgaaaaagagcctctctagatacagtgaacagcacctgctaagccctgggacgtgagaaatgcaagcaaggtacacacaggcacacgtgctggtatattgagggtacttccagaaggccggtatagccgaagtctgatgagcaggtggaggagtggcagtggatgatgttaaagaggtagacagggccagatcatgtggtgctttgttggatgttgcagggagtttggattttgttcacggtgtttgggagccactcatcgaaggaatttaaacaggatatggtatgatcaaatgtgagtttaaaaaacagatctaacttgtgtgtagagaacaaatcagatgaaacaagagtactgtagaataatttgggaactgttacaatagttcaggtgagacctgatggtaattttggtggcagtggagatagaagtgagatggttttgaaatacatatttttcactttttttcttaagataaaacattacataaaatttaccattttaaccattttaaagtgtacggttctgtggtatttaatatattaacaatgttatgaactgttactgccaatttcagaacattacgatcacccccaaaagaaacctcatacctcccaatttcccaccccgtcatcttctgccaaccgctaatctactttctgtctctatggatttgcctgttctgaacagttcatataaatgggttcatacagtagtggcctttcatgtctggtttccttctcttagcatgatgttttcatggtacacccatgctgtgtgtatcagtacttcattctttctcatggctgaataatattctattgtatggattttgtttatccattcattagttagtggacatttgggtgtttttcattccttggctattataaataatactgctatgaacatttgtccaagtttcaatgtgagcatatgtttttagttctctagagtatatacctaggaatggaatcgcttggtcatatggtaattctgtgtttcatttttgagaaactgccgaacattttcacaatgactgtatcattttacattcccactggcagtgtctgaggatttcagtttctccatatcctcacaaatccttgctatttttggggttttttgggttgttgtttggagtttttgccttttttaaattatagccaccctagtgagtaagaagtaatttacattatggttaatgatatgaaacagttttcatgtgtttattggtcatttgtgtatcttctttggagaaatgtctgttcaaatctttgcccattaaaaaattttgtcttcttattgaattataagacttcttaacgtattctagatagtagagccttatgagatatatgatttgtgaatattttctcccgttcttttgattgtctttttactatcttgatagtatcctttaggcacaaaagtttgtttgtttgtttgtttgtttttgttttgagcagagtctccctctgttgcccaggctggagtgcagtggcatgatgttggctcattgcaacatctgccttctgggttcaagcagttctcctgcctcagcctccccagtagctggcaatacaggcgcctgccatcacgcccagctgatttttgtatttttattagagaggggatttcaccatgttggccaggttggtctcaaactcctgacctcaagtgatctccctgccttggcctctcaaagtactgggattacaggcatgagccactgcgcctggcctaggcacaaaagtttttaattttaatgaagttcaatttatttattttgttatttatgcttttggtgtcatattaaagaaatcgttgcctaatccaaagtcatgaagatttacacctgtttccttttaagaattttatagttttgcctcttacatctagatctttgatttattttgaattgatatatttatgtggtatgaggcaggactccaaattcattcttttgcatgtggctatccacttgtcccagcatcatttgttgaaaagactgtacgttccccattgaaatgtatttttgaagtagagacattagaacttcctaatggagtagataggcagtgtgagggaggaagaagcatcaagactgttgagatgagcagctggcttagtggtggcagcacatattattaaaataagaggggttgttgttgtgacttgggataggagggagtgagggacaatcaagcattccgatttgaactcgttttctgtgacacttttctatatactctgtgtggtgaacatattgcatgggtgggaaggaagactgagccagtgtgcaagccttctgtgagggaggggaatggccagaaggttggcggataacagaaacacaaaaggagggagagaggatggtgtcatcggatggcctgggtctcaagagaacaaggatttttttcacaaaagagaaagtactagattggaagtgttagcagggactaggatacctactcttgcatgccttgagggtgcaggggttataaaaaaaaaaaacaacaacaaagcagtcctcttttaacaggacagcagaggaggcagtatcctcaacagcaggttcagtgaagtccaagaggtagaggaaatcgttttaaaaagcagctgaggatttatgggtgtttgctgattagcgcagcagctcttgagggcagagtggaagacgcaggtgggaggagtggtaggtgtgtgggagggagtgggaatatatccagcagtgtggggttggtggttagggcaataatggaggatcaaagggcccttgaacctgtgtggtagtgaaggaaacagatgtactgcctagtggaactagcccccagtctctgagaaggcaagcacctgtttcagtgctgcgggcctaaatccttcctgggagagtatgacagcttcccaggcagctcatctcattgtctcaaggacaatgagacagttgccagagaggcacccagtgctaaggtccagggacacactgagttagtagcaaagccagcctcctaacaccaaacatgaactctactcaccactcatattttcctcttagttgtagtgcccatttaccttcctgctggcagatcccgatccattagtttattataaaatgaaaatttaaggaaaaaaaatccttgaaactagacagtgtttccactttgggaccattccatggtcacagtaggtctgtagagcaaggatgaaaaatggctgtgctgcccacaggcctggagagcagtggggtctgtataactggcagtgtgctttgctctcacgtgtttgttctgtccacagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaagtaatccattctctttttggctgctctagtttcttgtggtcttttggccacccaaggtgtcttctaggctggttagtctttctaggcattggcctggaaccacacttctgcactgatccagctctgggtgctcaccaggtctcgcgcctgtgcatctcagagaatcagcttgcaaaatagacttagaagtttgtgaattacagacatgagaacatggatttttagtaatttccaaacccttttatgatccctgctaataagcaacctggaagggaacgggaggggattgatgtttgttgagcaccaatcatgcattgggcactgggctgggcactttgtagctggtatctggaatctcatttgatcctcccagctccctgggaggtgagggtaatgatcctcattctgcagtggtggaagctcaggttcagagctgttactggctgaaggttgcacagtgagagatggcagagtcaggatttgattccaggtctgtttgatgccaaggtttttgcattatttccttctgccttctatagaacctttggtccgaattttagttttctttatcagttaatggttctaattttctctcagtcactaggctctgttcttcattaaataattatatttaaaatgtagtgcttgagagtagcctctctatgcctcggcattataatttgaactttaaagtgctttgctgcattgcctctcccctacttgagtttctgacaggcattctcttctagttttacatgttctttccagcagtagggtttagaacacagcaaaatgtagtagatgccttcattttaaaaatggactctcagctgggtgcgggggctcacacctgtaatcccagcacgttggaaggctgaggtgggcggatcacctgaggtcaggggtttgagaccagcctggccaacatggtgaaaccctttctctactgaaaatacaaaaattagccgggcatggtggtggccatccgtaatcccagctactcaggaggctgaggcaggagaatcgctgcagaggttgcagtgaaccgagatcgcgccactgcactccagcctggtgacagagcaagactccatctcaaaagaaggattttcatggagatgttctcttcccctttcacattttcagagttagtatgatccagtcagcagttagtttttatttttctttaggtatattaaatttctttaggtaaatttagtatgacacataaaatgattttttcaaattcttattgacattgccctccactttgcctgagtaagttgtggacacaaagctctggtggcagagaaagcctttcaccaagatgccacctaggcttagaaaatggttcagtcagcggcacacctcaagggtgagctgtgaggtcctcccttttctgcatgaagtgggaacaaggaaacaggaaaaggtgtcacagaacaaatgactttatcgatgttgtctgaagtaattcttttttttttttttggagacggagtcttgctctgtcgcccaggctggagtgcagtggcgcgatctcggctcactgcaggctccgcctcccgggttcacgccattctcctacctcagcctcccgagtagctgggactacaggcacctaccaccacgcccagctaattttttgtatttttagtagagacggggtttcaccgtgttaaccaggatggtctcgatctcctgacctcgtgatccacccgcctcggcctctcaaagtgttgggattacaggcgtgagccactgcacccagcctttgatgtaatttcttaaaacattacttagggcaggcactgaaatcaagagaggaacttgcccagggttactagtaagtaacagagataggaattgaactgtgatgtacatcttatagatgaggaaactaacttagagagactaagtagctttcttatgtcacataataagtggtagtattagtattaaaacccaacaatctctgactccagagctccatctcttcactattacattatcctctccaccatggaactctgttataggtgaaatgaaaatatttattgagtttgtacttattgcaggcactgtgctagatctggaaatacagaaatgaaagaggcagttcctgccatcagggacctttctgtttaaggtaaataggtaataacaatataatacaattacgtgcaaaatcaggtgcttacaaggagatctaaccccacatttgggggtgaaaatggagtcgtgaaaatctcccttgattaaatgacatctaaactgatacctgagggagcagtaggaaaaagtcatgtagagaggttgagaggagggcattccaacagagggaaaagcatggttatgatagacctttaagttcatgctttaaattctatattctgctccaaatacataataatagtaaatgaaatgctattaacatatttgtactttaataacaagataagcatcctggtggactagaaatagaaccaactacagaaacaggcagagtgtgctaggagtccattattttagggtattactgtccttagagcatgctgtggatgggtttaccagtgtatgacatactgatttttctcaggcttcagggcagctagtcagggcatgggtgatgatcagagccctcagccaatcattcctgggtgagggaacagtctcatccatctagctgtgtactgtgcaaatattgttattttctccatatgtcatggtgtcaaaaagagtgggaaatactacatgagggtatgggaccaaaggaactgcatccctggacggggaccagaggaaatgacagaaactagaagctggagtgagactgtcatacctatgaaaagaagctgaacaaggctgcttgggtctgtggctcatttaaagttgtgtttctggggtgccaaggaatagagagagcagtgcaaccaggacctgactgtggcatggctgggtttatgttatccctagtattacaggaaccctgaactatcagtgtaagacctggttctggtctggaggcctctgtttggatgagggtggagggtggtggcaatatctgtaaaagcactgacagtgagtggagggagagagcaagcaagggttctcattcaagaagagctcagcaaattaaaattccaaagcacacgaggatagctagtaccaagaaacacagacaataatcaggagatgaatttgggaacagaatatagtaaagcagtctgaaaattaatttcaaataaatatgtttaagctcaccaaacagatgaaggaaggaataacattcatgtttcacttctaggaaattatgaaacaaaagcaagcaaatttgaatttagaaaagaaccaattaaaagtacagtactggaaatataaaatacaattattaaagtaaaaaatactttgggataaactctaggctggtcacaattcaagagagaatgagctgaaggacagttgatactgaggaattcaacctaggatatagtacaaagagataaagaggtacaaagaatgaaagagaagagacatgaaggaaagattcaaaggctcccacatgtgaagtggagaaggaagggaatagcagagaagcaatatttgaagagataatgtcaaagaatttcccagaactgaagacagataggagtgggtttgatgttaaaaacacatgcaaattaaatggcggaagaagagactttttttttttaaacaaatggtcctggaccagttgaaattctataagctgaaaaaatcaacctaaatcatgtatcttgtattaattaaaaataaatcacaagttaaatgtaaaatgtaagaaaaaaacaggagaaaatctttgggacctagagcaagttagacttcattaaaattaaaaatatttgctctgcaaaagaccctgtgaagaggatgaaaggacaagctacacactgaaaggaaatatttgtaaaccacatatctgactaaagacatatagaataggtaaagaactgagaacccaacagtagaaagtttagacggttgatcagaaaatgggtaaaggcataaacagacatatcactgaagaggatatgcatacagatggcagatgagcacatgaaaagatgctcagcaacattagccattaggaaaatgcaattaaaaccacacgctattagaacagctgaaataaaaaatagtgatgacaccaattgctggcaaggatgtagagaaactgtatcatacatcatttctgttgataatgtaaaatggtatagtcattctggaaaatactttggcagttccttataaagctaaacgtgaatttaccatacaacccagcaattgccctcttgggcatttattccagagcagtgaaaacttacattcacataaaaacctgtatacaaatgtgtatatcagccttatttctacttaaaactggaaacaacctaaatgtccttcagcaggtaaatgattaaacattgtggtacattcataccaagtaatactactatcaagagaagaggaacaaaccgttttcatacatgcagtgacttgggtggattcacgtagtgaaaaaaaccaatctctaaaagtttcatatcacccaattccatttatgtaacatcctcaaaatgacaaaagtatacagatggagaacaattgaatggttgccagaggacaggcacagtgttagggaggcagtccaactataaacgggtggtaaaaaagagcttctctgtcatgatggaacagttttgtatcttggtgatgattacacagatatatacatgtaatccaatgtgtagaactacacaacacacacacacacaagtacatgtaaaaactggtgaaaagtgagtaatgtctatagtcttttttttttttatacttttaagttctagggtacatgtgcacaacgtgcaggtttgttacatatgtatacatgtgccatgttggtgtgctgcacccattaactcgtcatttacaataggtatttcacttaatgccatccctccccctccccccaccccacaacaggccccagtgtgtgatgttccccgccctgtgtccaagtgttctcattgttcagttcccacctataagtgagaacttgcggtgtttggatttctgtccttgtgatagtttgctcagaatgatggtttccagctttatccatgtccctacaaaagacatgaactcatccttttttacggctgcatagtattccatggtgtatatgtgccacattttcttaatccagtctatcattgatggacatttgagttgattccaagtctttgctattgtgaatagtgccacagtaaacacatgtgtgcatgtgtctttatagcagcatgatttataatcctttgggtatatacccagtaatgggataggtgggtcaaatggtatttctagttctagatccttgagaaatcgccacactgtcttccacaatggttgaactagtttacgctcccatcaacagtgtaaaagcatttctatttctccatatcctctccagcacctgttgttttcatgaataaagtctagtcttaacagtattgcaccaatgtcaatttccctggtgttgatattggactacaattatatgacatttttaaatagttgttccatatttcgaattacatgattatattgagtctaaaccatggtcttttgaaattttttacaattcttagtgacgttggatttctcaggtttgtttggtgtaatacagtctataaagtgaatccctgggatctcctcctgtcgggcagtgtaatgtgaggtattttctttctagtgtgtttgtacttagtgttggaatagatccttatttggtcttttccagtgggttggccctgtgaaagagcttttcattcacagagagggaattgctggatgcacatgaagagtggcccaccagttgcagcctggttgtcaagaaaaccatttaagaatattgttcttgggccgggcacggttgctcacacctgtaatcccagcactctgggaggccgaggtgggtggatcacctgaggtcagaagttcaacaccagcctggtcaacatggtgaaaccccatctctacaaaatatacaaaaaattagccgggggtggtggcaggcacctataatcccagctactcgggagtccgaggcaggagaatcacttgaacctgggagacggaggttgcagtgagctgagatcacgccattgcactccagcctgggcaacaagagcaaaactttgtctcaaaaaagaaaaaatattgttctcctgttcctgtgccttgtaaactgtctatggtagtagactttggccccaatgaaggaatggagaatttggcaggaattcttggcctcctttacacttacgtctgttaactcttgagcaagattggaatatggtacttaggcttatttcctgcttattttgatgcactgatttgggggaaaacatttgggagaaactaactgaaataatttcaatctctaaatggtcaaattttaaaatttagactttgttattctttattgaattttgatcagaaaatgtggactatgaaatttttgcctaagagatttatgtatatttggctgcttactatgctataattttttggtcaatattccatgggttctggaaataattattctctatcggttatggacctcaatatatacttattaagtcaatgtccttaattacttatttctattatcttagggtttttgactatttggtctatggatgattaagagaaatgcattaaaatttccatcttgtgtgtttctgttaacttttcctaatatttcaatagtatgcactttatatatttcagttcacataaagattcatgtgttttgtgtctttattatcagttctacttcagtataaaccggtcttatttgttctgtttatgattgtgtcttgcctgtttctttgcttcatcagcaatctgagctttttttcccctgctcttctttgctctttcttcagtcttttacttttgccttctgttttagatatgttaataattttgtgaggtttttcttttttgactcatgtaagtgattttcatttcataagaactatctttttttatgctttttttttcgtatttatttattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcctaacgagcatgctgccttcaagcatctgtttaacaaagcacatcttgcacgcccttaatccattcaaccctgagtggacacagcacatgtttcagagagcaccgggttgggggtaaggtcatagatcaacaggatcccaaggcagaagaatttttcttagtacagaacaaaatgaaaagtctcccgtgtctacctctttctacacagacacggcaaccatccgatttctcaatcttttccccacctttcccccctttctattccacaaaaccgccattgtcatcatggcctgttctcaatgagctgttgggtacacctcccagacggggtggtggccgggcagaggggctcctcacctcccagtaggggcggccgggcagaggcgcccctcagctcccggacggggcggttggccgggccgggggctgaccccccatcctccctcctggacggggcggctggcccggcagaggggctcctcacttcccagtaggggcggccaggcagaggcgcccctcacctcccggatggggcggccggccgggtggggggctgacccccccacctccctcccggacccccacctccctcctggacggggcggctggccgggcggggggctgaccccccccacctccctcccggacggggcggctggcagggcggggggctgacccccccacctccctcctggacggggcggccggccaggcagaggggctcctcacttcccagtaggggtggcctggcagaggtgcccctcacctcccagacggggcggctggctgggcggggggctgatccccccacctccctcccggacggggaggctggccaggcggggggctgaccccccacctccctcccggacggggtggctgccgggcggagacgctcctcacttaccagacggggtggctgccgggcggaggggctcctcacttctcagacgggacggctgctgggtggaggggctcctcacttctcagacggggcggttgccaggcagagggtctcctcatttctcagacggggcagccgggcagagacgctcctcacatcccggacggggcggcagggcagaggcgctccccacatctcagacgatgggcggccgggcagagacgctcctcacttcctagatgggatggcggccgggaagaggcgctcctcacttcctagatgggatggcggccgggcagagatgctcctcactttccagactgggcagccaggcagaggggctcctcacatcccagacgatgggcggccaggcagagacgctcctcacttcccagacggggtggcggcccggcagaggctgcaatctcggcactttgggaggccaaggcaggcggctgggaggtggaggttgtaacgagccgagatcacgccactgcactccagcctgggcaccattgagcactgagtgaacgagactccgtctgcaatcccagcacctcgggaggccgaggctggcggatcactcgcggttaggagctggagaccagcccggccaacacagcgaaaccccgtctccaccaaaaaaatacaaaaaccagtcaggtgtggcggcgtgcgcctgcagtcgcaggcactctgcaggctgaggcaggagaatcaggcagggaggttgcagtgagctgagatggcagcagtacagtccagcttcggctgggcatcagagggagaccgtggaaagagagggagaccgtggggagagggagagggagaccgtggggagagggagagggagagggagagctatgcttcgtttttttaaaaaaattttaatcgactattttttagagcagttttaggtttacagaaaatttgcacagaaaatacagtgagttcccatacatatccttccaatccctcattttactcctgttactaatatcttgcattagtgtggtacatttgttaaagttgatgaaccaatattattaacaaaagccagcagttatacattagggttcactcttgtgcagctctaatggttgtatcatacagaatggcttcactgccctaaaaatgtcctgtgctccatctattcaaccctacccaccactgctggcaaccactggccttttttctgtctctgtagtattgcattttacagaacgccatctagttggaatcataccatatgtagccttttcagactagcttttttcacttagcagtatgcatttaagcatcctttgtgtgatacacttatttctcactgttgttaagtaatggactgcatggatttaccacagttcatttattcattcatctattgaaagatatcttggttgcttctaatttttgggaattatgaataaaggcactgtaagtattcatgtgcagatttttatgtggatgtaagttttcagctcatttgggcaaatatgtaggagtgtgattgacaaattgtatggtaagcctatgatataagacactgccaaactgtcttccaaagtggtcataccatttggcattcccaccagtgaggaatgagagttgttgctccaaatcctcaccagcatttggtttttatcagtattttcaattttagctgttttaataggtgtgtagtggtatgtcgttgttttaatttgtaattccctaattacatcatgttgagcatcttcatatgcttatttgttaccgtttgtcttctttggtgagctgttcttatcttttgcccatttttaatggccactatacattagacagtccagtgtgtaacaatacatggtatagtcatgcattggagataactctggattagcatcattttgataggacctcagccatctagactgcttagggaaagttggtgggttttgtagctatttgagggcttatctcatcaagcatcacattttattcatttattttaagactctgttgctcaggttggagtgcggttgtgcaattacagttcactgcagccttgaactcctgggctcaagtaatcctcccacctttgcctcccaagtagctagaactacaggtgcatgtccctacacttggctaatttttaaaattttttgtagtggcacaaattttttgcaagagctttgttgccttgggtggtcttgaattcctggcttaaagcaatcatcctgcctcagtctcccaaagtactagaatcataggcctgagccaccatgcctggccaaacttcatttgagttattcttcataggagctctctaaattgtgttaacatctttctgtactttcttaatcagaatataacatagtggctgaaagtgtgagattcacagctacaggctgggttttaattctggtgttaacgcctactagcaggatgattttaaatgaattacttaagccccatgtagtatgattttctcatgtataaaatgagggtggaaactatctaacagggtagtaatgaaaataaaatgagaaaatacatagcaagtgctcaataaatgttcatttctgctcctcctaactactgtaaccgcagccagctactaccacaaccaatattagtaagtagttcagcagtagtagtgtaatttagtccttttttgatgactcaagtaattttactatgctatgatattctgatgccctgtggacttaggacagtatttggcagtgtttgacctgacattatgtatttccagacaacttcgttatttgaactcttcagtatgttcttgatagtccccttttttaccatctgcatgcccacctgtgtcttctcccatttctgggttgctgcttctgctttatatttcttagagtcatcatgagaactactcacctaaacagtacagctgaagtggcccttcctattctgactcccagctgtgctcccatatatcctaaggcatcacattcttttactggcagctttttaacatcaataccataagtgcttttgctatttctgtagtcagaaatgcttttctcattcttctcctcttggcattctgcttaatctcagaagcttaagtccttcattccttcatttaataaatgtttttggagtttcagaccctaagtattcaggataaaatggagaacaagagaaatgtgatcactgcactaaaaaatgcacagtttgttggggaagaagaaattatcaagggtaaaagcactttgtaactggctcatttcacttatcatttctattcattcatgcattcaacaaatatttattgagtgtttgctatataccaggcattttgctgggtatacagtggtgagtagagccaggcatggtctcgctttcaggaattccacagtctattgaaggaagtgggcaaataactaaaataattaattcagatagttaaactaaataatgtttgctttaaaactgaattaagtgctctgaaggaaaggaacactgtttatgagagctttgcctggaagtcagggagaaattccccaagaaagtgatacaggaggcattggggcaggggagggtcccagcagatggagcagtgtggcagccaccttattgctggaggaagcatgttgtggtcagggaacaaaagaaggtcagtgtgactggagcacaaagaacagggagaacagagtgggattgttacaggacaggggtcttgatccagaccccaagagggtttttggatctcatgcaagaaagaattcagggtgatcccacagtgcaaaatgaaagcaagtttgttaagaaagtaaagaaatgaaagaatggctgttccatagccaaccctttggggctgctggttgcccatttttatggttatttcttgctgatatgctaaacaaggggtggattattaatgcctcccctttttagaccatatagggttacttcctgatgttgccatggcatttgtaaactgtcatggcactggtgggagtgtagcagtgaggatgaccagaggtcactcttgttgccattttggtttgggtgtgttttggctggctcctttactgcaacctgttttgtcagtaaggttgttatgacctttattttgtgctgacctgctatctcatcctgtgacttagaatgccttaactgtctgggagtgcagcctggtaggtttcagcctcattttacccagctcctatttaagatggagttgctctggttcacacacctctcatgtcccccccccccccccttttataagagaactctttaatcgtaagagttgcagagggatgaagatccatcttctttaacttcttcaggctgaatagcgattatgatattcctgcctaactatgagggtttcttgcattcagagtagacaggagctcagtgagaaagcatcagtatggtaaggtccattcataactcttgagttttgagaaaaggcaatatctggaagattaataagtgtttaatttaagaaaacattcagtaagcttgtcctgtattcctacacaaagagtataacagcagtatattccacaagagtaaagcaaaataagtaaagttattccaagtaaactaaattagaaggctttacatgaactgggcaactgttggaactaagccgatatgggattgttagctgattgtaatgtgcccagaattagaatactgatccagatttttacattactcatccctcttgtttcttctgaccacaagtcagagatcactctttggttcacaggaataagcagggttagcctaaattgcagaaacaaacttaaaaacaactaatgaggctagaatttagtagaaagtgtaccatagttcttgaaacataatatttcattctccagtttttcatttttactaaagacaaatcatggtaagactgatttgctttattatacttggcctgattatttgtataaagtgcagcaagaataattatttttcacatagcctcttttaaaattggctttgatggaactctgttccatagaaggaatcttagttaagatttcttaaaaccaagctcagccatggttttgtaccctcaaatacctattagttgagtaaattcctctcctcttggggtcccaagataacttggggctcctggacctgttagaaagtgacattctttacttatcacaggtcagaaaccttgtacacaccattccagttaaagccttgggaaaataactagtttcttcagttgtgttctgttataaaagaaaacagattcttattgcacttatgcaaataactatattgccataaattaagaatgctcacaaatagtttccaaattttggagaaatcaggtagagagaaacaaatatgctccaaattttgtttacaggagtatactttacttaattggtaaaagctgtaaatagctcaaatgaaaagtttccttgactctgaaaaacaaaggatcagcaggatattctatttatttatttatttattttgagatagagtctcgctcccgtcgagcaggctggagtgcagtggcgcgatcttggctcactgcaatctctgcctcccaggttcaagcgattctccttcctcagcctcccgaatagctgggattacaggcatgtaccaccatacctggcaaatttttgtatttttttttagtaaagatggggtttcaccatgcgttggccatgctcgtctcaaactcctgacctcaggtgatccacctgcctcggcctcccaaagtgctaggattacaggcatgagccactgcacctggccggatcagcagcatttaagcaaagttaaaaagattacgttagtttgctattggtccagttaattcagttaacttatgttctattagatattcatgaacattccagctcttcataagagttttaaaagttgtttcctctattctaatcttacaatttccaaagttattagaaacctgcgtttaagaacacctgctagagttctctagttaattataaaccaccttctaaagaggattaaaacaagacaacaatggtctgtagatgataaaaagttttaggacagccactattaaagccacaattgataaggaaatttggttacttctgtggcacacaaaattttacataacaattataatgattaattacatacactaagttatattagaattataggagtttcccataatttggaacatataccaataacacatttatgcacatatagtccaaagaaagcaaaacaccattttacatttgataatgtatgatttttataccaaataagccagatttcaccttcatattaatgtactattaatgttaaatgcaatttttaataaaatcttttagacatatttactgaattttaatgtttaaccgtaagttaagattcttataaacctttataaccctttacattttttttttttatgaaagagcagatgagtgcgctaagaaaaacctgttgtgcttttattctaaaatttaatttgtggaaaaattgaatagtacccctttaactttagccaatatgttcacacactgaatctcttaaagttactttttataaacctttcacaacttgtttaaacctttagatttttttttcttacttaaaacaatccttcaatactttaggcagaaaaaaattcacattcccatgatttcttacaatctttcaccaaaaacaaattttactttctttacacattgcatgtaaaattatttcagtagtttcaattgcatattataatgttaactcttagcaacttttatttttggtgaaaactttggtaagtttgagattttaattctacactaggtgtggagcagtgtactgctcctagatacactaggacacaccaggcagaagtgcagataaggtctgactctccagcatagctgggggcatgtctaactccacatgtccccaggccttacctagctgtaaagcaggcaagttatacagtaagaaccatagtggcatttcatgaagcgtttagcagatctaacaacctttgaattggacaacttttcgtgcataaattccctttcacaaattttttcatgacttacccataccatttgagactcttggactttctaacttgccctaaacctccctccttttaaacaaccagttattttactttaggacaagaatttaccatacaagatcctttcttatataaaatgtctttctttgtaatcttctttgtatagctagggggcatggctagttccacatgtccccaggccttatctagcatttaatggctttaaggtaggtaaattaaacaatttttaaaagttaaagaagcagttcatgaccttaaagcatttagccaacttaatatctgacctgcataatttagactaaacatttttatcagtcatttttaaagctgttttcatttcccaaagattactaaagttacatgaaccaaaaggcattacagtttttattttacttttaaaatatttaagtgcttaattttgtttaagccaattagagctcttttatataagcattacacacaacacatatgtagctacacagaaagacagaagaagattactacagtagttgtaagatttttcatttgccagtttttaagtttcttagttggattactggctttagggtggagtccttggaagaacagggccaggaaaggggtctctggtgcctcctgtttttcccaaggaggctgttagagcttgaatatccacttttaattaaactgattttaactgtagcactctctaataacgtccttttagaatttcttatgccaagcagctgatatttctggcttttgaattttaccacaggtaacctcccaggtattcagagaaaggaaaatttaagatagtccgcggaggagaaaagaatagacaaggtcacgcagatattaaaccagaaacgacttacttcctaggtggggaattgaacccggaccgccactgtgaaagtgcaaaaaccttagctactgagcgatagatagcatggggcagtctccatttcctttcccagaaggagtctagagtagttcattttgagcttgcaaaggcttttaactatttaatatgatttttagagctaactatgacatgaaccctaaaattcctgttccctggaaggcattaaacgtggttaaaaggtcaagcccccaagggcataaaacaaggtggagacatcatccagtttttttgtttaagggacctgtattcaagtttgttactgaccaacttgctggcttgtctggaaaagtgggcttacaggtgttctaagcccgtgttttaccctgaagtacccctcgacacagaacgactaattcatagcacaaaatacaccagcttaagactagccttagaattctttttcgcattaatcaaagctttacagaggagataaacgctgattttttttttaaaccattcatggacccgtttgcacagagaggaagaagccagaaatctgactggaaagaaattcttacccttttgtcagcatgccaggcttctggattccctttccctgagcggccccagtgatccagcttgcagcaccattgccctgggggccaagctgcatcataaaggaaaattattttttttcattctggccagagcaaaatacatgtaataaaacatagacattagccactttgcttagcacccaatatcaaactggcaaggcttaaatttgccctcagatgggccccatcatctttaatccaacctctgacttagagtttcaacatgtggtggctgggcagggtggttgccctgagtaacagaaaagaaaggaaaggaaaagtacagaaggaaagtattgcctgtggcagggtggggaaggtgaagagcttaggaaggtcaggtaaaagacccactcaatgcagccgacaatgaaaagttcaggcggctgctcgttggttgcaaacggaccttttctagcagtcccatcagctctcaagtttccccttttaggaaggaaaaaactcctcatatcccacgatccagtacatgcctaaccctgtcatccacagtcatcagcaaagagtgcaaggcggattaatccaaagagaataacagttaacatcccatagtgccaaacctattcttatccaaggactttaccgagaggggcctttaaccccctaaatcttagaagggactttaaccctcctaagttgggcctctaacccaaggtcagtcaggcgtccttgccttttattaagaggggactctaacccactctgtcttaggagagactctgactcccctaagttgggcctctaccccagtctcattctttaccaatctcattctttacccgggtaccccattacttacccaaagttgtccaatcagtgctccagtctatttcctttgcgtcggagggtctcctcagtattgtcccttttgtggttcgagagaaagatgttaccagaccccaccacttacccaaagttagcttttgttggatcaggggtttccgaagtatagtcacttctgtcattgccagaaagatgttacaggaccccaacatttacccaaaggtagccattgagtcagggttttctcactatagtcccttcatgatctccaggaagatgttacaggacaggggtcctgatccagactccaagagagggttcttggatctcacgcaagaaagaattcagggcaagtccacagtgcaaagtgaaagcaagtttattaagaaaaaaaggaataaaagaatggctactccacagacagagcagccccgggagctgctggttgcctatttttatagttatttcttgatgatatgctaaacaacagtggattattcatgcctcccctttttagaccatatagggtaactttctgatattgccatggcatttgtaaactgtcatggcgctggtgggagtgtagcagtgaggatgaccagaggtcgctcttgttgccattttggtttcagtgggttttagctggctccattactgcaaccttttatcagcaatgtctttatgacctgtattttgtgttgacctcccgtctcatccaaatgccttaaccatctgggaatgcagcccagtaggtttcagcctcattttacccagctctatttaagatggagttgctctgactcacacgcctttgacagaatgagaccgagaggtaggcaggggtcacagtggggattgagagaagtggacagattctgggagtatttgagaaatggaattcacaaggacttgggctgaactcaatatggagagtgtggcagaggagaggcttcatgactcacacaccgtgatgcactgtggtgctcttcactgaaatagctagcattggaacagcaggttttgttggggcttgctgtgtgactaggagggataggggcggcatgagtttggttttctgcctgttagtttgaggtggctttgctagatctaaacaaagtgttcaagtagtcacttgtattttcttgtctggagtttagaggggagagatatgagctggaaatatgaatttaggagtcatctacgtaaatattaattaaaacttctagcatggatgaatgaaaagagagacaggcctaagactgggtggacattgaagaactgtgtggatggcaaggtcgaaatgggatatcctatagaaataggtttctcagtgtgagtggagttcagttttgggtgtaatgaaggcggagattacttgagagacatccaagtgaatgaagaagtcttttttctttttctttttctttttctttttctttttctttttcaagacagtgtctcactctgttgcccatgctgctgcaggggtgcaatcgcagctcacggcagcctcatcctcccaggctcaagctatcctcgcacttcacctcctaagtagctgggactacaagcatgtgccaccacacccagctaatttttgtattttttatagagatggggtttcaccatgttgcccaggctagtctcaaactcctgggctcaagcagtctgcctgccttgacctcccaaagtgctaggattataggtgtgagtcaccacacccagcaagaagtcttataagttgtagtaggatagttttgagtctggactgtgtctgttttatgggcttgtattcctcagtccatacacaatgcttaacacatagcaaatactcaatgaataatttgtggaatgggtgagagaacataggaacatttaaagatctggactgaaattctctacccttgccatgccaaggaggcccttcttcaggtgtgtgctaaaataagcttctgactgtatatagaattttattcagtaaaaatcaccaagttagatttctcaacctgctgatgtattttatttaagtgacagatgtggaattattgcatacattttgttccgtgacctagacagaaagaaaacccattatcaacatttcccaattgctagtcaccacactgctagttaatgggttggtagatacacactggagggcctactatgtgttacaccacatgctaagcacttcaagtgtattattttattccttacaacatctctgtaagttatagataataacctttttttttttttttttttttttttgcaggagagaaactgaggatcaggaagttatctaacttcctgaggtttttttggacctcactttcctgaggggttttggagaaaaggaaatcttgatcaccttaaacgccttttctctgatttcagagatatcagcttctgagctgcaatcctcatgaccttttttcccttgctaatgcccaatacactattaatattgattctttcatcaaaataaacaccaaagcccaagtaatgagagttctggacatttaaaaatcatgtgctcttttatttttcatgtaaaaaaaaaacaataagcattcatctatctggtcatcatacttaagtgtgttttacattttccgaggatgagtgaatttttatgagtatgtaaattgaacatgccagatcacatttgggagaaatctgggatgcctcctggaatgctcctgaattctcacatatggattaaatgctatctatatatgggctacaggcttctgtcgctttgtgaaagctatactggcctttgaacataaaatgaatattggttaaacaattcaatgaaataaattttttaatggaaaattttaatcttatctgatggaacatgaataagtgaaagttgtactcattaaagatttggagatatgatttatgtatcatatatattctgccctgtacacccccacacccacctctcttttggcagcaggctctattttgcatccattcgttgttcaaacttccaattctcatggagacttcctggtcccatgaaaggtactgctctttttatgccaaaccaactctaaaattaagtctcttcctgtggatccagttatcctgtacttgttcattgttcttttgatcattcgtctttctctggtggtgactcagaaacaggacttttaggtctctgcttcatgctgtctgccatgctactgtctgccctgctactgtgagatagttaatccagcttctgcgtaatcagaagcttaagagcggtgcaagaaatcttagcaacatgagaatctttcttcatgcaggcactgtgcaataaattcaatcattcaatccttacaagacccttatgcagtagatatggttacttccttcataattccagaactcggtagagaaaatgaccacttaggaacaaggggacgtgagtgaggctgacaatgctcagggtctccaggacaagtgattctctgtgtggtgggctaagagatttccctgcattcttcatactgcttcaaatttctaaattgtgcacaataaaaatgtgctaccctcatcaaaaataaatcttttataaagaaaggaaaataaaagttatatgtactcaggatatttggaaagtgtataaaattagaaggaaaagagggctcgtgacttaaatgtatgtgtaaacttaacccatttggtacattacatttatttctagtcttttcatgtgtgacaattgaaaatttttacatagtatcatcatttctgttttttctccataaaaagtgagatgccagtattcatatcttgatggactataaaaattcccctttcatcctcacctttgcctgtgctgccttctcctctagtcttgaattacaatctttgacacatgtgcattgcctagaaagccctatttggttaacagatatcactgtgaaaagcaagaacacaaaaagaaggttattactttccctcttctcattaacacatacctcactaataataccctttgctggttgggcatggtggctcacgcctataatcccagcactttgggaggccaaggcgggtggatcacgaggtcaggagttcgagaccagcctggccaacatggcgaaaccctgtctctactaaaaatacaaaaattagccaggtgtggtggcaggcacctataatcccacttgggaggctgaggcaggagaatcgcttgaaactgggaggcagaggtttcagtgagcagagatcgtgccattgcactctagcctgggtgacaagagcaagactccatctcaaaaataataataataataataataataataccctttgctttcttcatagagtgattgagtctacacattcatatcttcatttattcaacaaatgtttgttaagtaccttctaaatgccagtcattttactctttagtaagtatggagagataatagaagaatccttgctctttagaatacagatgcagaaataggaaaaagcaatatgattagtgatatacagaaatattgaccaaattttgtaagaccacaaaggagaattgcttgaatttcggagatccaagctattctcctagagaaatcaaggaaagctgtttttccgataagaaaatggagctcaaagagatttggtctaagaatttgagttagcattaaaaccagttgtgtctgcaaaatccctgttctttccaccaagctgtgtcatgggaagtgcccctgtttccattgtgttgtaaactctgagatgtctgtatcggggggtttcctgaggcagggaccagagctgccccctttcttttctctccccatttcaaagtccaccagttttttatttgtttaaagaataatggacaagaagtggggacaccagagttttcaagaccagctttgcctctgtttaattgggtgatcatgagcatgttatccctcttttctctgcctccatttcccatctgtaaaagcaaggaggttgaactaaatctaactttttataagtaatatgtcatggtttccttcttctcatcaaagtgtgtcatatttccataggtgattgggttctcaagtgcctcaggaagtcttgacacactgtggctttggcagaggaatgggtgggggtcaagagggacagctcttggctgcctggatttgaatctcagccctgtcacttacatgctgtttaatcttgagcaagctacctaatcctattgaggctcagttatctaatttgtaaaatagaaatataaatgattcatttacaaagttgatgtgaagtttcagtgagcttatatatctaagccgctttgcagagtgtctggcttatagtactcaataaatgtagctaatgatactgctggtattgtactagtactaatttggagtcctgaagcagttttagaagtcaaaatatcacagtagcttcttttactaatgattcctttataaaagcaccaaaggaaccagtatgtccatgtgtagaatatagaattttagtcattatctcctcagattttcaattaaggggtcagaggagttggagcactatttactgctagactttactgatgacccagaagaggcttctattcatcttgtataatatggcaggaatcagtcttcttttccttcctctgttcctgatgctcaggacaggccacagcccaggggggcactttacaaatgtgttttgaatgaatgatttcacacttcatatttaagaactggggagaataatagcacttggcagtgaaccttttgcatctcaaatcttagcctgtgatatttattgaatttgttttgagaggatttggggatgtcccttaacaatcaaagcagaattcttctgatatcattgttggacttttctgctttgatcaataggcttattatttgcccctgaacctctgtgatgctggagaatcaaacattcctcaggttgatttacatggcaataaataatctgtgctgtctgttgcttgttccatccatgtctgccctgttcataaaaccctgggggctcagtgacccaaggttccaaggttggaacacagtggacatgttgactcccattacagttgtgtgtacatagaacatgctgctcagatgcattgttgcttaatatgcatccacaatttgtgtttaaggattggtgcaactataagttagtttccatatgactttcttattatagttaccttcccatttattttttacttctgttacatgccagacactacatatattatctgatctaatctttacaatctctgagggacgattataccctttttatagaagtggaaactgaaactcgaggtgaagcttattctctgaaatcacatagccatgagccatggagctgaaatttgaactcgttctgaccacagagctctcttagccagtataccatgacattttcctcatccaaagtgctttcttttgcctctctaattgttctgtttttaagttagtacccggctgcagagatccaaaagtttcccatgccattcaaagatgaattttaaatatcttaacagcattacaaatacctgaaatgtaaagtgacaaacatagctagattactttcttgttatcaatccatttagcaaatttacagtttccattaattttaatttgtccttattacttgttttttataataaatatctcttagtcatgacagactcactgagtatagatcgcctgaagtaggctccctctcttgcaataagcagagttgcagctaaagatttgtgaattaattgggaaaattgcaagtcaggtagtcagtgaaataattcattgtcacatccagtcaataaacttggtaaatcaactcatttaattcaaaaaatgatctatatagatcaaccaaccaattaaacaattagcatacactttgcaattaattaatttaagcatcaatcatgtaattaaaactccaaacttaagctgcagaatttagaattctactgccttgtgagctattgggttcctgcttctgaagctagcataattctgaagctcgcaggtttgcggtttggagcaattgaattgattgcactcttacactgtctgtatgttggtatagtttcccatcctctttgaacagatcaactttttacttcccccaaagagggtatgtgttgattctaaactgggcaagactgcaatctgggagtactgtctggacattctagggagtgggaagtgtgcagaagtagtcaagaggaccaggtatctgtgtcaggactaatccagtcatttgcttttactctgctaaggatccatggtgtttgaagtcagattctaccaactgacttagatactctttagagaagggagaactgtatggattgtcttggttaccttgagtatttctcctgatctagagcacaaatattttcttttttaattttaattttatttttttgagacagggtcttaactctgttgcccaggctggagtgaagtaacaccatcatagctcactgcagcctcgacctcacgggctcaagtgatcctctcacctcagcctcctgagtagctggaactacaggcgcataccaccatgtctggctaatttttgtattttagcagagatggggttttgccatgttgcctagctagtcttgaactcctgggatcaagcgatctgcctgcctcagcctcccaaagtgctgggattacaggcatgagccaccatgcctgtccagatattttcttaatcctaaccataaatcaaaggcctctgacccctgccttccccgaggccagataatcttcccccctttacagttttgtttgtatctgttttatatatatattttttacatttgtattgtagctagtgtaatgcttattacttttcctccctactatgctgtaagctgcttttagggctgatactaaatctcacctttgatctaagaggttaggttctttgtcgtagctgcaatagggctcagtgaatgttgcaagaatagagtagtataaagaccttcatttcacactgtttttctcccctttgcattgccatgtgtattctctctatcaaatgaagtaggatttgggattttttactgtatcaccaggcttggggtaaagaaaagcagtctcctcaatttgcttgctgtgcaccataccctctggtcttcttgtcccttccctaccttggtattcactcgcctttttggttttcctttcagtgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaatgtgagtactgactctattacttctctcggtatctcatcccaaccttctagcattttggatctgattttggttttgttcatcaaataaatgatatttggcatctggagagtccactggtaataacgatgactcccagagagatgctgaggacgacattcgcattgtatttcatgcctctgcacctaggctacgcagactgctttgcagtggcacattgtgtgaagcagatctctgaacggcatgtccagagccaggcctctggaaacactggtgcactgggagcctgtgaagcaaaacttctaggtttgcaccttctctgcgaggaatacacactaactgaaaatgtgcactgtggccacttctctcttgtgacttaaaataattttctctcagaccaaatttgaccttccctgtcagttgcctgccttgagactgagcacatgtcttcagctttttttttgtgcctttctcagaaaagcgtgtgtaaatgcataaaataaaatccactggaatataaaagtattctgttatttaaagttatcagattattgaacaaattcatgatatagtaatatgtgtggctttactagtagattaaacaatatccagctgtatacctaacagtaactcctgaagcctgttgtttcaaagcggtgatgagcataaatggtatttgagaaatctgcaacagctgtaatgtgctgtagtgttagctatgacttctgttcatgacagagtcactggcactgtgattctgctgtgattgtttgcctacacttataaatcaaggaaatgcaaaatattagaagttagtgaaaattaaaatgtagtttttatccattcaagtttatgagctcctgagttttatccacatgtcccagttgttaagggaaaacctgctgcatttggattttactctcaaacctaagctttttttcaacctaggcctcagcagtccttctcatggctgtctcctgggaacaatagcgatccctttggcaccccctgctgttagtaaccagcaaattcactgctcaaaagggattgctttagaagacatttccctgtctctctcaacatactgcctttgtttgagattgttacagaaaatagggttatgctacatatgatatatgagtattttggctctttctacccttgagcaaagaaagaataactgagtacctgggggtaagctggggagtgggccctcaggctttcatggtggccgtttcatccctactacaaggtcaagtttggtgtaaataacagcaaattttttcctgctttttcatttcagaggtactaaaataactttaaaggatatttaaaataattgaaaagttggccaatgatgcctccatcttaactatttttaatcttgtataataatcgtgtgtatatgttactcagtttcacttgtagcacacatatttttgtgttatttttacttgacattaaattaggtcaggcgcagtggctcacgcctgtaatcccagcactttgggagaccgaggcaggccaggatttgggaggccgaggagggtcaagagttcgaaaccagcttggccaacatggtgaaaccccgtctctactaaaaatacaaaaattaaccggatgcagtggtgggcacctgtaatcccagctactcgggagtctgaggcaggagaatcgctggaacccgggaggcggaggtagcagttagctgagatcgcgccattgcactccagcctgggcgacaaagtgagactccatctaaaaataataaattataaacgtttcagtatttgttcttaattcctacagtctgtatttatgtgccagagatctaggcagagacagcactaccctcatggagcttactatctagtagtgagacagttgtcaaataattaaaatgtgataagcagtataaaagaaaagtgtatgggttgtagtggaagccgatcacagaatatttagattgcttccttgtgtggttttaataagtaatttgatgatgatggtcattatctatataccttttattctgttgaacaacttccttaggatcatgccttgtaagtaggattattggtcagagtaaaaacatctttagactcactttttattgacaatagccctctgaaagatgtcctaatttacaatgttaccaacagaattcctaaaatcatttttatagttttaccattacaaggtattagaagtttttttttctactctaaaagatatacacagtggcatttcgatagtttttacttgcatttttattgattattaatatgactagaactttttctacatgaatgttaacacatgatcatagcagtcttttgaaccagaagtccttttttaaagcaagaggctttaaatcactgagttttcagtagagtggagtggggctaggattcatatgcctttccaggaggggcatctaagactacacagtgtttcactatgaaccctgccttctggagaataggaaggagggggaaggcagagagtaacaactgctttaaacttaatactctgttttttgatcctgaattactcccatccctgtgttcccactcccagacacacacatagcccagtcaatcctttttctattttaaaattcaagagagtttatttgatgtgtctggagtgtttctgaaaacacgaggtaaagtgaaatctttatatgtgagcattaagaacaaaagtgtcaataaattttctttttctcagtcgtctgatgaaatagtacagattactgaccgtttgccctgtgtgtattttcttggttcagcaacctcttactcgcctttctggtctatattctaagttagtaaagcttctcctacagatgcagaacagagcagaccttcaggagtctgtagggatgtgtctaaagtttcagagaaggaaatcccagcaaaataaataaagccgtaactactcctcctcgtcatttcccccctttcctccttccatttgtctcccagtagaggagggacaagaagtggctgggaagacactaagctgaaacagaaagaggcaagtaggtttgacatagggagtgaactaatacttactaagggccaactatgcatatgctatctcacttaatcccaaaatagcccagtttttatgaacaatttagaggcgtggaacctgagggtgagcaatattgttcttaggcctggatttgacgccatccctgactttaaagtccatgccctttccaaccctctgctgaaagattgaggctggggaatctggtgttggtttaacctgtgaatctcactgtcttaaggctgacattcagccactgctatagtgcagtaggtgacagcatggtgggctgtgagccagatcgcttggatgccgatcctagccttgcccttactagtgtgtgtggtcctggatgaatatttaacttttctgtggctcagtgaaatggagataataatacctacctcacagatcagttatgaggattaaatgagttaatagatctgaagcacttagaacagtgtttagcatatgtacgcatcatcttagtgttagctgctgttattgttactattaataaacaacccttggagagcaagaactgaattatctgtgcccacaatactcaccatcactccattactgtgatagatctgtcacacgtatttcttgaatgggttactgagtagatctctgccacttctacatttttcttctccgactttgttttatagcagaggaggggtagtgtttaggtggacattgctcagctggactgaaaaagctgaattggaataactttcagtgaacatgggcagtgggtaaacatcgaggatctacatactttcaaatgagtcctcttatgagcacacatcctctgagttagtagcaagaccattaacttcttgaagactaggaaggcacagtcttattgtctctctgtatcctgagcacccagcacagggcttcatggagaaggaatgactgaaacttcaggtgtctgtgggctgccaggaggacacctgacccagcagtgtgtcccaccttgctttctaagacctcttccccttttttacacccgttcctgcctttcaaataccaggaagcccatgtcgccttctgacctttagaggccctcacaccggctattcccggggctccagtaccatctttccctctaagtgcggcagcacagactttgaatttaggcaaacctgggttcatgtttcagcttcaatagtatcttgctacatgcatgaccttagacaattttacttacctttgttaagtctcagtttcttcatctttaaaatttgggtaacagtaactatctcatggaattgtcatgagggagtttcttaaatgtaagttatgtacagaactcttttaaagggaaataaattctcctaaagtctcaatgtttatccaaatgagttttttaataatgctacttagatacatgcaaatacaaagttctgtaatgtttagctataaattcagtgtttttacacaacctaaacaaaattacaaactaaatacagataaaattataacgttaataaaatacaaattaacaactttaatgtaacagatgatgttttgctgaaattaaacattgctgatgttgggtttaattgggtgttaaatgttttacttgtcaacttgagtcttttgattttcatatgagacatcacgattaacatccttttaaacagtgtatttttaactactcgtccattattttagtgggccaattgatttataatgtgtccccccacacaaacacataaattttaaatgttctttactagaaaatgctttttttttttttttttttttttgataagtgtcttgctgtgtggcctagtctggagtgcagtgatgtgatcatggctcactgcagccccaaactcctgggctcaaaggaccctcctgcctcagcctcccaagtagctggaactacaggcatgtgtcaccatgcccaactaactctatttttagtagagacaaggtctcactgtgttgcccaggctggtcctgaactcctgagctcaagcagtcctcctgcctcggcctcccaaagtgttaggattacaggcatgagccaccgctcctaacctagaaaactctactttacgtttggcccaccacgctttctgttagtatgatcagtttgtgatggtttgtccaggactctccctgtttcaaaactgaaagtcctgaatctatgagcactccctgatgctcacctccaaccccttcctccatcctaggtaaaccagattggtcactctactttatctgttgcttggtctatacataagtgggctctgcctgactgatacttgtgtatagtgtgacttggcaccaaacagcacagatttttcagagaccagcaagactgttcatagagatctttgtgcccactgaattctgtcaccatttttctctgttcagcaaacaagttctgtatgcagcttgcagtaatgccatttgacttttactaagtttgttagttatgttaaataactctagctgctggaacacataaccccccaaatctcgccacgttatcctagggttggcaaactttttttttgagatagggtattgctctgtcacccaggctggagtgcagtgacatcatcttggctcactgcaacctctgcctcccaggctcgagcaatcgtcccacctcagcctcccaagtagctgggactacaggcatgcaccaccatgcccaaatactttttgtattttttgtagagatagagtgttgctgtgttgcccaggctggtctcaaactcctggactcaagtgatctgctgacctcagcttcccaaagtgctgggattataggcttcagccaccgcttctagctcagcaaactttttctgcaaagggccagatggtaaatatttaggctattggccatagagtttctgtaactcagcactgccattgtagtgtgtgagtagccgtagactacatagacaaatgggcatggggtaggtttgttggtcaacttctggattttcccaataagtttctttctttctttccgtcttgccctcccctcccctcccatttttttgggtagagtttcactcttgtcacccaggctggagtgtaatggcgtgatcttggctcactgcaacctccgcctcccagactcaagcgatgctcctgcctcagcctcccgagtagctgtgattacaggcacctgccaccatgccctgccaatttttgtgtttttagtagagatgggttttcgccatgttggccaggctggtctcgaagtcctgacctcaggggatctgcctgcctctacctcccaaatcctcccctgggattacaggcatgagccaccgcgcccagcctaataattttatttcttgttcacatttgtctgatgtaggccaggtgactctcttgggtatttctcctctaggcagtggctcagggctccccaggtgggtggaaaatggggaacatggaagatgaggagtgaggaggggcctatatctgtatctttatctcatacacccccccacacacacacagtgacatatataaaatatgtggtgacacatataattttgcttttagttcaatgaaaagcacatatagatatatatagctacacatccatatcatacatatattgatatgtatagataatacatctctatatgcttttcattgactaaaatcaaaattgtttttaatttaaaaaaatttttagagacagtgtctcactatgctgcccaggctggactggaactcttgggttcagacagtcctcctgagtagctggaactagaggctcacatcaccgttagaaaacaggtttttaaattctgaaacttagtctgtaaattcatctgttgattcctgggggctcttgaacctcaggaaatgctgctgtgattattaatattagctgagactctggcatgtaggaagtgttacatagttgctattgttatttctgtcagggattctcagtgggaataatttacactaaggtgagaatggggtttaaccttcctttgagttattttttattatataattaatatgtgtccattatagcaaaattgggaaatagatctgtttctgcatataaaagaaatttttaaatttgtcttcattccatcatgcaaaggttgtgaattatattttataattatttacattttttaaaggggaactaattaatgaatttctcattggaaaattattctgtggagggaacgtgaaattggatgtcttctgatgttcttactaaatcaggactagatctatctagctttccctctagaacccctgggccccaggaatcccctggatagagttgttgttcagggaaggagaatggattattctaacaacttgcaaattaggagcctggtaatggaaactgcctcttttaacaaatcttcaagtggattcctaagctatccattgttcctgattgattttggacagagcaaatatatctataaatgggaatccctaacttgctgactactttgagcttaagcagtaaagatgtttggatatcagtagtgtcagagaggagaagtagggagtgggaggaatgggaaggtttttggctgacccccaaaaccagataaagagctggagctcagatagtgcccagcatctcaagaagtgtttcttgccagcagtgaccaagccaaagcctactgttcctttagacaaagtaggacaagggagaatgagatcttgagtgggctaagtgcctctcaaggatagggacctgccttgttcgtctccttctcccattcccaacacagacctaatttagtcagaatttgtgagactgaattgagttcaaaagtggcaatgacaaaaacaactgtggtagtattattaccttatatgtgttgacattaaagtttcatgccaggattctactctggagtgggggaagaagggcattaaaggaaaaaaaaaaaagtcaaggccaataaaatggtcagaatctccttaggttagaagtcagagcagttaaactgtctcctatatatatatgtattttcctttaaatatttgatatattagaggaacatgaggaaggaacagttctaaccaagagctctttgggtaacagctgtcaggtaacagtggaaggtcttagcccagaagctgggctgccttgggcaggctcccagagactaccttggcttctcttggctctgcagaaagggaacgatgagctgcttttttaaagaggcgtgccctaggttcattcatgctctttactgggcttttcagaagagtggggagttttagtttaccttcttgatgataaatccacagtataccccaagtgaccagacctttattaaagggtgtcattagcttgaagcctttccttctgttatatgctattgccttgtggtctagagaatgaaaaaaagaggagggcagggagaatattttcacacactcattcagtttcatacctccaatagatgctatctcatttatttctttttttatcatttatttcttttttatgatattttaaaattggccacaccccatcagtaaagtttcttatacgcaattcacttttataatatgtaagctgaggctcagagacaggtagttagttactaattcaaggccatgctgtttggtaagaggcagagctaaaatagaataaggaataaaagaagatgcttgtgttctttgtaaccaggcctgacaaaatgagtataaattatcctggttatttattgtttgcttgattcatagaggaccaactgtgtgttgtttcttttcattctgttgtattagcaaacattttcattgtccagattgtcctcgtgtatggaaatgtaacatatgcagcctgtttaattttgtatttgtaaatctgacttgatttcctttttggcaacagctactgtctagagaaaagaaaggatttttctttgtgtctgtttaaagtgacagaaatattggagcaagtgataaagatggaaagcattaattacacacttctaagaatttaaaggtcagacaagctaaatatgtatgttttgctcactggaatgtcttgaaattgtgccaggattcgctttgttcctaccataaaagcacacattttagataaccatcaacttactttgtatctaaaaattatgccagattgttgctttagttaatatgtgtcttcaaagtcggggagctcccatttctgagcccatgtgattggtttggtgatgcttccccctttggccatgtttagttactatgtctcattttgatttcctctgttctcccctcagcttatgtcggagtctgtcagctgctgctatgtacatgtcaggctagtgacttggaatgtttattaatacaatgtcagtcttgctgttgaaaaaaactgtgatgcttctcagaaggttgtgatagaacgaagcgtttgatttccagatcctgtctgcactgcatggtgaatacattctcagatgttatgcagttcactgacctgacagttatggaaccccgcctgggaccccatttcagcaggacatatttgaacagaaacagtttgcaaaactttacacacttaaactcctgccaaggcaaactgttagccacttgagtttgttataaatacccagtggcagtggttggaagtagcccacggtgtgttttatattctgaacggaatgtgaatgtctttgcagttatatagagtagtaaataattgagtttgattagggagagggacctcattatcccccacctgtgcccagctggaaggggagggtcgaaatgaagccattagctgtctctcttactggcatctcaaagagctcaaatacatctgtgtcttattttcttttctggcacaatcagtcgagcaagctaagcaggcatgaccggatttggcaagtcccaaggactctggcaaagatacacaaggagaaggcggagggcagtcattttggcttctcactgcccattagtctagcgagttatgtttttggaaaatgtctgttttgaaaaagagtactttgtccaatgtcaaacatcgcatgctcccacagtacgctttgatctttaaaaaaaatttttggtcagtctaaggggaaacaaaatgtggcattcacactagtgtaaactctttatggataaagtcatactcagaggacttattttaaagcaggcatgctgcagttattacaaggccttctcttgctcatatattttcattttctaccttgaaatgctggagaatgaacatgcatggaattggaccagagcaggttgggaactagagtgtgtcttcatcactattgggaactggtcaggaccagagactcgagaactgctcgtagcaaccttttcccacttctgcaaactgagactgtggcttttgaaaccatgacattctccaatgtctccttaaaaatcctgtaggtcatatggttagtctaagagtctggacattcatagtcaagctgaatttgttacagtggaagttgaaccttttccacagattgggtcagtggttccggtatggaagatgtgctccctggaagtctcttctttccccgagtccctaagactccctttgcggctgtggagggattaacaaacacagacttgggagtctagctgatctgggttcaagtcctggctccttcaggacttattagttatatgatgtattaacttattatataactccagacaaatgtctcaaccttgccaaacctcaattttctcttttataaaatggaactcataataacacctatcttttctaggaggattaaacaaagtaagtgctcaataaatattgaatattattgtctcatcattatatattacttcattgtacatatgaagaaaatgcttatgcttattatatattaactgtttattaagcatttatctttttttaactaatggctcatctataagcatttattatatgacagatattatggtaagtactttagaagtattttgcctttacaacaatcttaaaatccaagaataattatcatcctcattttgtagatgaggaaatgaagttaaagtgattatgttgttatccgtgaaagcagaggtggggttccaaaccaggtcactttattctagagcttactgtgctctgctgccttctggtgctgccaccgtctctcctagcatggtttagagctaaatgatgtttgcgttttgagacatcatccccactaggaagcttcccggaccctctcacctctgtgtggctgggttacgtgccctatgtttgttttggcagcactctgaacttgcctccacctttgtgactgtcacacagaactataattgtttgttgacttcttatctttctctcccactggactgtgcagcttgggttagggaccacattgttgatttctgaatccaaaacaggatttttaatagatgagtgatctcaggtaaattccctaatgccttcagcctcagtttctataaaatgggtgtaataattgtacctattttaggattgaatgagtcaatacagatattttttaaaaagcttaaaacagcacctagcccatagaaagtgttcaataaatagtagttgctgttataattgttaaacagtggacaacttgtattgtgcaaatcaaaaagttcttaataaatgttgttgaaattctctacaccaccatgattttttaatttccattatcatcatgcaaagccagtgaattaagttgaggcagaacatacctgcttcatagttaacactttcaaaaaggaaagttttgaaaacaacccagagtgctccccttggagctcttgggaaattttggtgcttgggccacaggctactcactgataatgcccctgaatatggccaccaagctcaacaaatcacacattttaatgcccctgtgttaccaatgacaggcagtgagttttgagactcccaccccccgataagcagtctctgcttaggaggcaggggaaggaggggctgaagtggggccttttctcttggaatgatgacttagggcaaggggaacaaaagagaactaacgtcgactccctttactgtttgccagccatagtgtgaggtgcttggcattcattgtctgtttcatgcttgtgacaattctatagggaagtagcctactcatttcatggatgcggctgaggttcccacatgttacagcaacatctccgttagccacggaaccaagatttcggtcaaagggtatttaacccccagcctatgccctttcctctccagtatgctgccttccaacttgagttctggttccagctctgttcctaaagatagaatctaagcttttcagatgaagacctgtgtccctgtgggctccgtggctcccattgcctctcgcttactgcttagtacagaaagcctgcttgcgttgggttcgtgctggcatacaaacttttttggggtaactgagtggctgtgcgctgggacggagctgaactcctcaagcaaggagtctctttttaaaatgcccatacatcgttcagtggttacgagacttgacaggacctaactttgaattgactgaagcactcctggcagtgtttcttacgctccctgacatggagtttcaccctagacccagcatggacagcccaaggagccgtgggaagggcagctgctgcttctcagtgtccctagaatgccctgctctgggggaaaacaggttgtctgtccctgaggcgagcaggaggaggagcggtttctgagccgagactttgagtctgtgtgtagcctgcctgttcatccgagggctgatcaccccgccacagctcctaacccagagactggagcgtgtgccacagggaaggcaggccaggaccaggagcacccttcctttcctgcccactaccagcactccccccaggaccattgtcttctcagcttcaaacccagcatcccacattaagtaaaggctttaaaagatgtatttcagtagactttttagaaagcccataaaaaatcctggatataaagaaatgaggcataaaacccagaatgtttggaagtcaagctgaaaattgtggtggcaagtctccatctccacttgttaaatgggagcataacttaacacttgcacctagacggaggctgagaaccacttgcattctatgctcttacgttttggaaacatatgagggtattactcaaaaaacaaaaccctgcccatctccccccaaagcgctgtagacgtggaacaagatccaaagttggcattcgtctggagggaaaggagcggagcgtgggactgacctgaggaaactcttattaggtctgcctgaatgtgcagcactcagggcagaacctctttctccttttaacgtgcacgtttttacggaaatggagccccagagtaagatactgcacactcacgaaggtccattccgagggccgtgtgtgccccttcccttcgctgttgttttcattttcctctcatgaaccttgctaccctggcttcagcacggaggctgtaaaggaagatggagagccaagttacctcagaatgatcactatcgttaacattcacgggtggttcacttatcattcctgactgcacagacatggcagccgctcggaagcgtccgcaggtgtagcatggtgatacatattacattgtgccacaatggatttatgtattctgtaacaaaagaaaagtgtaatgaaaaaatacagaaggtaatcctttattcctccaccacacaatttatcagtaatgcctgtggatgataagtgccagggatttcctctgcttgctttaaccttgtcacccaggtacgttttggtaaaatgacagaaaaatacagactggggattttcctctgctcaaaaatcttttaaaaggacacttttaatttatggaaattagtccaaacacaaggcttccttttgagcttttagtctgcctttgctgaaaaagataaacgtattggctggaaataatgctgtcagccggcagcagattaggagggaacgtaagcagtttctaagcagactgaaatctacagtagttcctgtagaaccaggtggatggcagttcatgaggtccaggccagtactagtttgtgagtacccgagaacttgtgttctcttttaggccctactcatccatcgcccaacatattgtcacagatggagcgcatactgacttctgaggagaaagcaagggaaggcaaatctgaacgtggttgactggcatttgttccaaacacacactggcctagcgccagagcaaatacccccaagtttataaatgcacaaggcactttacgtttcagtactcttgccaaagtatcacttactgcatcgctccctaaatatagttttttaaaaagagctttttcttattttgctttgatcagtaaaataaacttttaaagattgttctgggatgcggtccagcttctgaggtaaagaatggccgggactcaggcatgattcagtaacagagtgttcagtaaaattagcttgacagttctcaggcctgctgttcaatagcaagaacttgaccaagttaaaatggatgatggtgctggccagaccagcatcggcttttgctttttaacaaatggaatgtcaaggattaaacagcaagccgtatggagaggagggttgtggagatgtctctgtattagggaagcaaattaggtccttggttttgagatcggcccccagcccctgtggagagtcagccacctagttgggtccaacctaggcttaaggcccttcccagcctgtcctaccattgggaagcttttccagaacttagcttggggcttggcttttctttcagatttctcgtcaatatgaagttctgccatgttttttggccacattccctttagagattcttatggagaaatgggaatgcgaccaaactccttgtggcaattcccatgttccatagttggaaacttgggtcccgtttgttacatgagctacttggaattggtctgttttgttccagtgcccaagtgtagtgagtagtatttgtgatacttgctattgcaattaacagtcttggtgaagttatacctcacacaggagatgggcttctgtttttagagtacttgttccttagcggtttttttccaatctagatgaagcctttcccccacccagtttgattaattggaagcttacaaggagtgtaagtgttttgtcttataattacttgtgcttcagctaatattttgactttctaggactaagattaaatcattcatactgaagtgtatagactgtatttaaaaaaaaaaatacagccaggtgcggtggcttatgcctgtaatcccagcactttgggcagctgaggcaggcagatcacaaggtcaggagttcaagaccagcctggccaagatggtgaaacccatctctactaaaactacaaaaattagccaggcacggtggcaggcgcctgtaatctcagctcctggagaggctgaggcaggagaatcgcctgaacctgggcagcagaggttgcagtgagccgagattgcgccactgcactctagcctgggtgacagacatctcaaaaaaaaaagtgtgtgtatgaataaagaaatatatttactagctagttagagcattttcttttcctccttctcaattactttggggtattactgccctgcggccccacatgacgtttttttgtctggggctccatgagcttagtatgatggcagtatctgcctgtagtgacatctactgacacaagccaagtttatcagttgtcaatccttgttgcaagatttggtttggaagccaacactaggaacccatggtgctgctgacccacacagaccacttaggttcaacttggacaaattagaagaaccttccctaagcgtgacctctctcacatggaactgctcacgctagaatcgtttatcactgcccccccgccacccaccatttgaagtatatttattcaacctatttttaaataattggcacctcagtatgcacttactttaaaacttgcttaaacacggccgggcgcggtggctcatgcctgtaatcccagcactttgggaggccgaggcgggcagatcacgaggtcaatagatcgagaccatcctggctaacatggtgaaaccctgtctctactaaaaaaaaaaaaaaatacaaaaaattagccggatgtagtggcgggcgcctgtagtcccagctacttgggaggctgaggcaggagaatggtgtgaacccaggaggcggatcttgcagtgagccgagattgcaccactgcactccagcctgggtgacagagcgagactccatttcaaaaacaaaacaaaacaaacaacaacaaaaaaaacttgcttaaacacagtgaagattgcagtaacatctctctggatgaatgttggtgatgatttaatatttgtcttttcctacagaaatgctgctcatggattctcccttattcaggtggacaacacaaaggttaccatgaaggaaatcttactgaaggcagtgaagcgaagaaaaggatcccagaaagtttcaggtgggatagttaaatcatattctcacagtagtagaagcttaacccttattaaaagggcatagggggtgtgtgtgtgtgatggctggctagattctttcagatgtcattgctagaaggtttggttagctgatctatgcaagaaaaggtgattgtacactgcccctcggcctcagaaagggactgggtcagcggcatatgtgagaagaatgtattcatatcaattgtggaagttccttcattaataatttgtggtagactcagacagagctacttgtgctgatgatcagttgatataaagctgtcttgaaaaccgaatcagtcctaaacttgaatcactgctattaatttcatgttttcacataatttcccatgggagaacttttagttactaatatttgtggtatggggaagaaaagaaaaatttctcttcatccttatcaaatgagggcaacctttaaaaaaaaaagacgaataaaaagacaaatcacttgatgtgcactaataacttaactcctcattacccaactttatatagaaaatatgcttatagtattagctgtgatatttaaaggatatataccaggattgagaaataatcatcttgagaaatagctcaaagatttgtcatatcacagacaactttaatataaatcaactcatatatgacgtgttgaatatcttagctctgtaaataaagagacttcttaaacacctttgattttaccttttggaaaggaaaaaaagcattgctggggttgaagaaaatagttttgtgctctttttaaggggaggcatataatctgttccagatttaattagctatcttcagatgaaagctgaagttttaataaaagttagaagagataacacagtgaaggacacggatgagctgtctcaaggccatattccaggggaacgataagagctgtaaaaaatggcagaggagagcaattgaatggagcaatgaaaatctgattctcataaaaaagagagagagagagagatgctggtaggggcggttgtagatgagacctgctagcgtctgcaagcaatttggatgcttgccaggagtcattgttcaccctcggctgtggcggctccgtccagatgtgccaactgcacgtttcggcttttgccagctgactgcgccgtttgataaccagctctctggatgcccatcactggccgcagagatagaattaaatgatgatgatcttcccacaagttgggagaggaaacaatgcatataaatcttgatttcatctcagcatgagaagtctttatccatcatcactcataatgaacaagtcgttagctgggatgaatggtgttctggtttttccaaacacctcttttgttcattttttgggtgacttttatccattgcgtgggggtcaaacttctttgcatttaggggatgattgaagaggcacagccactccttcccagtgaaaagtggatattttggggttccaggtgccaatctaatagcttttaaacagctttagataatcaaagatatttagtaggcattcaccctttcggatcctggttctttactcttgttttggtcccaaatattttatataaaagtatatttgtgatataatgcattatattctaagaaggccttattctgaagtgtccaaggagaaggtgaaacttttttaagcttcttagtagaaattccactgtcacagatttttcagaccatgaaactcctatgaacttacttagatacagctgagcaagtatctttccttctgtctcccgtcgtctctgtccaattgcatacccgtttttctatgtccattcccagcgtttatcatacacacatttatttatgttcacctttgtgtacacattactgccttttccatcagagtctttgccatatccttggcaaagagttaggactcgttatctgaaaaacagtgatctgcgttatttattccttttcatacaagagaagccaattgagattgatacatttacataaattactgtccgttttcttaatccaaaaagctttttaacaaaagaagctctttctgtagctttaataagtctggtctcataaaacagaaggatctccagtttggtaaagatatttgtttaaggttaggttggtaaaggcagggtacatcttgtgtttttgaactttttagacttttttttggagagtgattaatgaaaagaggaaaatcctcttgtcatagaaagtaacacatagaaagtacttaaaaaattgttggtgttcacagttggctatgaaatacctgttagttacccattatgacgcatgaacttagtcatgaacttggtggaaagagatgccaggttagaggcagtcatcctgcacttcctgagcctctgtcacaatgaccagcttagtgtttgcaaaaatgtgcctaccatgccccatgtctgggaacagaattagagtgatcatccctgtcgtcaaaccccttttacctgattgagtacagaacagcacttgtctctttgctacccttactgaacgtcagtgaagaaggggggaaataccagttcaaatcaaaatacacatgccatgtagagtcagtagttatcacagaggttagttgtgctacaacaagatttcagaaatcctttgataggctgacagtgaacttgttccttgcccacagacatttctcttctcttaccttttttccagactgactacacaactgtttgtctgataataataataaatttagaacttaaacatttcattattaaatcaaaatgtaggcctaatggcagtcctaatgtttgctctcttgtccttcagtctggcactccttccccagttttcatttgtgaaaaatcagaaggtggtaggtatttgcttgagcaaaggaactcttctttgtttaggtaaatagctttgccaattgaagcccttagggtttcaaaatcattttgctttttaggatagactgtcatttacagacacttgtaactgacctaaaattttgatttgcattatttgtaattatttcatcaactcaaaactatgaacactgcatgggttttttttctattaatattcatatgaaaagaatatactatagtagtcttttcacagtatgtttcagtcaattctctgctaaggtctattttttatgcctatttttaaatgtctcttttaaagtttctcttcagcctttcatttttttttactgacctacttgacatttggaatgtacctgcattggcaggaagtccctactatttaagaaaattgtaattggagaatccagttttagaagaattagatgaagcctctttactcatgttaacagttaggtgggtgtgtttttgacatagtaaagagtggcttgtcaggtcccttgatttaggcagcaaaatatactaagctgttatttagtgaataaaggccttaattcaagttctccctctgtcaagcttaccctcacaatcagtgacctttgttgttatttaaaaatgcggttaaccatcagcccttcctagccttctgaagcattatgttgggcatgacagacacattgctgagaaatagatcaatttcaatgtttaacattgacacagaaatatagatacctctagatctacagaagagagagcatcaaagtggggtttgctaagcagaatagttttccacataacttgtctcagtagtctcattatgaaatagaggtgattttctgtattatctgtggaaagattgaacaggagcatcttaactttttcttattcctgtccattcttttgatatgaaagacaaatttttattagtctgaagattcttttaaaaagttcttaaaatattgttaataagcctagtgacattcattcctacttttataaaatttcacgtagaacttgaaagaaaaatgttagctttgtcaagtggactccctcctaactctatatctgtttagaattacagagcaccttattgcttgctaatttactttgttttcacaagacccctagaatgtcaccagtgagatagtgtacggggcttctcaaacattattccgccaagtactactaggagcagagggggagtaaacatgtacaacagggtttgggggttctggtctgagggacaatgatggcatcgttggactcttaagttgtatcttaaaaatttcatgtaaaatgtaaatatcgatccataacgtatctgtagctatgtcgtacattcacttatgtgctcccctgtgtcagacctaaggatgacctttttctagagcaagagtatacataagaggctgagagggagaataataggatgcaggggagctctctgcatcctatagggtgtttggggagcccctctcggagaaattgacatttaaacaatgaccttcacatttaagctatgaacagtttaggagtagggcagggacaatgccagtcaaagcagtggcttaccatattttaatgtaaaaagaacatttcagattactttgcagtttaatttacttaaccccccaccccaccaaaaaaaaaaattgtagtaaaattgaccctttaagggagataaagcaggttccctgcacagtaagtggcaccatcatctacccattcacctgagccacatatccagctgtcagtcttgaatttttcctgcactgcctccccacatcttatccattagcaagtcttatcagttttacctctagaatatatcctgaatccatttagttgtcttcgtctctgttggatgggtccaagtcaccatgactctccacctagactgctgaaatagcaccctggctggtttttctgcttgtgctcttggcctctctccagtctgttgtttacacagcaaccaaagagagattttaaaatatgagtcagagcatatctgctccgaactcttcaatgactttcagttctgtatagaattaaatccaaatttttaaccactgtgaaatacactgaggcccaaagaggataagagacatacagagagtatgaacacaaagaaataaaagaacttgaaagaaatggagaaaaaaatacagagttgatgattgccttatgacagagggatacagatcaggaagagaccctgggcactcaaggccatggggaggtgcggaatttagagcctgtgacccactgtggacctgctgtactagactggctgcagcagggtcagtctccataataccacacacagtaggccttactttcatgccagatagactgagaaagttgtatacagatgaatttattatttattaagtgtattttagtcaggcacagtagctcacacctgtaattccaacacttgggaggccaaggcaggaggattgcttgaacccagcagtttgagaccacactggacaacatagtgaaaccctgtctccacaaaaaatttaaaaaattagccaggcatggtggcacatgcgtgtagtcccagtgactggggaggctgatgtgggaggattggttaaacccaggaggtcaaggctacagtgaggcatgatcacactactgcacttcagcctgggtgacagagcaagactctgtattgggagggggagttattttaaaggggatttgtgtgccatgggaggagttggtctttccaaaaggaggaccccttccaacgacatgggagctaatgaatggagtgccttggtgtacctagaaatattacctcatttaatctgtacaacatccctggaaagtagattttattatgcctggtttgaagatgaggctttagaaatgttaaaggaaaaaagaggtgcatcttagaattaaggacctatggtaactgtatatgtaatgatgtacttctctgagcctcactttcctcagctctaagaggttaaatgtacccaagtttccttagtaagtaaatggtgaatctaaattggagcccaggcttttttgacctcaaagcccatactctttttatttgtaccatgttgcttattagaaccctaatgggagaacaaatttaaaattctgtaaacagaaatgttcattgattctgagatctaaatgcacgagggaagtgcagcatttaaaggaaccctgtggtgactctggatataaagccaggaattctttttgtaattgcacaatttgtctgtattggtgtcagttttaatgttttatgtctagctttcttaaagcaacatacacctgtcctaagctgccctgtggaaaagggaaacccatatatattttagatggagtagggtttttaacacccttctagcctgaaatgccctctgaaggctaatgtaagctaaagaatcttctggctatagggttgaacagagagtcctacttcacatgcaattggtacagaaaatccagtattctttcttctatcaaagtagagtttgtaagccagggacacaaatttgtgatttccttatgctgtagcagataatccttaaaagaataaacactgaatgaatgaatgaatgaataaatggaaaatagaactgtttaagtgatctttgtcaaaaagcagtaaattctgcagaaaattattcctccttatggaagaataagtaatcatgctgatgccactcatgcataggggatgaataggaaacagagacctgacactctatatccagtgacctattgggaaaatgctacagtaaattagggctgctaaagtgtttaaatgtgtgactcagaagtgccccgggcaaggagctccgacttcaatattcctgcctgcctcctttctctgcctctttatcttactgttccatctcacctgagcctctccctgtctggagtgctctgaggctcctgatggatcttcccaaatatagagtacagcacgttgaagatagtggcattgcagtcaactattttatctagaaagcctggaaatttagagaatttatgtcaagcaaaaatcttttggaaccactttagagacccaattattttagaagggtgttatgagctctcgcaactgccacctcagaaaaacttgaaatatatcatttgccaaaactatgtttgaccagcatttactcttcctgctagtcgctaatctttcagaagttccttttccattataaaatctattcattcatatcatctgggcagtcataagtgtggattcgattaatgaaaaagcagactgaaaggaagaaaaaagacatatgccccaagaggctgtgtggtggtatgggagacacacacacacacttagaagtcagacagccttctcctgggttcactagggtctgattctagagcaccgccaatttaataatagcttctcaggaaataattctacattacgtgtacatattgattgtaaactgcatcctgattttataaatgttttaaaaaatgaaaatctatctcagaattaagaaattctggaaagtgtatatgagtgtaatgatgtacttaacctctctaagcctcgctttcctcaactctaacatgggagaggctgagtgaggattaatcaaggcactggaggaaagggctatctgtgctcttaagctctgtgtggctctgagatgccctgtttagttcatctgtcatcaaatgctgcctgctctgtgccatgctgtctgctctgtgccatgctgcactggaaatcaggtggaaaacccaatgagtacacgtaaaaagagggattaaaatgtggtaaattgtcaagcagatgtatataagctactaaagcagcacaggtaagggagtcctacttgaaactactgggttgggtaggggactgagaaaagatgctctggggtgatttatttgatggctccttgaagattaattagaactttgtcagatgggtaaatgagaagaacattctaagtagaagagacaacatgttttgagatgtagtcacaaaacatagaagttccaaatcattggagcaggaagagggcagagggtaagctacagaaactaggcagggccagatccgaccaggccaggcctgataagtgagcttaaaaatagaagtgcatttatgttctgggagcttgttttgtaacaggcactgtgtaggcactaagaattttgtaaagaccaagaaatcgttcctactctcaagcagctttctatttagttgggataagcaggcaattataataccatacaagggatacatggaagtaagtatagggcctgggtgcacatgggaagcagggagccctagttccatcctggggagtcagggaagaccatcccaagctgaaatctgaagatgaatagaaactaggcaggtaaagagggatgggaaagagtgttcaggctgctgtggtcgtcaggggctaggtcatgtccgtatgtaagctgtgttgaatatgaactttattctgatggcagaggggatctattgaaagaagggcaatatataatcagaatttctcttagaaaacactcatctgcattgtacaaatgaattagaggccaaagaacatgaagcagagacaccaatgcagaggctctcaagaaatctgtccaacagatagtggagccctgaattaaggtgtgcagaagagtagaagctactcatcgggaaatggagggatggacactatggtaacatctgatttctttcattagagctaaatgcacagtttgggagaattgaaatagctttgatctgtggccagatctcctggagttaatatcaaaagaaggtagtggcatttaaagatattttttaaataaaattaaatacttgttggggaagaagcaaacattttagagatgtgtgaagtaaaaaatgaaggtttcctataacttcctttggtgtaaatcctttgggttttttttcttcagttcacatacagatatacatataggttatacatttcatgtggacaggattcctgttttttgtttttgttatttttaaaatcacttacatattcaacatctgtcaaggtacctgtcaaatagtatactcagtaaatgcttgttaagtgaactcatgaaaaatacatatgtgttaaggtttttagggtaattatgtcacacagcatatatgatattgcatttacttttttaactcaatgtgtcataagcattattctatattagagtgaccacacattttatcttcctaataatttgttcaacttagctctctattgaaggatgtttagattatttccaaattttcagtattacaaaaacatgcagtgaacaatcttgtttgaatatttgtgctagattgcatatttgtgctagattttaaatatggattgcttgtcaaatatttatttaaaatgttgaggaaaacaaattgcctttcaaaaagtttatgcctggccgagcgtagtggctcacacctgtaatcccagcactttgagaggctaaggcagacggatcacctgaggtcgagtttgagaccagcctggccaacgtggcaaaacctcgtctctactaaaaatacaaaaattagccaaattaggtgacaggtgcctgtaatcccaggtactcaggaggctgaggcagggagaatcgcttgaacctgggaagcagagattgcagtaagccaagatcgtgccactgtactctagcgtgggtgacagagtaagactctgtctcaaaaaaaaaaagaaaaagtttatgcccattctttgacattccaagagtatgtgagaatgcccttttccccagctccttaccagcactgaatgttatcagcctttaatttttgccaaactgatggttagcagccagtatctcattttaatttgcatttctgggtctttagtgtcgtttagtatttttaaatgtatttattagccattttatctttctaaaagatagttctttggtcagtcacgactattttaatgggaaaaagaattgagaaaaagcctaatttcagaataccatttttaagatgtgctctatagtttagaatacagctcgtccccacctcacttcctgccaaagcaggcgtgtatgcgtacacatacacacacaccccatcatgtagagaaatggatcacgcatccaagccacacagcttcacttgtttgcctgctggccctttgagcaccggcaaagcttttgtttatatgttcagaaaaagctgtctaataatttaccagactttaatccacctcctatttgagaacttctgttacctgattgctttgtcatcaacactagtttaaaaaacagatttttagttaaatgtttattaaatactttagtctggtacatgtacatagcacttagaaaatgcatcataatctggaagtcacaaatatagacaaaaacattgttaccccttaaccggtttattttggggcagcagatctaaggacacgcctggcagcattatgaacagcagtggcaccaagggcaactgtagggggttaatgtggaccctgcatcattccttgccatgtgcctggtgagtaaactcctagaagtttctgggaatggtagcaagtggggaaaaggctgcaaccaacaatcaatgtcacaaagtggggatgactaatttgctgaggaggccgttgagacagatgtttaattagctgaagtcagagtggataaattgggagattactgcctatgcagagagatgcctttttccccctcatctcttttgcaactgctttttgtgtgtgtgtccttacttttctttttgaagacaatatcctcagattggagagaggtgggagagaggtagaaagtaccaaggtaatgattccattttgattacatctactgaatacttattgtattccaggtatttttgtatttaacctttacaaaagaccttgtgagatgggcattatctcttttttgtggtagaaaaccaaggagatatataaatatatagagaaagagagcacatggagtgtgtgtgtgcacacttgtatgtatttctaatgagtaatacaggtgagatttgaacccagaccctttgattcttgagcccaatgtttttttttccgtacaccacagcttcctcacttaaaatgtaatgtggatgagggaactttctggagtaaagctaatcatctgtatattgattgggaatctatatattgacgggagctgcaattgccaagtgtgtacatttgtcagactgtcaaattgtatttgtacaatttgtgtgtatattgcatgtaaattttacctaaaagtaaaaagaaaatcttaaacaaatattgagcttcagttaatgctatgtatgctgaagtagttcagagtgaatgtagtaatgtctcctccttgatttgaaatacattttaaaaaatggattgatagatatgtgatcaagcaagtattgtaaaatgttgactataggtctaggtgatgggtatatgggttctcagtgttcagttctttcaacttttctgtggtttaaaaatactcataataaaatgggaaaactcacaaaaattaaaaatacatcatttagatactgttgatactaatatgaatttctgaatgtacaaacatgtattcttgtagcataaaaagcactaggttattttattgttattagctcgtctgttaaataacatctttgaggtcatagtttctcccattgatctgtggttttaagttgcatttacagttacaggtataataatcaccacttactaatactcacacttggccaggtgatctgccagatacttttttccattacactttaatccttaaaacaactatttgaatcagttgtcatgttcattttataagtgagaatactaaagctcagagaggttgcaggacttgctgaggtcgcacagctagtaggggagtaaggactcaaagccaaatggccaaaggttgtactgctagacactgtggtgcttccttctactggataaggttacggggcccacggctcagtggaagctgttgcctttctctctagagagaccaaatgtccctgcttcagctgggggtggcagcaagactcagtggaaacagcatgggctttggaaccaaaccaaccccagtccccaggccacctgtcccttttacaagctgtgaagttagggaagtcatcagccccttctgacctcagttgtcttttctgtaaatagaggtaataatacctatcttgcagggttattgtcttaactgaatgcatgtaaaacacttagtccatagtaggcgctcagtggacatcagctgccatcatccctattgccactatcatgccaggcacgccataaaacctggctttctctttaggttttggtttacttccttttctatccatatgatttggcctttgcctgcaccttttgttttccagtgaattaagtctatagaaagtttttaccttgtggtagaatgagcctttgaattgtgtttgaattagaatctgctggaagcacactttattttgaagaaggagaaaactagacccagagagtcaactcaaatgattttttttactaataagtgaaccataccatatatctatagggatggattaatggtcacaagccttatttatcagatagcttatgtctgcaaatttaatttcctatgccaaagattctggaaataatgtgaacaaactgtaattgcctgtaacaaacacatttataagtaagttttaaaagtctttgtgttcacagtttagtagctcacagaccctgttgctgtttctcagaaaacatttaaaagaggaagtatacttaaatatccatgtgattttgaaaatgaaaatgattctataattacagacaggattagagtgttgcatgtgcccattacatctctccagcctccatgaagagtctcagtctgcaccagaggaagcagaagtccctctttcttcggtcaggccatttgatgtgtttatcctattagtagctgtaaggaaaattcttctctaccaagactgattttagctactttctatgaaaaaacccttgctttagtagagttaccccaccacaggaaaccaagggcctgaaccacccaactcctgttctgctgcttacagaggcctgatactggagctgttttactcccataagcaatgtaaaaggcattttaaacaactccaatagtaattttgcatagttctttctttttgagtaaattataagtagtggcactttctgccgcatatctgcaacagctttaagtgcattataaagaaaagaagaaaaatagctagtcagtaagggcatttctttttctgccttacatgacaataatgtcctgagacaaagaagacttaaaatcaggaaaatggcattggattagcaccgtaaggcagatctggggagaggacgtatcagcatctacctctctggttacctagctactaatcacagtatggcaggcagctaggtgtgtagattctactgtgtcatcgaaccaatttttcaaacagaaagtcagtgagatgtgattaaagcccaagtgctgcaaaagatacaaggtggtctattggaactcctcaatcttcctggaaactgtcaccacataatcacagaaatatcaaatcatagcaaaacttaagctttccttttcttttttcgcctttttttttcttttcttttttttttttggcacactacttttaatagcagaacagtgtgaattaagataatgtgtaactgaagtctaagaatccctgagggtcatgcagatctctcaggtacagtgtgtctgaaacctaacttatccttcagtagagtcttggctacatttcaggtagtgaataaggatataagggtgacagttgggtgaactcagagagctaacattctaatagaggagatggctaataaacaaagcaataaaacacatttgataggaattcttgctctggcttttgttagtccttccattttcttttcttttttctttctttctttttttttttttttttttcctgagatagagtttcactcattttgcccaggctggagtgcaatggtgcaaccttggcccactgcaacctccaccttccaggttcaagggattctcctgcctcaacttcccgagtagctgggattacaggtgcacaccaccacgcccggctaatttttgtatttttagttgtatttttagacaggggttttcgccatgttggccaggccggtctcgaactcctgaccacaagtgatccacctgccttggcctcccaaagtgctgggatcacaggcgtgagccactgcgccctgctagtccttccttttttttttttttttttttttttttgagacggagtctcactcttatcacccaggctggagtgcaatggcatgatctcagctcaccgcaacctccgcctcccgagttcaggcgattctcctgcctcagcctcccaagtagctggcgccacaggcatgtgccaccacgcccagctaatttttgtatttttagtagagatggggtttcaccatcttggccaggctggtctcgaactcctgacctcgtgatccacctgcctcggcctcccaaagtgctgggattacaggcgtgagccactgtgcctggcggtccttccattttctaactgaaaagacttccttgagtcctcaggtttgggagttcccctcctagagggagtctctctggctcccaggctcaggcataacttcattctttccactcgtttccacgcatctcctaattgggctaccagcacccctccttgatgcaggcagggagaagtggacagggcagaaagggctgggtaaattcatgagcagtaaatgactccatcaacagtggccatcaagggaaacaggccatgttccagccatggaagctgggaagggacactaatcctctccagagatcagtatccctcagccacttaggcttgtggcagaggcactgtggccctgtccccagtaagttccaaatacactgatcttgccagctgctggtaagcaccttgcaaaagaagagaatgagagcccccgcttttccttgagtacagtgaaagctccttttggagaggtaggttccttatggtttaccagcaccgcagctggcccagggttggtggttagcacatttgtggaatgaactaagatgtagtgaaaaccagtccacagctcgtagccacgtgtctctcagccagcccacacctgaggccaccactttgtgtttaggagtggattcactgtactttggttatcagagattaaactcccttggagaattacatcatcaaatgaaaatgtaaatgtgtttaaaatgaaaggcgatgcatatccgttgaaattagtgttgccgcccagattcccgtaatgatgtggatctcttctgagtccttggggagccagaggagtataccaaaagcagacattttaaacattgatagtcacgtaagggtgcccagcaggaggaagttactgtaggaagctactgtattgcagaaaaagaaaagaaaagcaaactcactttccaaaggacgtgtgggtgtgtgtgaaagagagagagagtgcacagcctaagtcttcattctctctaatgtaagttaatagatattgtctgatatttataataacttatctaagtagttgaatgggaatgttaataaaaagtaggacggtgagtgccagaaatcacacacacaaaaaaacttaaacaaattgcctataaggagggactcaagaatgggacagggaattactctttttcatcataggacttaacagcattatttactcttaaaactatatgtatgaggcccgggcgcggtggctcacgcctgtaatcccagcactttgggaggccaaggtgggtggatcaggaggtcaggagttcaagaccagcctggccaagatggtgaaactccatctctactaaaaatacaaaaaattagctgggcatggtggcacacgcctgtagtcccagctactccagaggctgaggcagagaattgcttaaacctgggggcgggcagagcttgcagtgagccaagatcgcgccactgtactccagcctgggtgacagagtgagactacatcccccaaaaaaaacaaacaaaaaaaacactacatgtatgaatcccagcattttgggaggctgaggcaggcagatcacgaggtcaggagatcgagactatcctggctaacacagtgaaaccctacctctattaaaaatacaaaaaattagctgggcgtggtggcacacgcctgtagtcccagctactcgggaggctaaggcagaaatcacttgaaccctggaggcaaaggttgcagtgagctgagattgcaccactgcactccagcttgggtgacagagcaagactctcaaaaaaaaaaagaaaaaagaaaaaagaaaactatatatatgctactttgattaaagttaatttttaaattttgttaaaagaaaacatcttactttcaacttctggagtgtagaaggatctttctttccttacttatgtggactttgtctatttgaaaacgccctttctcctaaaagcaaaccattcatttcaacatgttggatgtcagatttctctgagaacatcattattaaatagttgtttcttataaacgttttcaaactttttaagaccaaaatgttatatgagtatagtcagtgtattgtgattctgccaacactttgtctctgtgacccatattttccgtaggttaaagcataagctattagctggatactctgtcccattggaaggatgactaatatctcaaatataaatgaaaacagctgcttttccataacattagagtcccaaacagctgtcacatgtacattttgacattcttacttctttctaaattgggacaaaaattagtttactggatttgctgatctggttaagtacatcatctaacttctgtggagaggtacagaagaggtcataggaaagtccatggagccagcatgcagacatccccaaaggcttgaacttacttaaaatgtaaaccctgtgatgagacccttctgtgccaagaacataaggtctgtaagggcctggcagtggctgctgcaccactgccacctttgccagcaagcctgaatctcggcagccagccattgttctctgttccactgaagagattgtggagtaccaccccattgtctcctgaacgcctacgtcagtgcattctcctcttctgagagccttggaggatttatttcaggaggtggctgttgcggatcagaagatcatgcttcctctattggcttaaaactggtcattctctgtctttgagttccttgctttagtctcctcttcaataaaataaggtcccaaccagatcatagtcttctggttgatagccttaactgtggagcttagttaagacctgggttctagaagacctacctggttccacccctgctcctgttacttttcctttttttttttttgtttgtttttgtttttgtttttttgttttgtttgagatggagttttgctcttgttgcccaggctggagtgcaatggcgcaatctcagctcaccacaacctccgcctcccaggttcaagtgattctcctgcctcagcctcccaagtagctgggattacaggcatgcgccaccgcacccggctaattttgtatttttagtagagaaggaatttcttcatgttggtcaggctggtcttgaacccccgacctcaggtgatctgcccacctcagcctcccaaagtgctgtgattacaggcgtgagccaccgcgcccggcctcctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagtaagtctttgctgttattatcttatcactcagtaaatgttagtcctgtcccctcctttcagtttcagtcatgaaacctagtcagactcacaattttgtgatctaatgctctttttgtatgaatatgactgctttgagttatagttcaaaagagactctagctgctaaggaacccagctcaaattgagtccatgtattaggtacagcccagaatgtgtgcatctgtctgcgcagctgctcatttgggcttttccaggggtccgaggccccttgtcagagcagcagagcatcagcaagaacataggagtgcacgtgtaggaatgacctagccttcctctggagcaccctgcatctggagcaggatatgcagaagggttaaaagctggagaaactttagtcataaattttcttttcagcaggacttcccagggaacatctgacattagcagagaggaaatgctgattggcctgggagtcagctgaaggagacaggaactgcagtggaagctgctggatttactgttattagcaaggcaaatggaaagccagcagggcagcccagctcccagataatagatctaacaagaaagaaaactctgagaaaggaaaatggctgacagccacgtctcctcttctgccatttttcccattgcttttacctttttgttttgtttgtagcacaaagagaagcaacatgttcggttgtaagtcacaattggcttaaaataaaacaggatatataattcagcttcttacctgtttaagataagaagcttgagagttgaacatggcaaaatgtgcaaaattgtattaatgtattaagaaatagttgctatttattgagcacttatgtgccaaactaagtgctttacatgtgttatctcatttaatctgtataataaccacatgagttagaaattatcatcattccccacttagagataaggaaccagtgcttagagcacttaagtaatttccaaaggtcttatgaattggtggtagtgcttgaccccaccatcactgtcctaccaacctagtagaaggtactgaggtgagaacttaaatggctgttataaagctggacagggtagtggtaattaaagtgctgggagtgtatttagggcaacctaaatctatgctcctaggttgcagtcctcaagcctggcctctttacttacgtaaaaaaataaaaaataaataaataaataagtactcaccaaggcttgtgttctgacttgaaacacaaacctcagttggcacaatggttattagaaggaagatggggcaggcagagagaagccctgttgacaggtggagccaatctctgaaggatctggcccccacagcagggaacagggcagatgggcagtcagcagtggggggccataaggacagcgggggaactgcaggtcctggcagcaaggaccagggaagcagatgatgctcagcacctgggggtggccgtaccaagagccacagcttatccagggttagatcacaaaggcaacaggtgagtaaaaatcccattgtcaaaattacctgtgggaaagaaaaatctctttaaaaatgcccatcagaggcaatgtaatttttctcattaaattcacacagcttttttctctagcatcgtaacagctaaaagtacatatttttaaatgctaaaatcaaacttggtctagaaagactgagatactatcatccacccatttaatgcagttagtcacttatcacacatttacaaggttccatagttgcaaagatgatttctggactcctgcctcatattcccactcttggggctcattggatcactgagagtcatggcaagtggaattctcccaactgcttaaattgtgctcttggtcaggtctccctctttttttcctcttttctacctagcaagtatggttgaattcagataaattaaatgtatgatttatgcacaaggaaatccaggcgggcaggcagtatcagagggcagggcaggattttcagagagacacactgggaacctagcatggcaccaggcctgagggcagggttctgggcaggattgggccaggagcaaggacagttaactgaatgagatgtaaaggccaaggctagagtttttaaaaaggaagccctgtttttggttggctggggattgtagaaatcctattgccttgaagacgttaactggtgcaactttccctattgtggggaaaggaaggaggccagtctgggactctggttgggcctgatatcatggggtcagaaggagagaagataagacttaggggataatcaaaaaggagggatgtgattttgacaagctgacggagtcagtctgggtgaagggaagggcacagcagtgacatggaggtaggaaaccaggacatatatgcactgaacagtgagtctagtttgggtcataaaggacatagatggacaagaaattaggatggatagaaagccttgagagtggggtaaggaatttgcatctaaactagtagcctgcaaggaagttgtgaagggattgtatgaaagtgataccttgaatctaccagaatttggctctggagagcactctaacaatagggtgaagagtggttggctggaggccagaagaaggttgggaaaccattactgcggcctgagtgagaaggaatgcaagggagatgtattaagtgggtagagtctgcagaacttgggagccgatttaatgtcatcaacaagggggaaggctaagaagtattccaaacttgagagtgccgtgttcactatgccaagtccttagaggccagatgcagagtcttgttcatcttcatatctacagtgactagctcatgacatggcacatggtaggagtttagtacagtttgatgaaccaactgatttaattcattgggtgaatcgtagtgtcgtcattggaagcacagttacaaggaaaaaaagctggtttgagaatggaaggatgataagtttatagttgattgtcctgtaaaattagaagcaaaaaagagcttagagtctctttcttcctgcaaaggctggtccaaccattcactggcagtggtgcttccctgaagagttggtagaagtccctaaagaggccctgtagccttttgtcccaccctgggctagagccccttccaccagggccactggcatcaagctagccaaagaataatcctggtgcctcactgaatctgctcaaaatcctgtcaagtacatacaactactgtattatccgcatttaacagaggaagagactgaagttcagagaggaagtggtttaccgaagcctctgacataagcagatttgaatgaaagtcttcagattccaatatatcataacagagtctgctgactgaaaacaattggctctaagcttgctctccactgactcaggttggagtcaccactttcatgtagctcagagaaggttgaagataaatgaagtctcatttttgtttcttctgttttttgtccttaggtgcttgtgactaaattcactaatttcactggctgtcaaggctgtgttaaggaaaatgggtttgaactgctgtgggttttgagtactggactggatgtcagaaacctttgccatcacgggaaattctgtcactctggatttactgtctgttccccacagctaaattcctctgcagtgtgatttagcaccctggatccccatcaaccagttttggcatttatttgaatgcattaccccactggtttccataaactattttacaattgtttaaaataaatgactgtttatttccacaaaaccatctgtatttctttacagagcaacagataactgtatgtaaaatttggtattgtcacagtgactcaagttaagagaaacagattggattgaaaaattggattcttagggacaaaggtaaaggtttccaacctctctaacaagtgatatctggatttcaaggagaaaaaaaaatttccttttttacaaatagtaggggacctcctttctctaaagagaagtacattcctgctggctgcatagtgacaggatgtagagtattagcactcctcatggtagtgaagggtctgcgccttcaagcacactctctgcctacaaccgcatatatgaggctcctgtccagtggctcccaaccttctgcaagttttgaagtttttggttgtacatgtgttacctcttcttgttctgatgttgagtgggctccacttaggcctgtgtgttgtggctcagataactttggtaggatatgtgttgggataggtggctactgaagatggacctgggtaagagaaccagactgatggggatgagggattggaccctgtcaatgatggtcttccattctccagccaatgtccaggtgagtcagctagatccatgctagttccatccatccctaggaaacccagtcagagttgggacactaatgggaatctccaaacagtggaggcatttggagtcagatggaggtggagctccaagtctactttggaggaagaggtaggatggtaactaagcaggatgggcttgtttcatcaccagataatcactaaacatacctgtatgctgaggctgtcctaggaatgtagggacgctgaaatgtgctctccattctcaacttgcatatatgtagtacaagaggtctttgtagtgtgggttgcacgaagaagtccagagacagaggcatctaagcagagttttgattccttgagtgggaaaaaacagagtaaagaagtgaagtagagggaagattgttccaaactgagggactagtatgagcaaagacacagatggttgaaatggcatggtttggaggatatttctggattactatatcattagaggggaggaagatgaggccagtaaggctgacctggaggtttcagcctctcctagagaactagagacccttctctttccgagtgctgcttagaaagcagaagcagcaacccaggcatagggacaatgcagctaaagctacagactttatgaaaactgtgggccaggcatcctttctacttacacgttttacttgtattaactcaatgaatccttgcaacaactctaagatatagatgcccatttttacagatgggaaattttacagatgggaaagtaatgcacagaaaggctaagtaacttacccaggattacataacatgtgagtggtggagctaggacttcacacccaaggagtctggcttataagcgttacatcatactgtctcaaatgtgctggggtctgcagagtttgcagaacattccctagatacacactttattaagcttaggcagggatcaaatccagaccttttctctacccacaggctgtagggatggactcctgaccaccacttatctcaaagcctgcatggaggcttcagaactgccttagaggaagaccagagacattatgggacacctttgttttctgtggctctgggtagaatccatgaggaggctggggcgggcatagttatcaggccatggtgataacaggagcgaatgggatctgacccttggtctgcagttgtggcctgcctttgtaaacagtttttgttattaattttttaaattatatatatatatatatataaaagacatatatatgtatatatattagacaaggtcttgctttgtcatccaggatggagtgcagtggcatgatcatagctcactacagccttgatctcctaggctcaagcaatcctcccacctcagccttccaagcagctaagacaagtgtgtgctaccataccaggctaatttttattttctgtagagacgggatcttactgtgttgctcaggctgttcttgaactggcgtcaagcgatcctccccaccttgacctcccaaagtgctgggattacaggcacgagcaaccgcacccagctgtaaacagtctttgtagtctggccccagatgctccagtcagtcctcttcacctttgcctgctcaacccctttaagcagcactggaagcttctgtggtctacttgtagcttgactatggacctcaggaactcttgaacaggctctatcccaatttagttcctggctcctcaactgtttaggtctctctccagagccactgagcctacatgatgtgtgaggagccagatggtgtgagaggagactcaaggaggttccaggggccacagtcttccctagtctggtctagctggaataatctctgagatttttccacctcattttttaaaattgaatttttaaaataaatgtaatacttataatgatctactgtcaaaaacccaaatgtgataggaatctataaagtaaaaatcaaaagccatcttctttgctggtataccttcctctaccccacaggttactacaggtaaaagaacggctgtgagaatggtttggttcatgaccctccagattgtgctgtgtgtttcacaaatccacatatcagtgcacctatgttttggtgcttttattttattcgggttttactttactaacatgtagcctactctgtacattctatatcttataaatttaataatgtatcatagaattcttcccatgtcttattaacttagctttattttgttttagagatggtcttgctctgttgcccaggctggagtgcagtggcaccatcatagctcacagtaaccttgaactcctgggtttaagcagtcctcctgcctcagcctgccaagtagctgacactacagctccacaccatcacaaccagctaatttttttttttttaattttttgtagcgacgaggtttcactggtctcgagctcccgctctcaagtcatcttcccacttgcacctcccaaagtgttgggattacagatgtaatgtgggattacagatgtaatgtgggattacagatgtaatatgggattacagatgtaatgtgggattacagatgtagtatgggattacagatgtaatgtgagccactgcacccaaccaacttagcttattcttacaacaaccatatgacagcccagtgtatagatataccataatttatttaatagtttcctactggtaaatgtttaggttgtatgaaattttttatattaaaacggtactttaatgaacatctttgaacatacatcattgtatacttgggctaatatttcttaggataggaatattagctagaagaagtagattgttgagttcaattttcaaggccaccttgtggaaggcattctatttaacaacgattattaagcaccaacaaagagccttttgctatgctgaagccctgggaagacagagttgagtttttttgaaagcctcccaccccgtcttcaaagagtgccctgatgctggctaggtggggggaatgacaaatagacaaaagtacttctaattcagcatgcttggtgcactgagaaaagcaaggtcccaaggaaggtgggatgaaagagctcttaattctgacagggattcaggcagggctgcagagaggaggggatatgccaaaaggatgcctccctgctcctccccagagcccattcgtgaggctaggtattcaagaataaatttgttctaaagaattatgatgctcctacagtttctcccacacaaagaaggaaattcagcggtacgccctttcctttcctcctcttggcactttctgattgatggttggaaatgatggcaatacataaactatttttctttttattttatgacctggtaatagcagtaacatatttccagtaaatgttttctatcacaataaaaaagttgtaacaagactagaaatgggtatagttaaaccctaaagaaatcacactttcagaactgtggattgaggcagtaagtctgtaaatcacttaacttagaaaaagaacccccaccccaaccctggaaaaatcagggcaagcagctggtgttcatgtgacacgcctgctgtgagggttgatggactctcagttttgaccccctcaagatcaacttcctactcttccctgctgcctggtctcccacacagcatctttactcctttctgaactgataaatcatctaaaccttacaattctttttttttaacccaaagatcaaaacctatactgttctttatgggatacagcagagcagagtggtgaagagcacaggctttggaattggaaaaacttgcattctcgtcctggcctcaccgtgggtacatgacttaaccactccatggtttattttcctcctctgtaaagtgggattattgtagggcctaccgcatagagttttatgaagatgcggaaagcaaatgcatggaaagcacgttgttaagggccaggaaagtcctccatgtcagttgctgatgctgttattatagtccaggaatgaagcaatatttgacttgttttcaaaaagggcaagttgatgattttgtcaaatttgtgtagcaatataactgacatttattaagtacttatgtgctaggcattgtgttacacataatctgtggaattactccatgaaggtttagatccactaacttgcccagagtcgcataacttgtaaaagagccaggatttcaatccaagtctttttgactccagaacccacactccaactgccacacatctgccttctaggattagatgctcacagcagcaatagagattgtaaaacattgggtagttctgtctcacaccaaacatctcctcctttggctgatgaagattgtgagctgataatattgagagcctgtggccttggaactccaaggccaggcaagaaaaaaagcattttctttccctaatcataagtagagtagccctttcttctgcttatccttatttaggctctgttactcttaaggggatgaatggctgccgcttctatgtgtctggtgtccttaacatgctctaaaaattaggcctcttccagtctttgtctttaatttctggttttagctgacaccttcattaatggtctagtgcaagctttctgtcgacttgaagactgctgtgtgaaagtggttttgctgtcctatcaataatggtcataatttccccaatactctcatcagcagtgaattgagtcttgcagcaaagaaatggaaaccccagtgcagtggtttgaaagtgatttgtcttgtagacggcgtcttctttcagtaaaatcaggtcagtgcggcactgctgggtcagatgtaagtctgagacaaattagttggaggaaattgatcatttgaaccttaggttatttttagctacagtagctttttaatatcttttttctttatatttgttttaataaactttaatcatcatcatcattcgccaaattaaatgtcttctcagtttcagccaagccttagatagaggaaagagtgccatctactcagcccacagaagcggccttcccttcacagttttggggcttgcttccatgatggcactgttgttgtttaaacactgaagcccactcctcctcatcttctggccggcccccttgctgggctttgtttattgcaccgactggccccttgaccagtctgttcttcattgctattgaaagttaatgggggcaaaattgcattcccaaacatttgaacctgaagtggccagggccgaacttagttgatctctggtgatcggttcaatttagttacgattttttgccattaggctggggctgaatgatggtgatttggttgaggccaaatgtctgaagaaaattggctctctgataagagtgctgttatcagagggggctaccttctcatttacatttagatgagtattgattatttatttactcagagaagtgagattcgtttccaatcttatctttctcgtctctgcttgtcagcagaaagagagatagagctcctgacatcaagccaagataacagcactttgtagcaaagataaaagttggaatgggcctttttctagtgttgactgaaaggataagttttaaaaattagaactgatgggtcatgctttcaaaacctttcctgaaggttttgcagtttaactaggcaggagaattggtttattggaacagccttggtctttcttcttttgtaataggaattgtatttaatttgattatattcagctgtttcacagagagcaaatggtgtattggctcagaagaggctaaagtgtgaccttattgtcatgtcagcttgttccttttttattatttaaattccaaactatccaatctgagcctcagagggggtataagctacagcggttgtcacttgaatatagttcagtgcttatattaagatcaagcagaaaatgattatagttgcctctggaggaagagttataagcgatggagctgacactaaatgcagacattttagcatagctgatgttgggtccgagctctgatacggacggcatcagcgtagtggctttggctcagtgaggaacgcagattcagtcagcccctgccatagagtagtcaaggcttggcacgatcctcctggaatgggtcttcctgccataagtctccagcccattgtcagcagtgccaccagaagaatctcaccaaaatataaagctgattgtgtcactttcctgctctgttagcacctgttgcatatgagagaaaatccaaatcttgaccaacaatctgggccaagcttctcagcctcagctcctccttgaacaagcttgcttttaagctataggcagcatttaagattagagacttgctcggcagccaggattcacagttcctcagtctctcaggtcctacaaatattgactaaaaatgacaagtaaatgtcagaacccacagaacaaaccatgatcgcacagatatcaaaggacatgtgatgctacactaccatccaaacatccatctaatgaatattttttgagcatcaacaatgcaccaagcacagagattactcatccctgcctcgaggctgggggaggcagcgaggcagcttgagctggtaaattatagaagagcccaatgagtgttcctaccaaggtaggaacaaggcgctgtgtgggagcacagagaaggggacaggtagctccaccctccccttccctgaggtggaaacatctgaaccaggttgtcttgaagcaggactcagagctaggtgaagaagagggaagagggaatggcacgtgcagaagccaggaggcactgaggaacccacgtggaccatggaaggtcattgtggaagaagccaaggctgtgtggggtggacatgtgagctcagacccagcgtcacgtgtcctttgatatctgtgctgccgtggtttgttctgtgggttctgacatttactcgtcatttttagactatatttgtaggacctgagagactagggaactgtaggaatcctggctgctgagcaagtctctaatcttaaatgccgtctgcagcttaaaagcaagcttgtttaaatagatatgcaccctgcacccctactttggacacacgagggaaagagcacagactttcgctttgatgccagcattccctgccccggtgtgccctccctggtaaggctgtgagcctgttgtgactcataggctagggatctacctaaaccttattgcagtggtttctgtttcagtctgtatttgcaataatagcagctctcattgaccgagcactttgctaagggaagtcctgcattgtctcatttaatcctcacagcaaccttctgagggaagctctgttatccctattttacagatgagtttaaattccttcccaaggatgcatagctggcagcgttactccctctcatggcacaaacaccagggatgttctgctcaagtctagcctttcctcttactgctcacacttagcttttttctggctaccagaagctctttcagattaaagcagctctttaaattggtgaatggaaaacagttgacatgaagacataaccatgaaagtgttcagcttttgactgtcatttttccttgcacaggtgattctcaaacttgttcttatggtcagcaatgatgatgataggttaattcacttatatcctaccttgatcccaaaaatatttggaattattataatagattttaaaatacacaaaccactgagtgcagtggtgtgtacctgtggtcccagctcctcaggaggctgatatgggagggttgcttgagtccaggatttctgggctacagcctagatcagcgctatgctgatcagatgtccacactaagttcagcatcagtatggtgagctcccgggagtgggtaaccaccaggttgcctaaggaggggtaaaccggcccatgttggaaacgtgcaggtcaaaacgcctgtgctgatcggtaatgggatcgcacctgtgaacagccactgcactccagcctgggcaatatagcgagaccccacctcttaaaaaaatatacatacgaggctgggcacagtggctcacgcctgtaatcctagcactttgggaggccgagacaggtggatcacaaggtcaggagatcgagaccatcctggctaacatggtgaaaccccgtctctactaaaaaatacaaaaaaattagccgggcatggtggcgggcgcctgtagtcccagctacttgggaggctgaggcaggagaatagcgtgaacccgggaggcggagcttgcagtgagccgagattgcgccactgcactccaacctgggcgacagagcaagactccatctcaaaagaaacaaaaaaaaaatatgtatacatacgaaccaataaactacgtgagaggaaaagaaacataaagattaaacgacaagtttacgagtccccaggaggaggagctggcagagaaatgcatgtccaggtcatcatagtcacacgaacatttagtgctgagcttcctgatgggcaaaggagaaagggacatgataggagctagttacaagatttatgttaaactttctaaagatacaaaagcaagccctttgctccagggaagtacagcttttcctgataccaggatctgaaagaagtttctcccacgggtctctagaaagaagacacagagcaatggaggcgacagtgtgtcttccctctcttcggactttggcaggcacttgctttccattggatttcagctttcagctagctagcagctgttaaagaattgcatgctaaaaccttttatgtttcagttaggggttaaagggatcgaggaagctgctctgagcatgtagccaccaaccaacagattctgcagattttctttgaaacttatgtgctgagatgtttgcctcgggtttacaaaatcccataaaaatcctgcctgggtattataacttggaaccctcccaaagtgcccaaagcaatattttgttcctaggccattcggtgacatggtattactgcaataaatacatcattggaatgcccaagcaggttttcccgtcgctgcagagtaactgcttcccagaatcttccttttgtgttcctctctgctgtgaaatggagggtatgcggcttcatgcgcagctgtgactttttaaatcctctttccaaagtgtggatgttgccttgagaaccttgtcctgttcagtgtgaaagagccctttatattttatataatcatttctttggcaaaaagtatattcatagaaattgacctcacagtttgtctttttgaaatggcttttggatgctatttttattttcctcccatgtcagcctcctaaaaattaaacaagtatttgatggagactgtactttgatataggtctgggttatcataatcttcactgtcaacaggcatttattaagaactttgtgtgagtgagatgctgtggttcataatgcaatatagagagtgcaggcctgggcagtcctaggtatgaattctctcacttctactagttcctgagggacactgagcaagttatttaacctctataaatcacagtttctcctctcttaagtgggtttataaactctttacatcttagggtgaccaaagagtgaatgagatgatctgtacataaaagacctagcacagcacttgtcacatagtagggcctgtgatggtggtagttagattgtccatgctgttaggatcacttagtattattacagtctgatgatgatgatgatgatgatgatgatgatgatgatgatggtgatgatgatagctgatacttaaatcacactattaatgcattggacattgttccaactgccttacaactattagttcgttgaaactttagacaatcctgtgaggtaggtgctattattatcccctgttttataaagaagaaaactgagaggttaagttggcccaaagtcatacagcaaaattgcttggccaggacttaggccaaggcaattgggccccaagtttatgcccttaaccacctggctatattgcctctcgtatataccctgcctctcattacacagtaagacctgaaattatcatcctggcctttttggagggaaaatgtgtaaaatactataatctttctctgtgaaatatccactattcaggtgaggattatggagagaaatgcagatttataaaaagcagttttccatttggatttagatatcgagtttcatatgcagcttaaccaccctgccttcccccaggttgttacccattggtcccttgctaagttcagaagtgggtttccaagttgttcttcagctttgatggatgagcagggagtacccagggcagaaaacacacggattttcagttactgactaaactgagcgtagaatattagcagtattcctaaggaaagatggatgggccttcctggatggatagaaagacaaggtgatcatgtctggtcatgtcttcgtaagagggaatggtactaccatggactcagaaggcagccagagcatgaaatacttggtatgtgtgggtttgttggaataaatagtttcagatcattttcattttgaatttatagaagttaagtgattcagattctagatgaatccacaaatctacagaaacctttatttatggtataaactatggcctttttataattggccagtaatttgtagtttgcaggaggaaggagggttcaaggcagactagctttagagccagaagacccccatgggtttcatttttcccccttcctactttttacctttgtgatcttgggcaagttacttcaccagcatcccaatctgtaaactggggctaatatatctgcctctgggggttactgtgaggattcaataaggtaaggtatatagcatgcttggcacataataagcatgtattaaagtcatcaacatgctaggcttcataggacaaagtccaagaagctactttcagaaaactaattttaatagaaatatctgcaagatccaagaaataaaatgaatgtcagatgatggcatttatggctttgagagtggggcagggagttgtcttcagggataagggatccttcctggtactccctgactcccctgttttccctgatccacgtttcccaggcagctgcaaagactggtaggaaaaaatgtgcaaaggagaccggcctgaaattcctcctgatgcagccaggccttagttcccagtaatcaggaaagtggtagcttatatataatccagctgtcaggtagcctgacagcttgagaagcccgacagtctgtgcactgctctcagagtacacatgccagggtgcacggttgcttcacatgaaaatatgtctacataaacagatcgtgtctgcttttgattaaattactgcatgtgaatgacccattggagatgccacaatgtgtgctaattatagtagcctcaaaaagatgtcatagtaagaaattggagaacttttaagtttatctggtgtttttaaattacaaaagtggccttcatttattatagcaaatttgaaaaatacaaaaaaacacaaagcaaaaataaaaacaattattaattccactatcaattataactactattcacattttaggaataacctcctagtcttttttcctctattcctttacatattttttgcttagatttacctttttaaaattcatacataatgtttatatatatctgtggagtacacgtgatattttgttacattcatagaatgtgtaatgatcaagtcagggtatttgggtaccacctggggtatttatcatttctatacactgggaacatttcatgtccactattctagcttgttttgaaatatatagtacattgttggtaactatagtcactccactctgctattatattttaaaaattataatttgtatttttataattataatttaaaatgtgctgtaatttgctgctttcataaagtagcatattataaacatgttttataaaattaaatatttttgtagcatcacatttaatatttttatggtatttcataatattttatttaatcagtccccgtattagacctaggttgttcctaaatttgggctattatttttaaaaatttttttggagataggttctagtgcagtggcacagtcatagctcattgcagcctcaaacccctgggctcaggagatccacctcagcctccccagtagctgggactacaggcatgcaccaccacacccagctaatttaaaaaaatttttttgtagagatgaaggctcactgtgtttcccaggctggcctcaaactcctggcctcaagtgatcctcctgccttggctcccccaaagcgctgggataacagatgtgagccaccatactcagcctgggaaatgaattattacagctaaactttatacccagatttcactgtaaatttatagaagtggatgtcagttgcttctgcacactgtgttgctgggagattttggagataggaacagtcagagattgtttaataggccattatcttagaaagcagccctccaggttcaggggtaactccctttcctctgctagactaaaggggcccacagctgttttcttaaggttcagctttctgagattccttctacccagtattacgtgccagcatccactgatcaataccagatgcacctattaattgaaaattgttggcatggacaggtgataggtagtagagactacaagaattacctgcatttccttccatactttgatttacttaacactttttttttcccaagagacacagggattctctctgttgcccaggctggagtacagtggcatgatcatagctcactggagcctccagctcctgggctcaagcaatccccccgcctcagcctcccgagtagctgggactacaggtgcgcaccaccatgcctggctaatttaaatttttattgttgttgttgttactgtgtggcccaggctggtctcgaactcctgggttcaattggtccccccgaagtgctgggatttgggagaatcgctaagggggctaccatgcctggccttatttaacacttttgaaattagaattttaaaaaaaaatgaatttactaccaataattttaaaacacaatacctttttgatataaatatagtgtattagagtttaaaagaactgtgtaggcttctgagcatatgcttaaatagttgtatatgttttaagcatttgtttacttacaaaggtttaaaagctttatttaagtagtgtaaaaaggactgaatgtatgtaagaattcagaataggcagaagtgctaatgaaataccagttagagaaaagatcaaatataccctgaaactgaaatgaatctctacagtgctacagctgaacatagaacatgggaaggagaatgactggaaatgagtgaaatgcctcatgctgatgatagagaagcactagatgtgattaatccacaagttgacagcagctgaagaacatatctaaaaatacgtgttccgcctgggagccctgcacggcctctgatgcttccctcagctctctcacctctccttctgtctgaccaaacacgcctttcagagtcaaaataataagacagtttcttatgcctctaatcctttcaataaccattaacagatcacaggagcagtcttttgaatctgatcattggacccgttatgtgttatctgagaagaacaagattgtcatttgggttgacaaagaaatacatgaataaatgtataaaatgctgcagtgttttattaaggtctgccagaagaaccctctatgtgatgcagggtagctagtattcctggcttccagtactactgaacctgtgtctcgtgttttcataaatgtttcaacaaaaatgtgaatcggtagccactgtcttttcatcatcgtaactcagaaatctgagatttttttaatttaaaaactttttccacatatgaatgccaggtcatctgagctttatttatttaagcttacctgtttacaatttgttttgaattttttggactgttattatattagagttctacacatatcttattcctgattgtaatttattgttacataattattaataaatacctttgcctcctgtgaggcaggtacatttctaataagcatttttcctacatcacctctgatccttacaacaatctttcaaggtataactattcctacattacatattaggaaacggaggttcagagagggtaggtgacctgctcatatctgagaagtggcgtagtcactctgactcaaaggccatttacctcttacttggtttcggggagaactgagtggcaacagacttgataatagaacagtgaagaatgtgaagccttatgcaaaagaaaccccaaacttccatcctggatagctagaccctcaagacagactttaacactttactaaggctttatcagcttttcaccagtatgtggtgttttttaaatgttaaattcgctgtttcagacttcctcccctcctcctgcccctttgatcttccaggccctcagtaccgcctggagaagcagagcgagcccaatgtcgccgttgacctggacagcactttggagagccagagcgcatgggagttctgcctggtccgcgagaacagtacgttggccgcctcgctccatgcccgctttgtccgttgcaaacttgcttagaagtcatgtgtttggaaacgctcactggtctggtttccctaggcagatttgaagtgactgttttccaaggcagactgcagtcttcgtgccaaagtatatcccaaagtgaaatgattgattttgtgctttttggtagagaggctgcatcctgtttagcactctgtgattaatattttcctgttaaactgtcttcctaagttgggagcatccctggaaacagcttagaagcatgaggccttttctgaagtaaaggctattttgtatataaagcagctggccctgtcagtatcactattcagacatcaggttttagaaaattttaaccatttgcatattctagcaggaggcagtgtagtgattccttatgctatgttgagaacttcaaaacttgttaactttgttcattctctcttcagagtttccaaattgtgcattttgccatcctctcctccatactcccactgacacaagggcaagtgatgtgtgaaactgcgcttgcggcagcagactgtctgtagtcattcctgcttcgaggcttttacacaggctatttcttccacctggaatgctccttcccccattctggttaataactctttctcattctttgtctcagtttaaatgtcctgtcttcagaaaggccaccaggatcttcctgtcccccattgcttaaacctgatccacctctcgtttgagtccctcgttatattctgccataccgcatactactttttctccgtcgcgtgtgtttctatctattcatttatttattattttttagagatggagtcttgctgcattggccaggctggtctcaaactcttttttttttgagacggagtctcgctctgtcacccaggctggagtgcagtggtgcaatctcagctcactgcaacctccacctcccaggttcaagcgattctcctgcctcagcctcccgagtagctgggactataggcacatgctgccatgtccggctaattttttgtatttttagtagagactgggtttcaccgtttctatggtctctatctcctgacgtggtgatccgcccgcctcagcctcccaaagtgctgggattacaggcgtgagccaccgcgcccggcggttcaaactcttggtctcaagcaatccttctaccttggcttcccaaaatgttgggattatagatgtgagccactgcagccagcctgtatttagaattacatacttttctcagtgattgtttaatatctctcttccctgctagattatcaggtctgtgaggatgaccctggcccataccaagttgcccttcatatagatctgctgtagactatgtgctacaggatctcagtaaatatagattgaatgagtgaatgaatggtagatctttactcatgccactgaccctctaaacaagatcaggctgctactctttggatgtttttggttttggttttggtttggttttggggtttttttgagacagagtcttgctctgtcacccaggctggagttcggtagtgtgatctaggctcactgcaacctacactttctgggttcaagcaattctcatgtgtcagcctcccaagtaactgggattacaggcatgcaccaccacccctggctaatttttatttttatttttattttttatttttagtagaggtggagttttgctatgttggccagactgctcttgaactcctggcctcaagtgatccatccatcttggcctcccaaagtgctgggattacaggtgtgaaccaccacaccggcctaggatgctactctttgactagggccccagacagcctcttccgccgagcatgcacaaaattcaccaggaaggtgaaatatgcttttggcatttggtagcaaattctcaaaggcagaaggttactgtccccacagtctgcaaccagttataagtaccttttgtgaatacacatagaaataaaaatcactgattcccaaatggtccaaaaaatcaaatgagtagtaaacatttgtgaaaatatttatccttatcaacattgtaaaatacaaacattttagagccacatataaaataagccaggtgtttcaaagggagtcctcattgctggagagaatatggagaaataggcatactcaaacattggggtctgtagtataacagtataatatagctgtaaatatcgaaagacctaaaaatgttttctccagtaaatctgtttttggaaattatcttaaggaggctgggcagggtggctcttgcctgtaatcccagcactttgggaggctgaggtgagtggtttacctgaggtcaggagttcgagaccagcctggccaacatggcaaacccccgtctctaccaaaaatacaaaaaaaaaaaaaaaaaaaaaaaaaaaagccaagcgtggtggcgggtgcctataatcccagctactcgggaggctgaggcacgagaatcgcttgggcctgagaggcagaggttgcagtgagctcagatcgtgccactgcactccagcctgggtgacagagtgagattccgtctcaaaaaaaaaagaaagaaagaaaaaagaaattatcttaaagagaaaaggatctaaaatgcaagaaagatttatgtacagtgttttaacaacattatttctaatatttaacattggaagagtagtcagataacttatatccctatattggaaaattatgcagggttttacctttctagtaaaggcagactaagtaatttgaaccaactcttccactgaaggtaacttaaaaagctgattaaacaaatggtcatcctaaagtcatcaaagagcacaagatagaaaagaatcaatggccatgtctgggaaaaggttgaaacaaaagagatcaacgcctacgagcgcttttgcccggacattatctgcctgtctggcagtgcagcctaaaggttgagctgggttgtggatagcctttagaggaaaggagacaaaagaagtccagggtttgccaggggtagaaagcccaaaaggaggttaaatagaaaacatgtagtaagataatagatttaaacccagatatatcagtaaatgaactaaaggctttagtagtagtagttgttgtcatctgtaagatggttaggatgggtttttctcaaatacctaaaacaagggtactgaaagtttgaagtaaaaggatggagaaagatgttctatgcaaatagcaactgaaatctggtgtagccatattaacatgaggcagaatacgtttttagatataaaaaccattacttcataatgatgaaaggttcagtttacttggaagatttaacagttctaaacctatatgctcaaaatatataatacaaaactgaagaattactaagaaaaatatacaggtctccaatcatggagggaggttttaactctcagtaattgaaacagcaaatacattttttaaaaatgtataatagagaaaacttaaaacaacagttaaacttaacctcatggacaggcggtacagagaatattttaccctacaactgcagatacgtatttcttgcaatcacacatgaacatttaccaatattgaccatatgctaagcaataaagtaaatcttacatatcaaaagattgaaatcatatgtgatacatcctctgatcacagtgaaattaggctaggaaaaaacaagacaactagaagatctgcatatgtttggaaattgagaaacaggtttctgaacccatggtttaataaagaaataataatagaaattagaaagtattttgactgaaagataatgaaaatttgacattaaaatttgaggatataactaaaatggtatttgaaggaagttttacagccctctaattcaaatatcacaaaagaagaaaggctgagcagggcacggtggctcacgcctgtaatcccagcactttgggaggccgagccggtggatcacctgaggtcaggagttcgagaccagcctggccaaaatggtgaaaccccatctctactaaaaatttaaaaattagccaggcatggtggtaagtgcctgtaatcccagctgctaggggggctgaggcagggggatcgcttgaacctgggaggtggaggttgcagtgagctgagatcatgccactacactccagcctgggcaacagagtgagactctgtctcaaacagaaaaaaaaaaaagaagaagaaaggctgaatagtaatgagctaagcattcagctcaagaaattgaaaaatagaaaaacctgaaacgaataaaagaagcaataaagagaagaatagaaattaatgaaatagaaattcagaaacatcagaatcaagagttggttctttgaaaaggccaacaaaatcgatacacttccaatgaaatggacaaaaacaaggaagagaaacacagatagtagtaggaatgaaaaggaggtacactgtagatcctgtcattaaacattaagatcctgtcttgtaaataaatacaagattattttgaaaaaaattataccaaaaatattaaaattatagatgaacaaatttatagaaaaagacaacaaaattgacacaggaagaaatagaaaacctgaatattctcataactattttgaaaagctaattagtaattaggaaccttcctacaaagaaaatccaaacccacatgacttcactggctagtttctaccaaaaacttaagaaaaaaataactccaatcctatatccactgttgcagagaatagaaaaaggttataacctccaatttgttttaagaggctatcataatcttggtaccaaactcagtaaagaccatacaagacagaaaattttcaggccagtttgaaaaatatagatgcaaaaatcctaaacaaaatattaataaagtgaatctaacattatgttgaaagaacaatataacattacgaagttgggtttattctagcagtgcacatttggtttaactgtgatgtaatgttaagggaaaaaatgtcaagacaaatagatgaatcccaactatgtaaaaacaaacaaaaagtaaaactggaaagaaaatgttaatagtggttgtctctggttgacaagattctgggtaattcattttccttcgtgtttatatttgttcgttccagagtttctaaggtgagcatgcatgactttctaagaaggaaaagcaaacaagaaataagggcaagtctacatagataaagatcgtatagtgagacaatgtcttagtgtaacaatccttgtgacatttgaaatttcataccatatctagtaccataccatagtgagccaaaggaaaagttacaccaatacactcctatgtgacttgcttatcggaatttttaccccgtagaaatgaacaatccctccctccgcccctgtcattttttttcattctttaaagtctgtcatcttaaacatacttgaggaactaattcataggtaggaactttatagtggattctgtttcaaaatgttgattccttgttatacaaataaagtggtgtttattagaatcttggtaaatttcttggatatgtaatacttatacatgtaaaaaaaatttcaggtaactaaagtgtctgtagtgaaaatgaagtctctcttcttccatcccctaattccccttccagagacaataattgttcctggtttcttccatatctttccagggatcatctatgtatatgcaagcacattttgtatatgcatgtatgtatcataggtgtgtgtacacacaagcacactcatacctatacacacacatttgtattcctcccttttttaaaaacacaaatgggggccggcgtgatggctcatgcctgtaatcccagcactttgggaggccaaggtgggtggatcacgaggtcaggagatcgagaccatcctggctaacacggtgaaaccccatctctactaaaaatacaaaaaaaaaaaaaaagccagggatggtggcaggcacctgtagtcccagctactcgggaggctgaggcaggagaatggcgtgaacccgggaggcagagcttgcagtgagccaagatcacgccactgcactccatcctgggtgacagagtgagactccagcctgggccacagagcgagactccatctcaaaaaataaaaataaaaacacaaatgataacaaacattagtgttctgcatttttatcattttaacagtatattatagagattcttccacattaatactcatattgttccacatataaattcaccaatttctttttaactactatgcagtattccacagtatattgtgctttcaaattaatttttttgtttgtttttgaaagagtctcattctgtcacccaggctggagtgcagtggtgagatcacagctcactgcagccttgacctccctggctcaagcagttctcccacctaagcctcccaagtagccatgattacgggcacacactaccacacctggctagtttttttttaattttctttttgtagagatggtgtcttgctatgttgcccaggcttgcttctgcctcccataatactgggattaccggagtgaaccactaaacccagccacaaattagtttttctgaaaaaagataagcccagttttctaatattaggaaagagaagctgtgagggttggtgaataaagccttgaaatctgggctctagttcccactctacttccgaacatgaacatggtcttaattcagttatgtgatctctctgagcctcagcatcctcatcttaaaggatttgcaagatacttcccatcactttttgacgctctgagtcaaaatcactgtgttaataaatgaagccctaccagcacttacaaagatcacaatcaatggaatcataactagtctttgtaaaatggaagtaaattatgaaaacaatttattattttaaaggcttttaaaaggattttttaagtaggaattccaactaagaattacattgttttccactagctgcctattaagaaggtggattgaggcaaagaaaaacattccaaaagcagaattattttcatttctgttactatgtttgattagaacagcctccctatccttaaagccattgtagatgtggactaaattctgatcatgtattacgcagtccttaaagagaatgtgctgtcaatgaactgtctcagttcacatcctggccttgccacttactagctgtgtgaccttgggccatttacttaacctttcttgggtagtttatctgccctcataagattgataggattcagtaagctctaataatcatacagctcgtagaacagcacataataagtactcaataaatgttaactgtaattaataaataatggaaaagcagcattctgtggctggtagagcagatggggcacaggtgtcgaggtttggagtcatagacctggcagagccctcgaggagatgtatgttggctagaagggggtgacccagaatggaaagggaaggagagtggggagggggcaggtctgtaagtctgtgtcctaggaccagagaacttagaagcagcgtacctcccagcaaatattttttggtgtcccagaatggatatacgctttataaataaaaccatttgtttgagaagtctgtttgccataagggtggatagaagcctttcagtttttctttcaaggaggaatgtggcataatattttatatcaaccacgtcaatgaatgttttttgttatttcttttttatttatttatttttctttccatcatacctagtcctgcagaaaagggtgtttttaaaaattacgtatttgggcctactattgtaaggcattgtgctagacattttgcaaatgctttatctttcaattttcatggctaccctacaagatattgttctcattgtgaagagaggttgtgacttgctcgaagttatccagccagtaagtgataagaccaaaattttaagtcagatgtctgattccagagtcgaccctgagattgttgataaaacaacctgaattttcagtcctaagaatggctattacaattgtctttatatgctatgagagagaagcttacagatgaagcagatatgacaagagtttctgcctaggtactgagagctaacatttgtgcttggatcttggcctaaataagaaaatgacaagccaaagtccttgagctttccagtttggattcttgtcggataatctactacatccttcagccaaatgcctgctagaagctggaatcataccagaaggaagcccaagtacattatggggaggatgtaacattacaagacttccattcttgtccaagcttctatatacatcctggcaccaaactgagcctcaattcccttgtctgccaaatgttgccagtgacctttcccaccaaccatgtggaggtagtccatgcaggtccttagaagaaaggtgccgcttgaaccaacttattctttccacagctttaagagagaaagtggaatttcccatcatcagggccaatataagcctgaaattaaactggctttatggaatactaacaaagtgtcagacaccatctttctgttttatccctgactagtctgtcattcacagtgcttaaagcacagtcattagaatcaggcagaccttgggtgaaccacttgcagcctgtgacagtggacaaattatgtcatctctgatttcatgtgtaaatggaggtgaatgaatctatttcacaaggatttggtgagaattgaatgagatataagtgctcttattataacaacattttaggccatgtagtcatcatccttgttttatagaagaggaaactgaggggtgaagtgatttgctaatatcacatgaacaataatgagaggcctggaaaactgtcttttattcattaagtctggtgaaagagctgaatctaattattgtatttcctaaatagaaggtggtgtagagagagacttcagttgctctgtaaacattaattcagcttcctttgatctttccttttgaaggagattcacagaatgtttaagttcatccattatttcagcacttaatgaaattctcatttcctaattttaaggttatactgaggaagggcctcaactcaccaggtgggtagtcatgcaggagggtggactatgggaaggaagaacatccagaggtcttagtctgagagccctcatttaccttcttaattttccccctgaggccccaggagaggaggcaactcctaggagctgcccagattacctggctgcccctccatgggctcgttacagttcctacctttactcctctctgatcactgattcccctgaatggatttgccaagtcccacactagactgtgaccacccctcacactggagaggaacccagtctgagtcccctctgcatcctggtgtctgtggccaggcctggctctttccccctgatagagtgagcctcctgagcccctcacatctccaggcttctcactggaccaagtacaagatggcttttaaggagaacttgggtttgaataagcgtctttaagtgtaggggtttctttgttggactaccaccaccactacaaaatagaaacggagagagggaagaagcagctgtagaaagaggatgaaagtcagctttatcctggtgtgcttccgaccctctttgtgatgcttatttataacgggctgattcttcctcctgcgtgtgctctgtgccagctctggagactccctggtggttccatgctgcttctggaggctctgcctccttcagttacaaattactgatctccccaatttctatcatgtgacttaagcacctcctttattataccacaacagcactcttcaaatacacaagaaaatgtgatcatgcaaataaactcttatttacaaatgaaaatgacttgtgatgttcgttttacatattttaggttgttattgctgaaagccagttaacctgtctggctttagcggggaggtgttcactgtaaggaattttctgtagggtgaggatttttatccaagtcgatattgcataatagctccctgtttgctgcacgctattagaatttaaatgaaacagaaacattattcgccacatacctgtgagtccttgtcttcctctctggttaatgtggactggttcgcactataaaggcaggatatttggcaccactgtgtaaccttgtacaagtcctccttctttgtgggcctcatttcccctgctgcaaaatgtgatggtattccctaccctgtaaagcgttgtgaggcttaaaccattgaaacaagtcagtgagattgtgtacagtaaaagcccatagtgaactgcagtgcactatacaagcgttcaccattactgagtgtgtctgcctgagactcagaggccaaccaactgtcacagacaccatagcttgtctgagcatgtgtgtggtgaccctttccctccctgtgattcctgttttctttccctctagccccttagacttcccacaggcccctttgggcattggccagcaccaagggtagctgacacctggggcaaaaagctgtgctgacctgtcttgaagcaaacttgtgccttgtccacagctacttttcagtaatgagtgtctgaattgtgctgtgtgggctgagaacttccacatgatttgcatttttcactctcttctttctctaaaagttcccccgtttccgttttatcattaggtagtaattagtattcaagggaaattggtcttaatatattaaaattggtttaagtgcatttagacctgtaccacagccaatgtcttattggaaaatgtaattggggactctgtgtatgtaattaattgaattacaattaagaactttcattaagcgatacactggtacattagagcagtaaggaagcatgtttgatgagccacaaaccctgtctgggctctaagtgagggcatggagatttgcatccctctgataggctcctggccccagaattcgccctgaaggtcctgactaatggtttggtaatgcatcaggtgacatttctgcagtgactctgaatgggaggtgggattcttccagcggatatgccctcatcctctgactctcgagtcagggaaagggacaccttggtgttgatcagatgttacagttcttagatattttgccatgtaaattgtcaaaaatgccatgctcctgagaagaccccattacttttcctgggctttgaacatggacaaagacatattggagaaagaggaaataatgagaattctgtcactaatctaacttccaagcaaacccataatgaaccattggtccagacccttaagtggtcatgcttcatcctgtaaagggtattggattcactttgggcacatatttgttcatgcattccccaaacattgattgagccctcctctgggccagccactgtgctgagacttagccccacgttatagagcacacaattgtgatcagtgctgtgaagggtagaaaagagtgcatagcaggggaccagagcaggtgagaagaatgagaggcttgagtaagaagaaaaaggagttagtccaataatgagtaagagaagaatgttccaggccaagggactgctcatctgaaggctttgagatgagaaggagcttggggtgtttaggaatgaataaatggaatggaatgagggagagtgtgctgaaagatgagactgagggatagcaagggtctaagatgcagagcctcgtaggccccgcttccatgatctgctctttttcgaaattctacaaacctgaaactgtttctttctgactacctcataaaacaagattaccttgatttattgaagggggtctgaaatctccatgtggaaagtcctccagcctggctggctctggctccaagagtttaatcaattaagcactgacagcaaagatccctaccccggtggtagcatggcagattctagtgaagggtatatcctactgcgtgatcccgatggctttaaagagattactgcagagcggtgggcaggcggggggcatgaacgtgtgtgtgtgttttagtatatcacctattgattgttttttagagaccagcaaaaataactagtagccaaagggaagtgtttaatagaagagaagttttgggcttatggggctttggggacttaaaaggcctctggaaaaaaaaatgtgatggatgcagagcgctaaggaagagttttctctgtgactcacttatgcatccagctttaagtcttaccgagggagtggagagttaggttttatccctgattcctttgctctggcatggccaggcgtgactgtgttctccttagataccattacagcccatggagttatgcatttccagcccatctgaggaacatttttactcacagaggttgtgtggtggttaaaggtgcaattttggaattagacctgggttcagttcctagctccagcttgtactgtttgtatgactactgtagcagaatgacattctgagtctcatttttctcacctgtaaaaagaggataatatccaacttaaagaggcattgggaaaaatggaatgagatgacgtctttaaaatgctgagcatcgtgctggcatgcgttaagcacttagtgtgtgttagccaccgtcacagttgttgaggcagaacccctgtccttgacaaacctagtctgttggggagtctgaatggaaaacgaggaaaggtatgttaggtgctgttagccaaggtaaatacaaggggtggtgtacaaacctcaggtgctgttaatggttaacctgtgttgcatcacacttcacttgttccatcagcagcatttattgaacatctactgtgtgaccatgtgctttgtagaatgggatgttcctgccctcaggctccttgtctggaggggagtgcaaatacttaccatgtaagatacttaccagaagaaccttcaataaagggctataatgctttaggagagagacaggggaggttccatttggactagaccttgaagcatataaattttagagcataaaggacattctgaccaaatggtagaacctgagcagagtccagtttagctgaagcagggcttctgcgtggggagtagcaataagacttcaagatagagtggagcagagaagggtttatgtacttctcattgtcagtcacttgtactattttacttaattgtgtgccaggtgctgagctagatactgctccacttttgaagaactactcccacccccaccattttcttttccaccattccgcttcacacactgtgccaaaggcaaacacttggtgttccctgtgtaggtcctcatgctttgtggactttatgttttttcctatattcctccatggattgcctgtcctcctttcatcatctgggaacactgccatccccctaaattccggaagcactagcacagcacctggcatatggctggagctaagtaactgctagtctagaagaaacagtcaacaggattgtgctatggacaaaggtgaggatataacagaggccactgatcttccagttgagttctagagttggcatagatctttttagagaagagacactgaagttgctttaatttataactagattggggccttttagacttggtgtaagactccttgaaccataaaatgaatgttaaagtcccatgcagtttgtatctatgagtacaaggaatcttccagtaatatacggtgagttcatctgagctatgatttaatgattagtcctatttgtttgaaataaagtcatataactctaagtgtctccctcagttccaattaaatcacatctatgaaaacacttttaaaactataaaacagtatttataattagccttggtctgatcacctgaaagtaaacctattgcttttatgtgtgtacaggctttgcagctgtgtttgttgtcagattataacacatatacacagctataactgcactttcgtttcccattattattgtccaaatagatatcaggggcaatgaaaacatggcattataaccaataaagtcagcagttctcaaactttttggttttaggacctctttatactcttaaaagttattgaagacccaaagagcttttgttttgttttgttattttgaggcgaggtattgccctgtcgccaggtctcgcccaggatggagtgcagtggcaaatcagctcactgtagcctcaaactcctgggctcaagtgatcctctcatctctacctcccgagcagctgggactacaggtgtgcaccaccatgcccagctgacttttttttttttttttttaactttcagtagagataaagtctcactatgttgctcaggctgctcttcaactcctggcctcaaacagtgctcccgctttggcttcccaaactgctggtattacaggtgtgaggcactgcacctggccaagcttttgtttattgagttacatctattaaaaattgattaattttaaaatatttattgaaaaacagtaatttcattaatgttaatgacagttttatgtttttttgtttttttttgtttttttggttttttttgagatagggtctctgtcacaaggctagaatgcagtagtacaatcacagctcactgcaacctccacctcctaggctcaagcgatcctcccacctcggcttccccagtagctgggcctatcggagcacaccactaagcctggctgctttttttttgtattttttgtagagatggggttttgccatgttgcccaggctggttttaaactcctggactcaagtaattcacctgccttggcctccagaagtgccgggattacaggggtgagccaccatgcctggcccaaatgacaaattttatgaaaagtaactataatttctttaaaaaaaatttttttgagacagggtctcactctgttacccaggctagagtgcagtggcgtgatcacagctcactgtagcctcaacctcctgggctcaagtgatcatcccacctcatcctcagtagctgggagtacaggcatgagccaccaaacccagctaatttttgtattttttgtagagtcagagttttgccgtgttgcacagggtggtctcaaactcctagactcaagcaatccacccacctcagcctcccaaagtgctggaattatattcataagccaccgcacctggcctaaattttttttttttttttttgagacggagtcttgctctgtcgcccaggctggagtgcagtggtgtaatctcagctctcacttcagcctccgcctactggcttcaagcgattctcctgcctcagcctccagagtagctgagattacaggcatgccccgccatcctcagctaattttttgtatttttatagagacgaggtttcaccatgttggccagggtggtctcaaattcctgacctcaagtggtccgcccaccttggcctcccaaagtgctgggattacaggtgtgagccactgcacctagccaggcctaaaatttttaatgagaagagtgtcattattttattatattgcaagtttctgtaatgtctgggcttatagaagacacctggattttcatatctgcctctgcattcagtccgctgcaatacattgctttggttaaagtatgtgaagaaaatttggcctgacacagatatgttgttgaaaaagggaagaatatttcaatagccttttcagataattgtgggtattaatttttgttactataccaaaactcaaatgatagtttctattttgttgttgtttttttgttggtttgttttgttttgttttgttttttgagacagagtttcgttcttgttgcccaggctggagtgcagtggcgcaatcttggttcactgcaacctctgcctcccgggtgtaagcgattttcctgcctcagcctcccaagtagctaagattacaggcgtatgccaccatacccagctgattttgtatttttagtagaaacggggtttcaccatgttggtcaggctggtctcgaactcttgacctcaggtgatccacccacctcggcctcccaaaatggtgggattacaggtgtgagctactgcgcccagccaagctttttattcctttgtgcacttgtaagagaatggacatgaaaaaagtaagtcatgtcttgctgttgttataaaaatagtattgcaattatggaccctgaaggggacttgggaattccccaccaccaccaccaccataggacccagtgtgcactttgagaaccactaatttagaatttacagttattcgactcaacagtctattacagtgctgttgctgtaggagtgtggtgaggtaggcagggcaggagcagcctttaaccacttgagggaagggaaaggagaaggcacgtggactccagagtccaacagatctgtcccggtttcacctttcctaacagtggaaccctgggcaaggttttgacccagtcttgacactttgagtgacagtttgaatctctatctctgtactcttatattccatgttctttctaatgttattaatccccaaggctgcctcccagcaccttctctttctttcttggctgcaggccctagactccacctgcctccttcctcaactcctctctgcttccctttgcctgccgtggcctcttcttgccattcttcactgaagacaggtgtgaggcctcattcctcagttctcctttcctgattttgtattcccgagacttaagctgcttctcctcctgggttttctgcttgtcctccataccttcctacattgtgattgtcattcttctggagccttgttgtcagtccatttgagctgtggtgctcaagtcactattaggccccaccccaaaatttgatctatcacaatacatctttgagttattgcagcttgagcgttttgacacaatacattatggtaatccgtggcttatagagacattaaccctcccgactttgacaaaatacattgtgaagtctttgaaggcaccataacaatttatcttgtcattcacgaggagacccagttcagcattaatgtagatgaacacagtgtggcttttgtttcatttaattgcttgtgacctttttatttgctaatttaacaaaataccaatgggttatatttcagttaaattaacagggagtagtttttgttttttcagtatgtttatttttaagatgttctggttctctctgcttttcactttgagttgctaaaaatgtcttctcttgaacagaagtggactttttaatgtgaaggttgtcgtagagtaattttaatatgcagatggtacaatatcaagcatctttcatctttcatgtgtggttgggttcactcctttctggaaagatacaaacagtaaacgtatacatgcaaagtcatagaacttttctggtccaaaaaatatgcttttggaataatgaatgctttgcttcaggtatttgtctttagataaagtgtctattgcaggcaccatttttaggcacttctttctgccttgtactattttctggcctttggctaatttgtaagctcctgaagatcaggaaccctgctttatcctcaccagtgtcccccaccgtctagcatactgctagcatgggcagagaagtggttgcaccattgcatatacaatagacatgacccctccaacaagtggtactcctgagcctactttgagaaatgacactggaggctgggcacggtggctcacgcctgtaatcccagcactttgggaggccgaggcgggtggataacctgaggtcaggagttcgagaccagcctggccaacaaggcgaaatcccatctctcctaaaaatacaaaaaattagccaggcgtcagctacctgggaggctgaggcaggagaattgcttgaacctgggaggtagaggttgcagtgagccaagatctccccattgcactccagcctgggcaacaagagcaaaactctgtctcaaaagagagagagaaagaaagaaatgacactggaactccaaaaccagaagttgatcccattcatcagataacctgctttggagtgagcagcgtgaattggaggcgagtacaggactattccttctgtactccctcaggtgctgttatccttctgatcataaacacagacatgccccttgtcagttggggcaaggctcagaactcccccaggtatcggggggacttaaatcctcaaatgggatatgaatttacgctatcagagagtagaaggtcaatgcaagaagcattactgtgttgagccagctccagctatgtaagtcttgtacaaaattaatacaaggatattgacaagccttgctggttatttcatagctttaagacctctactaaaatcctatcatctcatctgcccattattaacatttcagcaaaatataaagttttcattaatctcccacagcaaatttaggagtgaaaactggcacttgtttgagcttttaggactacattagctggtgtattaaacaaaatatgtcattcttcagtagcttctgtaagaagctaaatcaatttccagccatatttatgcaccactttatctaaaagcatctgaattatcatttatagctaagatgctttattagcagctggcattgaaattgctcagtaaaaaattatatgtcacgttatagtaatttttaaattggttttaatccaacatcataaaatgtaaaaatcttaagtgtgggttttttttttttttttttagtaattggcattttagcataatgagctgttacctctttccaaatcaaatacctgcaatatttagaaaacactaattagtaaagcaaacagaagttcttgagctcagagctaaattgtatctaataatagcattttctcagaaaagatgacttgaaatgatttttaaaacattaaatgattttaatattttaccaaaattctctgcaattctcatgtataagaagttctaaaatagaaataaaacatgttttggcagttatgtttcagtaaaaatgactggaaaaagtgaatgattatttgaaactccaaatcctaaccagcctcagtattacccaggagagagtggtaatcaggatcatggcatctctgtccaaaatcataggtgctgcaaagaaaggaaaggggctacccagtggcccttgcagatgtggagtgaagctctgcagtgtcctggaggtgcaatgttggttaagtcactctgtctctttgaccctcaccttcctgtggacatggcacctggtattcgttcagtacatgtttattgagctctgctttatcctctgagtggtagcactggcagtgtctgagttgcagtggtgagaaagcagtccctgtgttcttggggttatagtctaatggcagagacaggcaattactccctgtgataactgttctgaagaaaaatgcaggatacggggacagaaggagccaaactagtgccgggggcttgcggccagggaaggcttccctggagtgtcactggtgctctgctcttcagtaggaaaacagggaggggccgggagagaatgagatggggagaagggtgacctgggcagagaggacagcatgtgcaagaggctctgagatgggattctgccagaggcactcagtgaagggcgaggtcatgtccttactgaaggaaagtactattgtgggtgctgggatggtccaggttgggaattactgtagtgtttgcaaatagaacacaaatttcctaataaatgatttcactgtgaaagcatcagacaccaactttgacttaaaatacttgccccgtaagcagtaactgtgggaaggaaaagcatatcattgtcaggctaccagtttgttacaaaattttccagttttatacccaaatctagagttttccattccccctagagttctccctaggtttccctgtggaactgtctctgagtgctcaacacgaggcctagagcaccctactgtggtcagcccctgcgagacaggctcctcccctcccaacccattctaccccctgcactggtgatggcaccaacagctgcatctgcagaagtccacatttcaaagtccagggactgagagatagtttaactttgcttagtgtaaccttggcatgtgacagcctcccaaagcctcagagttctcatctgtaatatggaaaattataagaccttcaatgcagtaacgtgtgaaatgcttaacaccaagcctggcacatggtaagcactcatgtatactagctattatttatctagcacaatttagtgagagcataccagttgcctttactgcttgcagaagatataaaaatgagtaagaaactttcctgaccttcacaaagcttccagattaggacagagcaaccactaagcaattctagcacacggctgaatataatccaccctgacactagaagaaaaatagtcactgctcttatgaagcatacatattctttacctaaatttggatgtgaatggcaaaaactgaaattcagagagataaagtcacttgcccaagatcatacagcaaattagaggcagagctaggagttgcggccgcagctgtcgggctccagggtccagtataagccaacttttatggaattcacttccagaagaaccatcagaaaagatttcacaggagaggtagagtttgagctagcctagggaggggtggagggatttcaacaggtctgggtgaggatgagagggttgttctaggccaagggcagcacatgagcaaaggcccagaattataaaagcctgaagcactgtgcagtctgaggggtttgagagggctgagagaaggcatgtgtgagaagtgagaagaatattggtatgtttcaggcacattatgggctgccccgattgcctggctaaaaaagtgttcttcattcaggaggccgtggagccagggaagatttttgagcaccaggcttcttatctgtctccagtgtcacatatcagagtacttagcatgcacagggtgctctctgagcatttggtgaatgaatgaatgatccaacctttagaaaaatggatcagaaagcctgtggcggctggactgcagaggaagagcctggtgaccaggaggccagtgatgagactgtcacactcaagcactagcaggtgccccctgagccagtgggggctctgtcagtagacagctatgtctatcaatagacagccatgtaaccttaagcaagtgtcttaatctttctgagcctcaattctatcctgcgtgaatgggaatatcagtaccaatggctcagggttgctatggggaacgagtgaaatcccacatggaggctgtggggcgcagggtgagaggcagtaaagaagacgttttgggaatcttggaaaggacagagattcttcaaggaatgtggattacttttgtgattaggaaaatcacatttagaaaaaaaacaagacccgtgacactgctaacaccacccaagctcttgtgcttttgactcactcctgtggactgagcttcctgccaagagcaagcaggaatttttttatccttgcatccctgctgcccagccaaggacctgccatagtgtttgtggaattaattgttgaatgattaatatgttaccattctctgtttactggaatggcattattaagtcatcgctcagccttttcttctccaaattaaatagcccatattattttaatttatcccaaagcattttaagcagacaccatttgccaagcctcatgtatctttatgtgttaaactgccttttcctccccaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtaagtgtgtgagcaggtgatgagctagcttgtcgtgtcagcagtcggtgtagaaatggggaaagaaacaacatacaacttttatgtgacctgaatgactaaaagtaatttgttttctgagaaaatgtttaaacaatggaatttgaagtacatcctttttcccacttgagtgctctgtcttgtcttcttttttatgaagcagaagattagaaatagaactaacttgagactcttttcaaactgattgacttcggtgaagttccataattcttttcattctgtaattctcttgcctgctctccttagaactgctttgtgacggtgccacctgcctgttcttaactcagctagctcattgcttattcattcaggcctttattcaggaagctttttaatgtctcagaaggtatatttggatcttcgtcatataatttggaactttcaactcatatttgggattaatttgttctaattatgtgctaaatttctgttttgacttaaaccggagtaggaaaagtgtcatagtaagcaacatactattaatacatcatcattatcatcatcatcatcatcatcatggctgccttttataggtgtctgctgtgtattagtcactgtgttaagtgctttacatgtactacttaactacctaaaaggtggggtatttttactgtccccatctaacagagggggtaaatgaggtacagagcagtcaagtctcatgcccaactcacacagtggttaggtggtggtgccaggagcaaaccctggtctgaccaactcaagtgcacctgctccctaacaaagggtctcccatgtgatggccgagggagaggaagaatgggtagtgatgccaggctcacccagtcagggagctgagctgcaccctgtctctgccacaccacctcttcctgcgtctccttttaactcttagggttcatttattttatgtttctcacaaatgctttgtatgcttgtcataataaaatcttttctaatgttggcattagtttgaacctggctaactcgtaagaggcctcaaaaatctcctcacatgttcctttccaacttgactgacaggaacttccaatatgctgacaatacagcttagtgattaagagatgggcaagagaatcacaaatggtttaaattgtgctctatcaatagacagccatgtaaccttaagccagtgttttaatctttctgagcctcaattctatcctgcttgaatgggaatatcagtagtaccaatgacgcagggttgctatggggaatgagtgaaatcccacatgtaaagcactgagtacggggcctgcagttgtaaacttccctatgtgagagctgttagttgggaggcagtagagtgtggtgctcagagggctcactcaggagtcggaggcccaggtacaaaccctgctcgtttattagctgtatcaccaccggcaaatgatgcagagccccagtttccttatctgtaaaaacaaagataatttttcaactgtgaggatgaaatgccgcagcacatgcagagaacttaggcacctggcctctagcaagtgcctagtgagcattagctgctaagatgatggtgattctagcaggctgatcagatgagacagcactcagtaacttcgaaccaaagcagaccccacctttttttcccctctgcattaagtcctcacctaatgtcatccaaaggttcttggaaactgtaactttaagtgaaatgacatataacaaaactcattttttcccttatcaacattataacaaaacgacattgaacaaaattatgtacatcatttcacttaaagttgaagtttccaagaacctatgaatgacaataagtgaggacttaactgtagctcttcttcctcataaaaaccttaaatatctaaagtggtgaaattgcttatttagtgttgattcttaaatcataaagtcattcagtgttgttcctcctggggatgtttttcctactgtatttcagaaataagactgatcaaaaagaagccagttctcaaaaataaataaaagagtacatactatatgattctattatatgacattcacaaatacaaggaaataatcttatgtaagaagtaaagatactggttattccaggtaagatggttgtagtggctggagaagggcttctgggaagctggaaagggtctgttttctgatctgggtgctgattacatgggtctgtagactttgtggaaaagtcatggtatatatactcatgatttgtgcactttttctgtgtgtacactttctttcttcttcttctttttttttttttttttttagacagagttttgcttttgttgcccaggctggagtgcaatgacttgatctcggctcactgcagcccctgcctcctgggttcaagtgattctcctgcctcagcctcccgagtagctgggattacaggcgcccaccaccatgcccagctaatgtttttgtatttttagtagagacggggtttcaccatgtggccaggctggtctcaaactcctgacctcaagtgatccacccacctcggcctcccaaagtgctgggattacaggcgtgaaccaccacgcctggccacactttcagtttatgaaagtaagaatgccactcaaacatccagtttgtgtttagctgcagtacttgcccaatagcaaagggcctgctttttctgaatgggcctacttttaagaagcccaataagtaggctgggtgccatggctcacgtctgtaatcccagcactttgggagacaaaggtgggcagatcacttgagctcaggagttcaggaccagcctgggcgacatggtgagactccatctctgcagaaaatacaaaaatagccaggtgtggtggtgcctgcctgtagtcccagctactcaggaggctgcgatgggaggatcgcttgagtctgggaggtcaaggctgcagtgagctgtcatgacgccattacactccagcctgggcgacagtgttagactctgtctcaaaggaaaaaaagaagcccaataagtagcccaactgtggtcaagacagagggtcaaagcaagggcccaggtgagcatcatcagcaaatccatccccgctcattccccagtgtgaaaagcgctgccttggaatgataaccaagatcatgggcttctttccccacttttttccaaaggcaaaaaagacaaactttaattcattagagcctgacatgtaaattatttcaaaggaaaaagtccacaaaaggctttgtgggaggagcccaagctctgcagtcagtcagcactgagtttgaatcccagccttgccacttacctgcagtgtcacctggacaagtcttttcccttttcaatcttagttttcaccatgtatgaaatggggataataatgtttaccttttaacattctatgaaagtgtctggcccatagaagcatattcttttttttttttttttttttttttttccccgaaacggagtctcgctctgtcacccaggctggagtgcagtggtgcaagctcggctcactgcaacctcctcctaccgggttcacgccattctcctgcctctgcctcctgagtagctgggactacaggcgcctgccaccacgcccggctaattttttgtatttttagtagagacggggtttcaccatgttagccaggatggtctcgatctcctgaccttgtgatccacccgccttggcctcccaaagtgctgggattacaggcgtgagccaccgcgcccggcccatagaagcatattctaagcagtagcttatcgtagtgttattatcattgtcattattatttattttgcctattgccctctctccaggtccaccatcttgaaagtattaaaccagatcacttagatcagggggtggctctcctggcaaagttccacttgtggccataatggagacttgtcaggtagacatgaatgatgacagtcatgcaagtatctccctggttgttggaagtgaggcgactggaggctggggcgtcacttgtgaatgcttggaatgcttccagtgacacacatggcaccctctggtgtagagtcgcatttcagaggggcttctaaaagagatgatgtcagaacatttgtttctgtcctcaaagttcagtctttatcattataatcagaaatttcattaattagtcgtaaggaattttgtgacaatcagacagactgcccatgagtattatatcatgcactgaataaataaacccattttcccatcccacgtagattacacaggtatgtaattgaagaccctctctccctccttacaaagcagatatcaccctcacattctaacaacaacaaaaacccacacctagcaatccagaaattctttcttcctgagacgttctactgccaagagtagggaggcaaacagcacaccctgtatgagtattcaagtgagcagctggattttgagacgagtaaataatttattttatttcacctgactagccaggtgcttcaggtccttcctgacactgatggatggtcacctccacctgtccatcctgtgtcaatcagaacagagatttcacttggcccctgtggcaacatcttttaagtggaaagtaagtgtgtggcatttgcccagcatccctgctgattccacagaaaaccactcatccatgctgaattagtggtagtaagagctgcagctgaggatcagaatccccaggctctgcagtgccacccagttgcttgtcttctgatggggtggtagtggcctctgttccagttgtttctgagaaagtcaggggatgagagactcaaattttgacctgcaagacccaaacttaagtcgattttccaccagacttttttttttttttttgagatggagtttcgctcttgttgcccaggctggagtgcaatggtacagtctcggctcactgcaacctccgcctcccgggttcaagcaattcttctgcctcagcctcccaagtagctgggattataggcatgcaccaccacgctcaactaatttttgtgtttttagtagagacggggtttccccgtgttggtcaggctggtctcgaactcttgacctcaggtgacccacccacctcggcctcccaaagtgctgggattacaggcgtgagccaccgtgcccggcctccaccagacttttctatgaccgaaaaaccccattaatgaaacatatgacacagctctggtcttttaaaataatagtaatgagaaatagaatttttacaaagcagttattatcaagtgcttactgtgtgccaagcactttgctaattgttctctttgcatgcgctggcgcctgaaatcgaagcactcttattagatagtactgattttatcaccattttttatatgatgaaactggggtgtaggaaaaatctagtaagtaatcaagccggaataagaatccaagactgtctgaggttgagtcctgagcctaactgctctgccttacatgcgaatcattgtgctaaatctctgtggaactatgacaacttacaatacaccaagagctttctccctgataacctcatctaatctacacagcacattgatattgttgttcccacttcatgactgggaaaactgaggcttggaggagtttggaagaacgtggtttatgtaaaccactgtgttgagaggtacctagctgttagtaccaactctcccacacctcagtcatcagatatacggagacttccagcagaattgaggcagaaactcagtcccatacgccagacccaatctgtcataccacaggtgccaatccacaggtgtcattaataattcacccccagactgggcaggatggctcagatctgtaatcccagcactttgggaggccaaggtgggaggattgctagaagccaggaattcaagaccagtctggacaacatgacaaaaccctgtctctacaaaacatttaaaaaccttagctgggtgtggtggcgcatacctgtggtcctagctacttaggaggctgaggcaggaggatcccttgagcccaggagttcaaagctgcattgagctaggatcgtgccattgtactccagcttgagtaacaaagcaagaccctgtctctaaatttatatatataaagaaaaaataactcaactgcacaacggaagtgattacttctagttggccagttcctaaacttgtgcatattcctgctcttctcccgcccctagtatctggagatgaatgtccacgtactgtgataccctcctcctctttattttagatgttgtttatcagccactgcgcttcctccctctgggcccggacctaacctcagaatttgttccaacacagtcctataagcaacccctacccatcaattgaaggtaattcttaaattgaaatatctttgccattcctgctctaccagcccagaatcttaccaaagtcatcattccaaaccattcctgtatttctctaaaacattcttggaatatttcatcttgtctgctttccctctgtcagtcctaaaaagtacagatgtccttcaagtgtagctttacttgagattctaccaagttgaggttatttccattaacttggtcttccatatacctgatcctgtgtgcctaaccacttgagggaggttgcacactgagatatgtgccacccaaacgggctggtagggggaagtaagttaggggaacattgaaacagaacgggtcaagcggagaatgcagccacaatctaagaaacccacagtatattatcaataagtatttgttggctggctggcagaagctaaattacaatgcaccagccaaaggaaagcacagaaaccaatgcaagaaccatggcagacagggccaagacatccccacagtgaacacctcttatatgcagagcacctcggggcagtgggtctgaccctgaacatatatcagagtcacccagtccctggcctcatcccaggcctgctggctcaatatctcccctagattgtggtgtttaggggacacaaactcacagtattgaaaggactttcttaccccttatctctttgtccaagcttgtttttactgactgggcaggtcaacctggtttttctgatgcagtctcacgctgagaagtggtttgatatttgcaccacttgtactcacttggtttgtttgcctcatttatcagtgtagaccgttcccatgtcaccgaagggatctgttactgaacacgtaagataccatgaattccatcctatcagcatcgcatctataacctaataaaataattctgtataagatatacagagtctgtataggatttatagataaatgatagaaaatgacttctaccaaaaggttccatggttacttccattatcttttcataaaactgtccagtatgtataatcataagacttgtgattatggtagttctttatgaaaatatcaagtacaataccacatgtcctagagaaggcaaaaaggtttcgtctcatcagctggctccagtcaagtttataacggctgcccagagcattatgctgaggcagcatctccagctgtgtctgagggcaacataaagaaactctgtgattgattagaaatgtctgccctgggcctgagcatgatgacaggcagcatatttgccatttcttgtcttccctgccttgtctttcctaccgcagttattatttaacccactagtcaataaccacaggccggcactcaaaggaagactttattatggtgttatttttaagtatacaacatgcaaacttaagaaacacggtaacagcacaatagtgagtgaaagcagcagcggtggcctggactgcctcactcctcaggcacactctcaggctaaacatggttctgggtggccacatgaataaaacattttcccttgttagtttccagtggggtacctgtggagtacagttcaagtaatcacataatctgaacatgcgtgttcttaggaagtggattgatcttccatgtttccatttcactttgccgttgaacactaaggaggtgcccctctccattccaagacacaatcaggaggaggcgtgcgtcacatttaactcaaatccctgggtccgttcagtaatttgaagttggcaattctgatattaaatgattgttcagtccctattgtgacagcatttcctgaaccaaactttggaattgacttatactaatgaactgatgaggcagaggatgcatgctatcaagactgcctccagaaaactccgttaccacttttgcactaaatgcagtgattggcttagggaaaaatcacctaactggtaatattggaaacactgtgggctttttcttaaggcctagcttcctctggctccctgctcccagagccacccttttgagaattcctatggagtaacccagggttattaatgacaatgtgtcaggttcctcaggtggctgagaaagaattgagaattggaagaagttgagaagcactggcatgatggaattaatgggagtcggattcatgagcgttcatccagagttctgtgctcctttaatcacttcctcatctttggcacctgagctccaacagggcctgaacatggggaagatcaggttttccccactctacaagtgatactgtaaattctcttagggcctgctgcttcctagctgacatcataggctcacctgaggtatccatttactgagagagtagtttggtgatctagctgtcctagtgcagaatctttgtaaatgccttctctgcagagagaacttagcactcattcaaagacaagtctttctgggattaaacagtcccaggtctgatttcataagctctgccctggtgctgtgtcctgtgctgactgctgctctgcgttcgttcgtgtccaggccactccttgttttgcgtgccaagcctaacagtctagtcaggtacactcggacttgtcattgagtctcttactgaccacatattggaattggcagcttttagctgtggttcccaaaccgtttcagaatggttagtcctttgaatgaaaccagtgatcctggggcctagaactccacttgatctcaagaaagtaaggctctactgggtttcattttagttgtgacctgaaatatggttttgtcatctattttgggtgccttaaattgctggagacagcgcttttttattgtaatgcatttgatcagtgtgaatatgcagtactcctgcatggcaggtgagctggtctgtttaagccctggcctggtagtatggggatatgaattatggttacagctctgtcattaatgggtgacatcagacaagtcatgtcccagccctgagcctcaattttttcatatggagaatgaaaaccccagactaggtgatctctaaggtctcattaagcccaaacagcctgtgtgtctgatcttgtgtgtaaattcagacaagtttcaaagacttccctgactgctctgtggatgctatcgattggctgtatatattcagcaaaatccactctggcgaagagttgttcagtggcactcccttgggggcttttccaggctttcataggctctcggtaacctgaagacaagaggattgtagaattgtgtaaaaagctgctccaggatttaacagcagtgggacttttgtagccttagattcaaagctgtaggaaattgatgaatgaaccacagcttatgatatctgagcaaatgataacaggaaatacactaagacatgaattgttaaatgccttaatttttgccaaagtggtgttttagcttttttaagggggtattttaagagtaccataggggaggttgtacctcccaagagtcaagcagtctcctctgggacaataggaaacagctggcaagtcagaactcaccaggcagctagacctggacttgaacccaagctctccagtttactaatttgattcaccataggctagtacattttacagaggagaatgatcaggctcaccaagggagcagtgactttgcccaggataacaccagtggggatgtgccagcataatcagggcctccaaatttgtggcctggagacccagtaggatgaggattccctagcacaaaagtttccacattccagatctgagaacattcttcctgatttgaattgaactcttggaggttgtgaggaggagatatgcccagtgacacttggtggtgggaggttactggggggatttgtggggatgaaggcattgtctcccaaactggatcctggtgctcccaagactgggatgtagagaaggtcccagggagaattcttctcgccctccaattccagagccaggcaggtcctttattcacctccttctcgtggctccctgagctccccagactcgaccctcatcactgagtctatgtcacatccttaacccagtgcctgacttctgataataatcattagaaggagtaatattcatcgctagctatgtatcaggcacaattccaagcccttgtcatgccttatttcacctaatcctcacaacaagcacttgaggtatctattattatgtgtattattatcatctccgttttatagaagtttttcccaagtcacgtagttaggaagtaggaaggctgacatttgaacagaggactttctgactccagatttcctacccctaagccccctctttaaatgtaagataggctaatagtgccttcctgattagaggtgttctaagctctcaataagcctctgtacacaaaaggacctagtgtgggggctacccagagtgggcgctcagtctgtgttagaagaagatgctacgcggtgctaatttccttttatggaaatcttggttagctaaagcagacaagggtctccttgtgataactctaaaggcttgcacaaatagtttccccagagagctgtatacacattagagttgcgtttttgtttattttgagctgtcttgttaaggaaggatttatatgctggcgttgatgtaggacagcaatcaggcaatgttttctgcctttgacagttggtgtgatagtttgcttccagtgaagtttgactcactgtatctggaagctgtcagaagtgggagcatgaaaaggtcatgacggatggctgtggataagtggttaggggagggagctggtaagggagacaaactgcctcccttgtttccaagagaaggggctgaccctggctgctcccggccagcccccgtgctcttttcttccccacctgcctgagctggaaagaagcctgccgggctccagttttgagaggggcaccaggttgggtgtagtgtagctcatgagcccttcccagcagcgcaacccctggcataccactagaactgctagaagttctgttaaagaaattctgctaaaaaaaaaaaaaaaaaagttctgctgaagaactgctagaaggaagcattctttcactgaggatcacttcaccattatcaagacttcagcatacttatccttccccacattttaacagtcgagaaaggatactgaattctgaagtggaaatcaaaaagtgtcagctttcaaagtgatgtttgtttttatttttcgtgaaatgtttatcttggaaaaaatacagaaaaggaaaggatataattctactaaccagagttggccactggcaccagtttttggagcacgtccttttgacatctttttttataaatggttttcctgtccttttcacttactattgtgttataaggatttttctagtcaaaacttttcgtggttatcttgtatttcatcattgttggatcaactattcctctattactggccacttaagttggagaaatgtcaatgtaacaaaagccagtttctcttatttccttggaaatacatttataatttgaattacttaaaacagtgcatacgtgacactgtaaggagtgcctctgccattccttaaatgactttacgcaaaaactttagccgaggaaatcaaaactatgctcggtggtcagaaagaatattgatcggatttcatgctccaatttgccatgtatgaacaaaaaatagatgtgtgcatttattggcatttgtgaacatttatttgttccttggtgaaaattgagagaggagatggaggactgcttgggcagagctccttattattaatacatcttctgacacggctgaggctgtgcagagcagcagaaagaacagggacttgagacccaggcagctctgggtttgaacagtggctgttccacttagatgctccctgacctaggcaagcaccttcccctctcctgggatatgttatatgaaacatttagcacagttcttgcagaatagtgtagtggctgaggggacacattctggaaccagacttcctgagttcaaattgcagctttgccacttctgagctgggtgatcttaggcaagttacttgacctcactgtgtttctgtttcctcgtcagtagaataggatgaacatactagccaacttcatgaggttattaagagatctgagtccatgcacacagtggatttctaaccatgctggcacattgttgatggcagttaatgttagctgttatgttaatactggaggtgctcagtgaatggtgtctataactggcgtcatgcctgttgggcctaaggagaaaattgtactgaatgatcgctggtgcccgagcctgccgaagcagaaacggcagtgagcctaccagggttgcacctttgctcttggcctaggcctttgccttaaggagtctgagctacagggaccgtgtgtgcagcagccctcttctcctggtgctctgctcacagggagacagtgctgcttctgcccacaacccactcactccccttagcatagagaagtggcagtgacaagtggggtactactcaacctccgcacttgcaaccccactagcctggcttccacaacctcttcccccacccctcatcactgcggcgatgccccaggaacctctctgactcccttctccctcacaccctgtgtgcagccatctgcctactcctaactcttttgtctttaatatgctcatccccactgcaccccagccgcgactgtccctgcccctggcctgggctgtggcacctgcttcctcactgatctctcctccaccaagccaactcctccttgtaaccaagaagactaccgagggctccgaagccaaggacagagaggcctctgtttgcctccaggctggattctgggcctcctttctcttttctgcagtaggtgtgcactcttcccgggggtgctcaggaagagggctgctcccgtggactgcctcaggccgagtgctgacacatggcggcaggagcagatagggtgctgcggtgctgcctgcgctgccttaagaagctgagactcacacaagtgttaagagggtaagattatttaatgtacaaaaggatttttcccatcaggaaagattcccctacaggtttctttaaatagtgactcctctaggcaggcaagtgttttacagatcattaactacttgactgaaagcctacagggcagagaaacttaaaactaaagtgttgggagcccctgccaattacagatcaatctaaaatgaagataaagtagctctggaactagaagtcagtgggaaaatgtgattcgattcagaaaaaaaaaatctgattcacatgcaacttttttggaacacaccgtctaaatgatatcccacctgtctgcccatcttgagcctattgcattcatctcctacatcttcatccccaagccccggtcttggggtgcccctctgtgaacagtaactgcacaataaccccaggaaagggcgtcattgggaaagtgttctgtggctgtgcagagcttaggcaattgatgcagagatactgctggtaatggatgaactatacggtaacaatttgcagataaaaataatagaagttaaagtgtactttacatgataaaagaaagatgaaagaggacgagagtctgttacatctgagatggttacaaaagtcctgctttgtgaagtaggctctgttgaaaagattgatgcaatggggagtgaccttggcttggagcaggagctggtgatgtatgtatgagcatccctctgctaaatggacccagatttgtagcactaatatacatgggagcccagaaccaaactcagtacggcaataaatcaacagccactttgggtgtcatttctggtttatattccactattgttctatcactttaattcatgtcactatcatcttttcatctggaacagttttatataattttccagtggagttacctgacaaatcctatcaaattaacaaggtacattaacagtattgactgactacagcttcaagagttgtaggggcatagaacaaaattttaaaaccatgtctctggtgatgatatttttccccattctttctgagaaaagaatgtggagcacggtttattttcacataagagatatgcatgtttattctgctcggctcattttgacttttataaatgtcaaaataagaagaagaaggggaacacacacatgcacacacacacacccgacaaccatggcttcagtacttctttcagggaactatagaaatgtccagatctttaacaattaatgaccaaattggaggcaagagtgtaactgggtagtcgtaatctattttaactgaaatgtaataaaattggtctcctgatacattctcaccctcctgaaatcatctagacctgaacgtccagagtcagctggacttacgacattatgcctaattgaaatatggtgttcctgaaataggtctaatgacaaattccagcgttcgattagtaaaaaataccaatggttcatctttaccaaagaccacacgtactgaccagggtacagcagccatctctgcattgtctcccctggaggcagcagaggagcctcgactgtagtctgtctgcacacattcttcttctgcctttgtctagctggtatttgggatttatttattcataaaataaaatataaatgtatggagcgtgtagcagacctaatcagtaggattttgtttgtatttgtttttttaattttaaatttgctgtcagactgtgtttggggtgtgtgtgtgttttattttggggggaggttaattgaactgtttcttttatctgctgctgcttttggcttactaagttttctcacattttgttcaaaaatttgagtgtgattcgtaggatgaaatatgttaactatgtcttttctgtttcactttgtacatttggttattttaattatttcttatatcttcattttgctttttttcactttgaccctgacctttaaactatggcctaaaaattaattacttttaaggttccatatggggcccactatagaaggcatgttaaaggtttttgtctcacttcatgaacagattccttaattttcagcaaaagaggaaaaagagcacatctagcctaggtggtgtgtggcgggctgagcatgtactcctctgcagtactgagaaagcggttgctgtgcatttccacacttattccagggcccctcccatacctggcattacctttgttctgcaaacacctttattcccggtcactatacaacgtgttgtcttttaagctctgaaaataaaatctgaagtgccagtattgaacattctggattcctgttgcgtaaaactcacacccagtgccgagtctcgccctcagcaggggggcaatgacctctgcagcctgaagccaggctccaagacttgaacttggaaggttttatgtaaggtttaatcctctcgtgacttcccttaaatatagcttggataattatttagtgtcacagaaaggaagagttattttattctttttagtgtataaggttgtttcagatcagaagctgttcattggtagcttagctgtttaaacatagggatgttacagatttatctgtccaccccagatcttcttaaatgagaacaacaactcagagcaccaatcaaaactgttttttaaataaacctgatggttatttcattacaatatagagataatgtacggctgtaaatagcctctctgtgttggatccatgttatatctaagaaggcttgtttcttaataccttctcatatagtttgggggggttcccccaccctcaactcacccacccaggaaaccagactatgcaacttgtgtgtgccatttggagtgtccttatgtttgtctcaggaagcccgtggcattccccaaagccctaagaaagagctcacgttcatgcaatttcagatttataaaacaggtcaaatgatttccctgaaatcacttacaccttctacttcttgtgttttcttttgtgtcctcaccttggcttacaggtatctctggagacaaagtagagatagaccctgttacgaatcagaaagccagcactaagttttggattaagcagaaacccatctcaatcgattccgacctgctctgtgcctgtgaccttgctgaagagaaaagccccagtgagtagtcccttttatttatgtctcctttctctctttcccctctcttctcttctgtgtgctgggtgccaggagaatatattgccactgtgtccttttttccttgggtctgttttaattcattaccagaaatttcttttaatcaaacgggattgtattatggtgcccagagcctgacatgtgccccatcctgttcggtcttgatggctgcagagaacttcgcagcccacctcctgacctcagcagcccagccccgggagctgggggcacagggccagatttctgctgggaatttgcactcaccagagccctcatttccctttgggctcccttccccttcccatttgggggacttgaccagtcagacctggacctgccttccttccctgtgagatggagggaagctggggatttcccaaggcggcgaacgcctagatttagatatatccatcatgccggaagtgtcagcaccccctagattattggcagctgcatgacctaccagctcatgattaaactcttgcctggtcctacagaagagatctctgctgggttggcattcctccgcttaaattatcaaagtagatacagtccagttatgtattttggcatattatacttttgcagttaagtaattgggtgtagcatttagattaatcacttaatcatttttaggactccagtcctatcaaggggcaaaaagggcacatagatcacactgaaattcctctgtgaaagaaaaaaatttaaactatataagagtttgttagttgcctagagactgctataagataatggttctcaaagtctggtacagacaagcattatctgcaaagcctgttaaatgcagttaccgagggcccaccctagtagattgtgattcagtaacttgggagtatagactgagcatctaatttttattaatcccgtgtccaacattcactaaatttgagaacagatgttataaggaattacttactcaaaaggaacaataagaaatgtaaaggccagcgagtgtttgtaatacgattcaagtttttgagataacgctgactaaacaggggctgacgggggctgatagactgggcacatgccacattgcttcatttatgggtgggtgtttaattttttgtcaaactctgctggactatgtgttcagctcattcgcctacagcttggcaaaaagggagaacttagggggacccaggggaaggaggaaggccaccccactcccttcctgccattcctgtcatcccagcgaggcctccgaccctgcaaaaggctgtgagaaaagtgcctgctgctggggggccttgcctcaaggttgctggattccctctgcctttggataaacatcttcctaatcccgctcacttcagcttgtcggccaataaagatgtcattgttctagcatctttctctccaagaacttaggatgctttgaacagtaacattttataaattctccatgtctctgagaaatgaaaggcaatcacttctgtgttgcataaagggataagctagagtggaaaggttagagaaagaaatagatgcaggattcaggttttttccttaacaaagaggctcactgcaccagtaaaacactgcctaagtccctgtcccctatggcagtgctttttaaaccgtgttcctcagaactctagcatctcagagagacctcaggggtacggggtgggtggtgggggaaggttgggcataaggcctccccttgaaccaaaggaactctacttagttgtagacacaaagtcttgctatgttgcccaggctgttcttgagttcctggcctcaggctatcctcctgcctcagtcccccaaagtactaggattacagacgtgagccaccactctcagccagaagaaaaatttgaaataggcttacagaataaaatgcagaccagcatagcctttgcagacattggcaagcagctgacacgctagcctcatagcccatagtttcccatctcacatttgggctgtggtcactgtaactacttgcacacgatgcattctgtgctgttcccactgcctggaatatgcctttcgaacctgaccccctctctaacttacaaacatttccacctccccgtactcagcctgctcatttttcaagacccagctccagtgtcaggctctctctgttcactttgccccccaggagtttgcacatgcctctaggaatacccctttgtgctgtatttatccattggaggcccacccgtctctcccacctccatctccatagtgaactaactgacccaagaactggcttccgtgtcctcactccctagcacggagcctgcagagttgtcctcactgaatgtttgttaactgaaaactgaacttactgaagccagaatttagaatccaaaagttattccacataatttatgttgtaaagtgcccaaagatgtattaaatgaatcggcttgatgttatgtgttttatgatttccagtatcttcatcaaattaattcagtgactcaatctagcaagttcatcctcagaccatagaattaatctgtggggcgtcttctgtttctttattatttaaaggattaatggtaaccctttttatcttttgtgtctgttgaaccttagaaaaaagttattttaacatcactaaagaaatgaaagtcactatatttcataagtttagcctgtgatttttatcagcatagtgatgtatgtttgtagctgagtttacatcaaaaattgttcttggggccttcttgaatgaattatggcaaagagagagagtctagaagtagataaggtttttgatttctgcaatatatttcctttttcatgtttttatctctggtagcacaagtgtcttgccgaagaccggaacgtgtgaccaactggaataatttagttgtgaaaacagagcagacatgttattaaacagctttctttacaaaaagacattaagtgtagggaggataatgaagttgtccccagtcttagttgagacatgtttgtcagaattttgaacagaaaagaaatggtttttaaaccttcgactgtggccagtttgcagtgtttattgagaaagccgctgtcaaaccattaatttggtcgtcataaggcatagaactcaagtttaattgatgccatatccaaaaagtgtgtgaatagctgacttggcaaagagactgagcatttgagcggctgcagggaaatacataattacacatactgcgggaccggagagacccaggctcagaagccgtgcttcgtaaacaacagttctgtggctctctttccattcccctcgacttctccctcttaggctggggtctcagagggaagatttattgctctgtccctgtgagtgtttaaggacttgaacttaatggctaaatagatacatgcctaaaaaattgtacatataaatatgaattcttaaaagagttatttgagaatctgtgtatcacaagccttgagaaattaagaattaaatcctgtctttctagatttaaggagaaaaaaaacatgctgccattattattcaaatgagtgattccctctgtcagattttgctattttgaaagacgtcataagcccctaaaaggtgaattgattttaatttattataactggtcaaggatgtattcaacacatacaagaggagaatgtttccgtatcagaaactaccatgtttaaattttcttagggaaataattttccatccttatatacctctagatacaggtctttttttttttttttttttttttttttttaatatatgagacagggtctcactgtgttgcccaggctgggctcaaactcctgggctcaagtgatcctcccacctcaacccaccaaatagctgggactacaggcatgcgccaccatgtccagttctagacacaggctttgaatgctgtggctctctttttaagtgctggcctcacattcctaccctgaaacaaaagcaagggacctttctgtgaagctggtacccatcagagacactcaggctgtatttcagaaccagactcagccatgccagatctggtttcatcataagaaggttgtgcaggtttagagtctttaaaggaagcagcctatcattaagaaatcagatttaaaccttaataaagtagctgtcatctttatagctgaaaagagcgctgtatctcaattaagcatagatcatataaaatcttaaggaagcaacataatagaggtaacctgattacattctcttgcaatagtataattcaaaggaaatctgattctgttcatgctggttatgttaggggatttcttgttttgttttgctttttgtccagaacaccatttggatgcaagataggaactctttggggttaagagttaagcacaactgcaggagactggtaaaccctagtgactagaacttgctggatatttgaaatgagattcagttaaggctatgagttaaatgagctgggcttattggtgacctaccacttaagtgaatctttcttttcataagtacttgacaagatctgtaaagtagtgtatttaatttactaattaaattaaagctactgaataatgatttgtccacattgatttagcttaaatagaaaagatcagcattgttgtgatcttcagcaaccttaatggccaagccagttagacacaaaggcctcttgtgttttataggtcagaaggacataggtaagtccaggctgtaattgaattgcctgcactgcaccctgcagtcgcagatttcctttgccttcccgttccattgttgcactggggcttaagagaatgttaacgcggtaataggcacagggccttccccattatacgtcttgctatcgagcggttctgcatgactagttaaagaagatggcaagaagattaatgaaagcaaggctaatacagaagggggtacttttgcaagacttctaccgaggagatattagagctgaaccagagcttggctttttctttatcctgtgacctttgaacctgccttactgttgagagctgccagggaagtcgacattttgattgatgttggtacacgagtcagtctttcccattgaattccacatctgtacaaaaatagcttttccagcagaattcatactggctagaagtgatagccaaattgatggctgaaatgcttgtgtgtagttttcagttaaactaagggtatttgatggtttaattcagtatccagttttcctagattatacaaattcacttacatgtttttaatgggttcattaacccatagtgaaagaccagtattaagaatgttcataggtttgcaaatagctccaaacaggctttatgaagagtaaaagcagtcagtcattaaacaaaccctgagggctcagggaaactgacttcagggtttatgtaaacaaagcaaagctggtttttggaaagctatagatgggctggtctgaaatctcacctctgcatcccaccttagccccagttcagaggctgtcttaatccacccagatgctgggttccctaaactggcattccagctgcaggggattgtcatgggccacttgtaagacagccttgtgaagatacaaacttcttcatatgttctcactgattttgttacttgtttgtagagctgcaggcctcacatgtatatgtgtggctgaatgtgccagtatgtgcattcctcacccccagcccacccccaacaaaggagagcagggagactgtggctgaaggattcatgcttgttactgaaatcaccctgggcacaccccagcttatccgtcggatcctcgccacctgatttctttctccctatttgacatgggtagttctagcagagaacacacgcatgtgcgctcttgcttgctcatgcgctctctctctttctcatgtgataggcattctagttcctaagggaggagatacccaggaattttgtcatattcttgagatgctctcatgaaatgtgtgaaagaggaatgaggatgactttagttacctttggatgaaagagctacagccccaaggtagacaggtggatatctacagccctgctggtgcactgagggcccagtaggtgaggcacctgcagttatactccagtataactggagctgcagcccaggaaggcaacagcccttcctcaggctctgtccactcccgggagatccaggcactccagacgttaggtggacacgttatgttgtgtttttattctctaacaagggcttatttcataagttccagatcaaatacagtaagtactgcctgattacagaacacaacggactctcacatattaatgccccagttattgaattgccttttcataagagtactctggagcacaatcaggagcaggcagtgcctcatccttttaacagatatgtttcctagccctattaaaaggggtcttcatctatcctgtcaaaggaagtctgctggggttttttagtttaattacactatccaattaaaactccttgctgcatttggatgcacctctccttgggcctgagtggatatgacatttacaaggctcgcctttcaagcagacaatagtgtgattgatgaggtgcacattcagtgaaggaggcgaatgcctgtggaagtgctgcttagtgcattttgatttatttctcatctccttccaaaacaagggagtgccggggagatgggtttaggcaaccagagggaccaccacaatttttccaagcgtgtgggagggaaagacttggagtgcaccacaggataaaggtggagaaaaaccgtaagcagacggccagcttgcgtcatctaatgttgaactgtcttcttaggttctctgacccagtttggtttccagtaacctcaagccacaatctgctgttaaacaggcaaatcactgtgctttcagggaacagtttggcagagttggatagcattggccaggtccctgagaactcagccaggccaacgtgtgtcccattgactgacctggtcatcatgagctgacatctgacttgtgctttaggcatgcctatttatttacactccctgcttcctccagaaatccagcagcttctgtccagtcatcaccagtgcttgatgactttttctaattctgcctaggcacaatgagatttaaaagtgcctctggaatttggaatcagccaagagcaagtgtggctcttcaaaaaggggtatgggagcacagtggagaacttctcacagttgtagtgacaagggaaacctaacatcttactcttaaactattgctattgaccctcagtgtatgatagatggtaccaatgtgcttgtctctgtagttcctataaaaaaggtgttttgatacagtgggccctagaaggatcaacactctgaatttcggagtcagaagattctcctctgacccccagatagttggtaagaagagcacacctcccatattcgtcatcaggcactagagttgctcataggggacgttatgtgtatgtttacagaacgtgtaagaatgtctacgaggaaaattggctggtgctgagatagtgagttttcttacattttctgtaaattttcttcatttttccctcggacgtattaataaacaagaaagaaaatttgtgttgattggaatattgatatttgttagagtagaaaacattttgagggtatcaacttttttttttttctcctgggagaagcctcctttttgctattaagttttcacttaattgttgacttgggctttatggacccattgtaacaaaacaattgcctaggtaaaatgaaaaatttctatacatttgcgttttcctagattttgattaccattttctcaaattcattctttcttgattttaatatcagaagagatcctaattgagaagagggtaagggcaggggctgttccctactgaaaaattctgtgtgaaagatttctcagctggataaatgatgggggataatctgttttcccttgcctcctgccaagctccaaattgtgttttcataataaataaatggagagcttagattttaagttactctcttagacatggaaaaagtaagccatagtttcattaaaatcaaagtgtgtattgcttataagactccatatgcgtccctctccctctccctctccccacggtctccctctccctctctttccacggtctccctctccctctctttccacggtctccctctgatgccgagccgaagctggactgtactgctgccatctcggctcactgcaacctccctgcctgattctcctgcctcagcctgccgagtgcctgcgattgcaggcgcgtgccgccacgcctgactggctttcgtatttttttcgtggagacggggtttcgctgagttggccgggctggtctccagctcctaaccgcgagtgatccgccagcctcggcctcctgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcatctctgcctggccgccatccgatctaggaagtgaggagcgcctcttcccggccgccatcacatctaggaagtgaggagcctctctgccccgccgcccatcgtctgagatgtggggagcgcctctgccccgccgccccgtctgggatgtgaggagcgcctctgcccggccgcgaccccgtctgggaggtgaagagcgtctctgcccggccgccccttctgagaagtgaggagaccctctgcctggcaaccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggggtcagccccccgcccggccagccgccccgcccggccagcggccccgtccgggagggaggtagggggggtcagccccccacccggccagccgccccgtccgggaggtgaggggcgcctctgcccggccgccccttctgggatgtgaagagcccctctgcccagccaccacaccatctgggaggtgtacccaacagctcattgagaacaggccaggatgacgatggcggttttgtggaatagaaaggggggaggggtggggaaaagattgagaaatcggatggttgccctgtctgtgtagaaggaagtagacatgggagacttttcattttgttctgtactaagaaagattcttctgccttgggatcctgttgatctgtgaccttgcccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagagggccgcagggtcctctgcctaggaaaaccagagacctttgttcacttattaatctgctgaccttccctccactattgtcatatgaccctgccaaatcccactctgcgagaaacacccaagaatgatcaattaaaaaaaaaaaaaaaaagactccatatgcaacttccaacacatggtaacttcgaccagattagcctttctatcgtaagtgatgagaaaactgaacaaaatataaaaaccacttttggacattagaaaatatgcagttcaggactgtgatccctgagagaaaggtaacaaaagaggtgagactgatgatcacctcagcttttctccagattttcgcaggaagagagaacccaaggaaagtatggcagtctcactgagctggaagacagagataagagatggaggaggctaaagcaacggaaatttgcagaatagagtatggaagggagaaagagctctagaaagagccccttgaatctttcactgtatactaaactatgcatgcctgcagtgggaccttacaaggctgggcaagcaactactggggagctataaactagagttctggctaaccagagtggagcatccagggcatttagtagtgattccaggaaggccatatcttagaaataggactaaattagccatagactaaagactgctctaatccttgcaaaaaccttaaaaggaatcttgaaaggatcaaactgatccacaagtaaattagcttctaccagaacaaagcccaatactctgtaaaggacagcacaatgcagacacctacagtgtaatattgatagtgtccagcattcgcttaaaaattactagacatgcaaagaagcaggaacatgtgtctcataaccaaggaaacaatcaatcaataaaatagaaccagaagagtcagaggtgatagaattcacagagaagtaccttaaaatagctattataaatatgttcagggacttaaaagaagaactcaaaaagaagaaaaattaaaacttaagaagaaccaaatgaaaattccagagctgagaaatacaatacctgaatcaaaaaattcactaaatgggccgggcacagtggctcatgcctataatcccagtactttgggaggccgaggtgggtagatcacctgaggtcaggagttcgagaccagcctggccaacatggtgaaagcctgtctctactaaaaatgcaaaaattagccaggcatggtggcttatgcctgtaatcccagctactcatgaggctgaggcaggagaatcgcttgaacccaggaggcagaggttgcagtgagccaggatcgcgccactgtactccagcctggacagcagagtgagactctgtctcaaaaaaaaaaaaaaaattcactaaatgggagcagattagtatgatgatgaaaaaagatcagtgcattacttatctattgccacaaaacaaattgccccaaaacatagtggcttaaaacagcagtaacatttactgtcttacagtttggtgggtcaggtatcccacagcttaactgagtcctctggcttggggtctctcaaaaggctgcaatcaagacatcagctgggactgcagtcatctcagggtttcattcagacaaggtcttccaagctcactgagtcgttgctggcagagtttacttccttgggaacaccctcagttctccaaagagaagcttacatgatggagctggcttcatcaaagtaagcaagagtgagagagtgctagcaaggaataagttacagtcttctataacttattcacagaagtgacatcccaacgcttctgctatattattcattagaagcaagtcgctaggtccaggccacaaacaagacaagggcattacacaagggcatgaaaagcagaaggtaggatcattgggagccatttcagaatctgccacaatcagtgaactctatgacagaacaacagaaactattcaaggcacagagaaaaaatggatgaagagattagagcctttggagtcatagcaagtgttctaacatatatgtaattgtagtcttggtgatggaggggaaaaactattccagatttgatttcaaatatcaaaccagcaatcttggaagccaaatgaaagctaagcatgataaatataaagaaaaccacaccaaggcacattataatcaaactgctgagaaccagcgataaagagaaaaatcttaaaagcagccgaagaagacatattacgtagagaaaccaagataagaatagttgctgacttctcattagaaataatgcaatccagaagacaatggaatgatgcctctaaaatgctaaaagaaaaaagtctgtcaacttagaatcctatattcagtgaaaatatccttcagaaaggaaggtgaaataatgacatttcaggcaatcaaaaaaaatgaaataatttgtcgccactaaaccttacactatgagaagtgaaaggctggagggtaaaaataccagaaggaaacccaaatctgcacagagaactgagaacactcaaaatatcagttaccaacgatatggaatgaaccaagaaaaagggaaggagcaagagagaccttttccagcaggaattggcaaactgtggcccacaggccaaatccagcccactacctgtttttgtatggcctgtcaggcaagaatggattttacagataaacatttgcaattgatgtgatgatacagaacactaattttggatcccatttaagtgaaatgttattccctcaaccaaaggaaaaaaaaaaaactacacttcttattaatagatctgtattacccaaaaatgtatttgatgattaaattttgaattttgtcaataaaaaatgtgaaattttttttctctcttcttgtgtatctacaaagtatcctcagttttatctcttggtccataaaacctaaagcatttactatctggccctttataggaaaagtttgcttgtctgagagtagaggtgaaaaaggaagcaaggggaacatcccccatcagatagtgttccaagtcctttttacacattatttaattcttgcaacaactctgtgaggttgtgtctacacttattatataattctaacattgttggacgactttttagggttatgtaatcctaacaacttgtgagacagataatattcccattttatcaatgagttaactggggctcagagaagctacataacttgtccaaagttatctgtaaatggaacagaggtccacagtcttccctctgccactgacacaaagccaaggcacttaaatgtctatgttttctcattttttttatttttgttttttgggttttttttttaattattattaaaatagagatgggggtctcactatgttgaccaggctggccttgaactcctagcctcaagcagttctctcatcttggcctcccaaagtgctgggattacaggcatgagccactgcacccagccaacatctgtgctttcctgaaggaagaataaccctagccccaactcagagtgtatgaagtcttctttttttaaacaaatttcatccttgcttggttatctggtttctcttcctaaaggatattaaatgcagaatattaaaagagggagagagaatgacagaactgaaataataaagacagtgggaagtgaaagctaacaagagttgaccaaaaataaaactaaacaaaaactattaaagagcattccaaaaactcagtaaacagtgtagtatggagcaattttgtggcacaacatagagccttttgcaaccctgggagaatcatgatgttcagtacttatacagaaaaaagtgataaaacagtattttcttttccttatactctaatgcagaaggaaggtctataatatagaattttaatgcttaaaatggaaaagggctttttgcacaaaggttaccctagctctccactccagtgattctggatagatgaggtttcatttgtagtaatttagcctcccatagagtacttgcaaactcaagcttgtcatagactttaagtccctccaaggaggaaattcccggatgcagaacttgtttcttatctacttctctaagagctgaagaataaacctcaaccaatacttggttattgaaatgcagtgtggtattttactagaacaacttacacatgaattgaagcgtcaaaaggccctcataagccattgttcttaatttatttcctgaagtacatggaagcatttctgctgcattcagaagtagggtacttgtctcaaggaatagcacttgtttaattatttgaattgcaagctgaaccagttgtttgtttcatggaaccttattataacttgaaagaacaactgacaaactatggttattcaaatgaatattgggcagaccttttcttgaaaatgaaggaagtgagtctgtcacttcaaggagaacaagtgatagtatttattgccagtgatgaagttcaaactttcaggtgaaaattagagttttgggaaatttccatcactgagcttggcttctcatcgcttaaagacttttccaatatcagtagtgatattaatgaaagtgattttttttcgatattgtcaaatgaaatatgtcaacatttggaaaatctgcataactcagtgaaccaatattttccagactactgcatgatgttacaaaagcaggcaaggggaaagattcaaaatgtaaaacagaccaatagattttaatgtaacagaatacaaaaaagtttattaatgaggtttatattccacattgcaactaatctttaagaaaataccatttatcaagttcagtgtagtatcaaagaggaatatttacaaagaagaacattaaaatatgcctcacttttccaaaaacatatctgcgggagtctggcttttcttcatttactttaaccaaaactatatcacagcagatcaaatgcagaatcagattggataatccagctgttttctgttcaaccaaatgttaaagagatttcaaaacataaaataggctggtacggaggctcacgcctgtaatcccaacactttgagaggccgaggcagatagatcatctgaggtcaggagtacgagaccagccttgccagcatggcgaaactccatctctattgtctctactaaaaatacaaaaattagccaggcctggtgttgcacccctgtagcccagctactcagaaggctgaggcaggagaattgcttgaacccaggaggtggaggttgcagtgagtcaagatcatgccactgcactctagcctgggcaacagagtgagactctgtctcagaaaaataaataaataaataaataatgccactcttatttaactttggggagatataagggtttttccattttaaaatatgttaatttgtaatgggtgtattattttagtgagttaatatatattttttaatttctcagttttaatttcatttattttctttttttgtttgtttgtttgtttttgagacagagtcccgctgtgttacccacgctggagtacagtggccagtgacatgattccgccttactgcaacctccacttcccaggttcaaaattctcgtgcctcagcctcccagcccagcctcaggcacacaccaccacacccggctagtttttgtatttttagtagagacagggtttctccatgttggccaggctggtctcaaactcctggcctcccaaagtgctgggattacaggcgtgagccaccacacctggccgaatttctaacacaataaatgttgataggtataatccacataagctttttggactcctcaatagtgtttaagagtattaagggcttctgagaccaaaaagtttgagaactgctgatctggggtcttgaaaatcatcttatgaagcttggactttattctgaggatgacaggaaaagaagcactgcagagttttaagtagggggtccagatggtatgttttaaaagaatgactcctggccaggcgtagtggctcacgcctgtcatcccagcactttgagaggccgaggtatgcagatcacttgaggccaggagttcgagactagcctagccaacatggcaaaaccccatctccacaaaaatttcaaaaattagctcggcgtggtggcgcacgcctgtaatcccagctacttgggaggctgaggtgggaggatcactcaaactcaggagacagagattgcagtgagcccagatcgcagcactgcactccagctgagtgacagaggaagactctgtctcaaaaaaacgggctggtgcggtggctcatgcctgtaatcccagcacttcaggaggccaaggcgggcagatcacccaaggtcaggagttcaagaccagcctgaccaacatggcgaaaccccgtctctactaaaaatacaaaaattagcctggcgtggtggcaggcgcctgtaatcccagctactctggaggctgaggcaggagaatggcttgaacttgggaggcggaggttgcagtgagctgagatcgcgccactgcgctccaccctgggggatagagcgagactctgcctcaaaaaaaaaaaaaaaaaaactcctgtgagtagatgtttgaatctgcagaagacatgatcaaaagaaggaaaaccagagaaaaagcaatagatgatcaggacctgggtgagggctgtggtcccaggatagagagggacggaagataaacgtgaaaactaggagaccaaatgcccagtacttggtgcgtggtgaagcctccagttgtgccaccacaactgccaatttaaggggagatgctgatgtctgttctggacatgctgcactgggggccatgtggaggtggcagccatacccactgctcagctctgaaactctggagaaaggtataggccacatagctgcttcaggatcaccaacatgtgagtagtaactaaaacccaagggcaaacccgacacaggaaaaacgtagttagaggaggtgctgatcaaggatagaactcaggaagaccattgcttaagggacaggtggaggtccagaagatcacaaaggaaatgtgagaaacagatgactggagacgtggacccaagaatcaggtgaccgtgcctccagggaagccaggactttaagaagtgtcgaaaacagctgagaaatctctactggatctctcgacattgagggcatagtgaccttagcaagaatgttttcgatacatgagaggaaggagggaaatcacattgccatgggagtttttataattagagatttaattatgtttacaggaaggagccaaagagagagagagagggagtttgagaatccaggcagaaatgtaagtaggtcaggcacatccccggctctagaggtcaaagaggtcattactatggttgcccaggccgctgcccacgcaggagtgcttgggaaggagcactcccttttgccagttgaattaccttgagctgaagctccctgcaggcagcccagaactgttgcttacggtggagaggagacccaaccaggagggagttttcagcccagagaccaaagaaccccagtccagcatttcctactaggacctacagaaagatacagctttgcctaaaacaatgtgtgttcccatcggtttcccccaagaaatccagtgagaatgttcccctctcaggccagagggcccagaagacatcagaccttggaaactgagttttcaaaaagtatccatgcctgatgtaaaggaattgagaaagaatcccaagcctcaaagctgttctttgtagccttatttatagtactggcaattttataagtaacccagaagcccaacagagatagcaacatgacccatagctcacgtctactggttggaataagatgcagccattgaaaacggtggttatagaaattgttgcaacagggaaaggggtatggtaaaatgttaacttaaaaaaactaagctcaacttctagtatacaatctgattacaactgtgaaaacaggcgagaatggttaggaaagagaccgtgaatggcattgtgctagtgttgggattttggggtggggtgtggaggttctcctctgtcttctaaatttctagtatttttaataaggaaaagaaacaggtttatttttatatttttggcaagtggtgacacctgggggtttaggcaaaggtgggctgcaggctcattctggcagctccagctctgaccagtcatggccagccacagtcagtactggcaggttgtgttagaagagaccctcccttgagacttttcttaaggcagatggaaagtaaaaaaaatgatagccgggcatggtggggggtacctgtaataccagctactcaggaggctgaggcaggagaatcgcttgaacccagcaggcagaggttgcagtgagccgagatgtcaccactgcactccagcctgggtgacagagtgagactccatctcaaaaaaaaaagagcaaaaattgaaaatcaaaaaaagacccttctttcagttgatttgcagtggaagtctgggagcacctcttttagcagggttgtgagtgctgttcatgtatgtttaagccatcccatctcatgaccacagcagcctttccaacatggccacgccccctgaactggcaggaagaacctgttttttcagcacagcctcctgttttagttagaatccataatacagaagatgaattaaagcacaaaagctggacgtctccacttctgacatttgtgccactaattagtttctgcttggtattaaattctatcttctctgtcttactttgaaaaacttacataagtgtaaatacagttctacatatccagattttcacttcagtactcacgagtggaggtacagtttcagtatctgccctgagcatgtgaccagtgcttagatgccacatttataccctcttatattgcattttatttacatagcactataaaagcaaatctgctcaaaggaggcccaattaaaaatgcaatcttcaaagcaattagcattttatcatcaaataccagttccatcatagttaaatgaatgaccacctccctgctatatgcagggatgtatgtgacatataagagatcactgacagatgctatcccctcctttacagccaggcaaaccttggaagggacagtgccttgccaaggtcccacagctgaaacatggcagagctaggatttcatcctaattctaacttcaggaattatgctttttttcctctgtgtctcaggcttttgttaaaccttaatttaaacagaatttaacaattaatgcaaaataatttgaactaattggaatattaaactttacatttttttaaagtcatactaatacataactttttcttagctgattttttttttttttttttttgagacagagtctcgctctgtcacccaggccagagtgctgtggcacaatctcagctcactgcaacctccgcctcctgggttcaagcaattctcctgcctcagcctcccaagtagctgggattccgggtgtgtgcctccatgcccagctaatttttgtatttttagtagagacagggtttcacagtgttggcaaggctggtctcaaactcctaacctcgggtgatccatccaccttggcctcccaaagtgctgggattacaggcttgagccactgcgcccagcatctcagctatttttttacaactagtgtctcagctattttttacaaagacagcttgctcctgtgacttaaccctgttcctatgaaaaccgctggtggtcttggaattttcaaaggtaacttgcctacctctgattccctctaacgccccagggagatgcctggtgggctgcagctgaggaggtcattggccccctcttcctcttctacctgagatgaactgtgaggtgtctgaggctgatggtatctgataacaggtgttcttttgttcagtcagtattgaagtgtgggcagttccttcttcccagacacctatggtggaaatttactatgtggcataaattactcatgtttattgacagattcatttccagcaagaggtcaatgaattgttacactttaatatataggtcttggtctgggtgaaattatgaaagtgtgaattctgattattagctattattctgttgtgaaagagtctccccatcctgccaacattaccttctctgtagttctcgcctccattccttttcagtatcctttctgcacctgtctagctcaaaactgcactcactcctacctggctgactacgggaactgcttacctcgcctccaggctccagggaaccagggagaacaccctaaaacacagtttgcccatttctttcacttgccctgcttaaacccctctagtgacccccatcagctggtgactccaggcactctcagccctttgtgtccctctccctcccacctgcctgccacacatgaccctggtttgcccagagctcccatggagaccctgtatgtttgcccatgccgtttccttgccctgtggcatcttcctctttttcacccttctccaccctcacctttacccagctgactccctgccctcctccaaaactgcggaggtgtcagctcctcccaagaaactgtccctagtggctcttctccacctctggccaggtgcttctgccttggtgtctccacggcagctccctgcgtttaccttcttcacgctcatcatatttgactctcggtgttcatttctctgtcctttgctctagcccatgctcctggcagagcccagactgaggaaaactgcccttctggccgcccagcgaaacagggctgctagcgaggggaactcggggcagaaacgcccgcggagtgagtccgccccatgtcctatggcccagcatggctgctgatcttaacctgcccttgccccccagggttccgctcatcactccttgcagagagcaagagggggctgtctgctgtggctgtccaccgtgcctcggcccagtgattaactttgcagctgtgtcattgttcaagtccaaacacaagtgctccacagaacgttctctgccctctgttcccctctcctatggcgtgagtgctttcactggaaaggacaaacagaccggaggcttgagggagagtgggggaatgttgggactcttcctcctcctcacctgcttcactcttcctcagatgggtgctggaatgagccctggggataggcaggagacacacacagcctccacatgcaaccaaatacattcaaaattcagaggacgggatttgaggttacttggttcaaatatgcagcctttcaggagacttggcttggtatgatttttttgtttttttcacgtgactgtgcagatgaaccacaggcctcccctctgtcagcccacaattgacatgcttcacaagcaccatagtcccaaggggacagtgtcaacgcttcctttctggggctcttaggccttgcagactacttattacatgtgctgtgtatagattgggctctgcttaaagtgcaggaaacctttttaacagtgtctcaattgttcaggcaaaacatgctttagtgctttgaggtttggtttggttttgtcagtgacaagcgggagcaggtggtgtggacagtccataagctgtcttatcaaagtggtcagtgaaccccgaagcttcgggtctgtgggtctccctaagaccttctggttctttctagccccaggccctggtgtctttgtgtgtcgtgaccagttgtcagcaggaatgcctcctggagggggtgtctctttgtccttcacagccctgtgtcctttgtagatggctgtgcttgttcacagcatggccaacaaaggtgcccgcattgttcctccacacagggatgtcaccgacaagattctgatgttgtggggtagatcctgtgaatgtgaatagatacagacgcacacacagatgcctctgtgtaaggtccacctccttattagaaacacagaatttatatgttaacagagtgactagcttccagtcaggaattctcacattttagtaccatgatttagaatcaggctaaatttgtcaagtgtctgaaagtgaggtttttcagaaattattaggtaattttttcaatttaggatttatagtcacaattagtacatcataatgatgtttccaggataaaataccagtggctcaacttttctggccacaaatgtacaacatatatcagtttatttttggagatctgaaaaattagctactgtaaagtccccaagaagatttctccaggaaagaggtgaacttacagtaatatgggtgatatattattaattaataactatgaccagccgctgcttcaattaaaaggacaacggatgagaaggactaatagaaaggatatgctgaattttaatcttacagacactaaggtctgtcgaaagactagggaaggtcatttctgggcgttttgcaggagacctgtatattagagatgtcacctgctgctccttggtctaggaaggtttactgaatactgactacgtgtctctcttgggcactgttcctttgcttgccagtaatggaaaccaacttcagtagcttaaggcgaaagaagaatttcttggaaggccacaggagtctcctagaacccaaggataacagtgccgataggccggggcagcccccatgggcctgagcctgggagtcccaaagcccctcatcttattctcagtccttgtgccagtttagacagcctagcatctatgtctgcatttagaagagggaatccgattgacctgtctggacataaaaggacaggcccagataatgtagccatggctgcaggtatgataagacaagcaggttcctttggagggccacggtaccgtgtggtaggcccacacaagaagtgcgcctagaagtgtggttatgaagactcacccaagaaggcgccagctgagctgagccacccaggatcagcaaatctttcccatccgggtcagtgagagaggacatcccaggcttggggaagaacctgtgtagaggctggtgtggcaggtgggagtgtgcagcactctggcagcctgtggcctgtcggggcagcggagtgagatgaggctagaccaggaagcagtcccagaaatgacaagtgtcatcctgaaggtggtaggacggggcatggagaatggagacctagatcagatttatattcagaagctctgccccctggagtcggtcgctttgtgaggtgcccactttccatggtgccccccccgcccccatcctcccagggttgagatgacctgaggcctttgggagcagcttccagcagggtctaaaactgggattctccctctccaggcaggagtcctctcccagcaggagcccaggctgtggagcagcctcataatagtgtggcttttgacccttctccttcctgttgctcatttatctgactttaaacagttagtttatttttagagtaataatgtggagttaattagccttctcccttaaaaacgccaccttttgcatgtaattatcatatagcagcagttccgtaaagccttcctaacgtggcattcccctgaatgcattccagagtggaatgggacctaactggctgttgagtctttaaaattttttcattgtccattttatacccagcctgtaatgagaaaacgaactactcctgggaagactaggtgctgctcagcctccacttgctctcgctcgaattggaatgataggggagaacatatggaggcccccgccatagttaactcaccagaacccctcaacacagttttctgtctctgcaggtcacgcaatatttaaactcacgtatctaagcaatcacgactataaacacctctactttgaatcggacgctgctaccgtcaatgaaattgtgctcaaggtgagtattccttcttgaaccagagacagggtaggtgggtccagcttctcttcaggctgtttgcggcatggccgcagccccacccactccgcagctctatagaaggttcccgggcccagtttggcagaggaggagtgtcgcagcttgccagccacccaggggtgagtgcctgtgccagggccacaccagcccccgctcagctgctctgcacctgcttcagtcaaagcaggacccttttcagtttcctcccaatcccaataaccctggctcttcctgtatttgtttattccttttatgtactgtttattttcctgcaaccattgtcaggagctccttgaagctcctggagcagactctgaggaaattattattgttttgaagataattatgctgaaggtgattttagcaacctgttctaaacatacctaactttctgctagacttgtatgtcaccatacctaaacagtatactcactgagcaccttccgtgtgcctggccacggcctgggatgccacggtgacagactctgtccctgcccctggagagcttttcctctaccagaggaaacaggcataaaacacaaaattacaaagagatcgttagtctcaaaggtgtgggtgtgtcacagtaaactgacttggggtggaggtatggaggcagggagagctgaaccctgaaggatgactgaaaaggcacagatgttgaccaggtaaagagagaggaagcaccacagacaggcagcctgggaatgggctgaggcaaggcaggcacagggggatggggggctgggggggctgggggagctggcggggctggcggggctaggccgtgcagggccttgcagagtggagtgtggctgagaggagctctgcttggcatgggagcctccaggggtcttgcggatttgggaggtctgggataggacctgagatcatacgtttccaagaagcgccagatgctgctttggccgctggtctgggcaccacactctgagtagccctggactaggggtctcagcctctcccaagcagagaatcctttcttcaagccaaatcttccataggttgatcagataggaaaagcagctgctgtggcagagcaggggcgaggaccagagagggctcccccacccctagttgtgtgaccctggctagtcacatcacctttctgggactcagtgtccccacctgtaaagtggggatcatagtacctatgctaccccaccccaccagggctgctagagtacaaatcagatgagacatggtaaacctatgtaagttatcattcagtctcttctgaagagttgaagtcatcacataatagcagaagtagcgaagatatgctgagggactgcacagtgcaggacctgggccagaggctccacgtgtcccatcacagtgcatcttcacagctctgtgagatcatgagataaagttgttcccatttcccagatgaaaagtgaggatcaggaataaagtagcagagccaggatcatgactctggtaagttggcagaaccagaacttgcccccagatttgacagatttcagacttgtgttttaattccccagatatgcatgacctaagagttgtgtgggagatttcaatgaaatagaattgcgatccaggaatatattgagacacattccccatggctgcaaaagattttcaaaaggagtaggtagcaatttaaaagagcagctggaaggacagtttggagcagacagagtagcatgattagctggatgaaagggagagggttcatagaccagcctgatcagagcccctccttggaccaaggagtggggacacgggcctgcctgggagtgcttgcagccagcgagcttcgagttacccactggagcatcacagacagcacgggccccttgtgcagagtgttcagggacctggcagagaaatattccattaccccgataggggctggactttttttttttttttttatagccagcattaaaatattcaagacttgagaaggattctagtaaaattataatcccatgtttgacatcaaaataattttcacaacagcagattgatgacagaaacacaggtttatgacttcagtatgagactgtggaagatcaagtgcagagaaatcattttacaggtccaaatgctccctcgaagcagatgcttctctgcaaaatccgtgaggtctgtcaccttccctaaagtgtctgtttccatatcaaaatatttgcagaaatattgtgtcatgcacaagactccagaagagttgtagcataccctaggcctgatttacttagagctaatgatcatgagcctgatggaagatgagatagtacttctcccacctctgatttttttttttttttttttttttttttgagacagagtctcactctgttgcacaggctggggtgtagtcgtgtgatctctgcacactgcaacctccacctcccgggttcaagtgattctcctgcctcagcttcccgagtagctgggattacaggcacccgccaccaagcccagctaatttttttctatttttagtagagaacggggtttcaccattggccaggctggtctcgaactcctggcctcaagtgatctgcccacctcagcctcccaaagtgctgagattaaagacatgagccgccaggcccggccccatctctgatttttatagcaattggaatacttagttttatccaccattcctgcagtgtcctgagtgtgtctttgtgagctttgcaccagtaccaagcaacggaagcccagccctgtgtccgggagcttgggagaaatgttgttgccatcagaagctcttgaggagtcagtttagactctagtaatgcatgctgttgttctagaattcaggaattttacataaaatgagagcttagatggaaattgaagggaggaaataagagccacaatctgatgtcaaataaacaatcatgaacaaagcctccatcgagctttttgcgcttgtagaaataggaacgtctcccatttattgaacaccagctacatgcagtacatctaatgtccattatcttgtttaatcttcctgaccgccctccagaatgtagacattgtccccattttatagaagaggagatggaggcccaaggtcacagagcacacaagggtggagcctctacttgaacctggcccgagaagctccagagccgccctcttcccatcaagatgtcactgagctaagccatgggtggtccctaattccacaggctttgagatgaatctcagaggagttgtcgggctcttcaaatcaggttcttctcgtgattgagtgatggaggctgtggctttattgaccatgaaaactccctatatttttatgccttaagctgtaaaatgcgttgaaaatgaaacactctatagtgcataaaattgtgccagttttaagccacagcatattaaccagctaatggcagagcaaagggcgtttttatcttttgattattacattaatcttccattaacattatctatgtgattatcacaaagcactgaagataataaatttgggaaatagttggcttgttaaggatcattttaaaatgcttttgtcaagttatatgtgccaaaaatacactgaaaacactaggttggctgagtgtgcaaacaatataatccaaagatttcttgtattaagaatgataaaacctcttatttccatacactgtattgtcccaaatcatcaacctggccctgcggtcctcatgatttattgctctcagctggtaacttggcgaggcagcgggcagagcgtgtcaggccttctgtactcacgcaccagcctttaacgcctgctgctccaaccagcagagcagaaagttgggagggacagtgttgaagcctcggccatctgaggcgttgccatctcgcgctgcctcccccgggagccctctggttccttctcggagtcagcagaagctcctctccctctggcacaggacacatggccctcggagtagaatcagcagaggcagtggctggcctctcttgtcagaaatattcagccttctagtcaaaacttttagatacttgcaggtgaagagaaatagcgtctgttcaccaaaagccccagccagaggagcagaggaggtgagaggctgcggagcaggaaggggtgtttgccaagcgcctgacaccttctagctttgtgaccttgactaaatgacattattgtcattggccttgacttcctcacctgtgcatggggatgacagtggcatctgtctcaagattattgtgaagattccatgagcgctgaaaggcactccgagcagtgccagttgccaccactgatttcacactgctgctgccgcccatgcccaggcacaggctgtcctcagcactggggcgtgtgcatcccactgtagcacccctccctggctcccaccacctcatttcactaagccagccaagctctcgcagttccagggacactcccttgtggcgtgcccctgctgtgccttgatgcatgctgcgtctctcctccccgttgcgcactcaaaaactcctgtgtatccctcaaaagcccgctcactcttttcctctggaagccttccctcctccacacctccctgatactcagccccattccttgatgctcctctttgcctgctgcagtgctggttctgctgctggacacccactcaccaggcagcaagctccccagggccaggaccaagtctcagcgctgtagcgctggggaagcgcctggcggtgcagctgctacacagagtggaagatgcacatgcgactccgggcagactcccagggcttcgtggaagcagcagcgtgcagaaggcctgagaggagcccaggaggcagccccgcccttcacacagggctctttcagccccctcacagctctcaccctgacttccacgtggcctaggccactttggcctccctctctgagcctctttcctttttgtcaagtgagccctgcctggctgggcactcatgagccctgaaggaagcactgtggtgggaagctctgcgcctggctggtgggaggctggatggagagcctgtcttggtttgcttttcatccctgtgttctcggccttcacacagggaaaggcaggctcagagaggttatgtgcttgtccaggtcacacagcaggtgggaggcatagccaggcagcccagggcacagccttccgggagtggctcacgccaggagggagcatgggctccggaacctgaagagctcgccgctcactgactgggaagcctggactggccacttggcttctccaagcctctgttttcccatcgtagagcagcggctctgggcccagccgctgccaggttgctgtgatgactggactccttccacacgacagcacctggccctgaggcacccggcccaggtcagggccttccctgccaccccctccgatgccctgggtgggtagggagcggctggcaaggtgaccgggctgtgtgctcttgtttctaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 38220 - DNA, 60389 bp, Homo sapiens
ggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccaggtgaggcaaggggcgccgtgagggttgcgagagtagcgactgccgccccgccggggtttccatcgggcaggagctggcggggaggaagcatgtgcctcctggggcggcttcctgcctcgcggtggagaagcccccgctccacctcatcatcacggcgcgtacggggtatcagtgccctgggatgaagacctccgactcgcaacgtttggccgcctcgggagaccctgggaccgcgggcgggcgggcgggggccagccacgcggtgggaagtggcgggtgcacatggtctcgtgcgtggcaccgccagatgcggctcccggggaggctggggccggggctctgggctaggtaggggtcgcaaggacagcgccccattactagcgagtcagtgagaacagactcgggagaaggtagtttttacgctggtgatcctcgccctccccactacttgtcatctctttggcctctgtggaagctgtagaagaaaacctgatcgcccaatgttgcttgttaaagatgtttggaaacaatttacacttgcactaatacttcgtttatgagagacagcctgtgggagggggaaggaagggcttctttgctctgctagagttctcggttctctttgtaactcagatcttgagatttatggaaatagggagtggagggtggggaggttggagagggcggagattaaattggtgttgctgcctatatatagccttagattagcctcttaatccaaccttcattcaactgtaatatgtagcctggagcttcgaccataggtagatgggggtaaatacaagtgtgtatttcagaataagatttgcttgctaaaatgcgggaatcagtcatttctccagggtgcagatttatatttacatcatcaatgaaagtttctttggaaattagtgtttatgttttactgttgtttccctacagagtagtattgatgtttctctcaatatgtgtgtcaaagagacgtgtatgtgtcaaagagaaatatttgagtaattatgtaggtggtttttgttaagcatccccaggaccactgtttcttctcatagcgccatacgaaaagcgaaatgcattttcctctggccttaggcatttattttgcgtgaagctttcactaacatctgaaatctcctggaatatgtttatcattatttcctgcctttagcaaaaatctttcctaaactccagctgtttttcccccctaaagcttcagcattaaagactgggacagatctgagccagaacatcttacatgaaaatggtttgaaattattcatctcagtgtataacaaagatacttttgttggatgatgctttaataatgatgtggctgttcaagcaagtagtaaggctcctgagagtgaccaatcttttgtaatgctgttagttcagagttacaattgatttataacatagtatcatgcggaagaaacccacaaacctaaaaaaacagttgagtggtaacctcctggaacatgtgatttagcatcttaccagcagatgcatacacataattgggtacttcattgctagtatttccatctcttgtgccaaatctgggccatggttacttgaaggtcacacctgtttgtctcactggggttgtcagttcctcgaggatagcagcttactatctattttcttgatgccttatgacacttggttggtatttagtgctctctgaatacatgaccagtgaatttagagacaataacgttgaaagagaatctaacatctacctagaaatgcaaataaatcatgttcagtttacatttctagaaacagattcataatgggtactgttcattagatggattgattacattagtagttttgtatggtgtaaatatttaatgtagggataagattagataatgagcatattaaaacagattcacatcaaagaagttttattgataataagatagctacttcatattgagtatttagtctgtgctagatattctaccagatgctttgcatagaattattctagtgttatgacaacccaggaatgagccaatattatacccactttgcaaataagaggacagaaagtaagggaaataatttgcccacaatcccatattaggaagtgtcaagtcagaattggaataatgatttctgaaatgtttgaaatgttgtatgtgtcctctcatatctaccactctagagctattgcaatgcatcttaagtagcctgcttctctctcacctgtctccatctagctaattcagggaactaccagttcaataaacattgagcacccatcattctttgaatggctctctgctggccacagaatagagggctgggtctggcctggaaggttccaatccatccatggtctcagcaggcatttccagtcatctgggccctcccacacactgggctctaaggtcaccactctgcttgttccccaacctgccggtaatttccacccctttgttcctgcttttctcctcctctgaatgatttcccttcccttttcactgaatctcctctccagatctgatgaactattcaactttccagacacaatttaaacaaaacctcttttcttcagcttttgtgttcatctctccctctctatccagtaagggaaatatacatgctagtaaatacatttattcatgtctcttggcaagggttataagtaaaatctttgtacatggaggatattgatatgcaacatggctactggtatcattgctggcagcctttaattctctcttcttatggattctagcgacccctcttttaccgcccccctaaattgacatcattgcttcttcatctgaatctccatgaaaatacctaaaacaagcactttctcatcgcattctattatagttattattaatctgtttggtcccttctcattctacagtatacattaactaggtcaaatttatctttgtttctcaggtttaacccagtgtcttgcacctagtgtatgctcagtacaagctgagttgaattcagtttgatttctaagttattttaggtggatttgttttcctacttgactaatccttcctggcaatgtgaggtgaggtggcactaagcacgcacaatcataaccagaggcagaaagtctttaaatgttttggatctcaagcttcttgacattctgatgaatgctatcaaccaagaaaaattgttcttgtgcacatgttacaaatttggcatgccattcttagatttccccattaaagaccctgatttccagctctctacattaggagaatgctgcctttttgttgcatttttgagtattacatctttcagggtactgtttgtcttgacatttgactttttttccttagacttaggtatctttattgactggatatttgataataagaaattttgatttttttaagttggaagtagattacggttatatttttaaaagattacttatcttttagagataggaacagaattatttcagaactggatgagaagacagctgagatttgctttaatataattctgtgacagaaaggaagagagactgaatgagaatataaatgagataaaattgactatgttaacagttgaagatgggtgatgagtatattcacttgattatactgttctctctacttttggatatatttgagattttccataatgaagtttttaaaaagaaaatttggaagtattacagcctctaagaaatcttttttttttaaacacaacataagaaagtaatataaatacaaatgttcttttttctatacttggagtttcgcttatgtgattattcatttaagtgttaaaacagttacacctaaatctgcaaagaactgtcttgtgaacaatgcgtttccataaacatttgacatcacattttaacttctccaaaaagtaaaaggttggtggcattactcagtgcttgtagaacaaattgatgaatatcttactggtagttaatcttcatcttttttgaaaagaaaattctgaagaaggggtacagatacatttagtttaactgagaaaatcaagaggtgaatgaagtggagatactgatgttcttctgtgcgtcataatccaactcagaaggcattccaaaaaaaaagagtaccaaaactgtttcgagcaatgtcagcactgataggataagtattagtctaggaaaatcaggagcaggcccaggacagggtgtgactggtaggttcttactcagtgtttgcttagctgaatacttaatctgacacctactttctaatttgtgcaattttttaaactgattttttgatctttacaattttttattgtgttttagatatattaaatgtcctttataacatgtcatcctagactttgggattttacaagaatatttaattaatatgaaatccaccaatcttagcaggtcataaacaagaatacttttcattcttaactcactcatttctgtgtattgaggccatggcgctctttagcaagtatcttttgggcagttaggtgccgagtggaatgatttgccccgttctaaatttggcgtgtattaagtgaagagtgccaaaattgttcaggtagtcatatttgtaaactatctattttgaaaataaagatttgaataactcattgaatgaaccattctttaaggttaaatgccaaaaagataatgttctcattattctttcttgatttttagcaataggtgtttccattgatgttttttaagtttattcaaaaattaaaggaaaaaagtataatgacaaaaagaaagaataatgccctgtattaatatttaagatagtataatcctttggctatctttaattccattctgaaaatattaatattttagtaggaaaacaataacttaagatgtagaattattttttgtgtcagatgtagcattatattttctttttacatctcaacttatttttatgctagatgagaactttaaaaaatataacaggtgtactgttatttttgaggacttctaaataaatctcaagaaaagccctggggcagagatgaataataagggataataacgtttagcactgtagagaatatatcataagctactattggatgatattctactgtcatcctttttatatatccacacagaagactttaatggttttcaaactaacctggatttatggtcatttctaagaagaaaaaagaaatgttatatgtttttctcagtgaacaaggtaattgaatgggactattataaacaggaaagagaacccctagttgtcggtgcagaggaaactgctggctggaggaaaaggatgcggtgttagtatttgggagtgtgaagattgtgtttgtgttagagttgagcttctgcaggaaacaatttaaaaactgtatcctatagtgctagaaattatggtgccataaattttctaatattcgtatgtccctaagaggcaatattgttaaattctctctctaaagataaatgccttttcccccccaccgcttaatagaactctatggagaactctttggtattttggaagtaacatatgctaattcaatttatccaagtgctgaactcaactttaaattaatatttatgcgctactccatcttattccaaactataaaatttatgaggcaaataatgaaaaagctgtcttcgagaatcatataaataattctctaagacattgcaacagctttagttggctccttggaaaatgcactgagtggagacagtggatcaggttctggccccaactcttccatgtacataagctccagatgggcagggatcgttctgctttgatctccactgtcttaccaatgctagaatggaattcctgacctcagccaagtggtttgacatctcagtgccttatctgaaggttagcttagggactgggcttacatccatggttttcaaagtattccattccgcgtggatgccacttgtaagttacaaagtaaaaaaacacgcacttaattattaaaacgttaataaacacaactgcatctcgaatgcatcatatgttgtctttaaacatactggagacaatcagtgcttgctaacttgttctgcccgattgtgcaatacttggaacaaagctccacctgctagaaagtgacctccatgaaatttgcctgatttagtgcttgctgcatccctattgactagtaccagacctggtatatttggcaaacaaataaatgaatgattctctgtaggtttaaacctttttcttttgagacggagtttcgctgttgttgcccagtctggagtgcgatggtgtgatctcggctgactggctgactgtaacctctgtctcctgggttcaagtgattctcctgcctcagcctaccgagtagctgggattacaggcgcctgccaccatgcctggctaatttttgtatttttagtacagacggggtttcaccatgttggccaggctggtttcgaacacctgacctcaggtgattcgcccgccttggcttcccaaagtgctgggattacaggcatgagccaccatacctggcttaaacctttttaaaatgtatgattcagagagcttgtagctctgtactagttcttttttatttcctttaattcaattttgtatggtccacttctgtaaagttgtgttggggaatccagtcccatgtcatcagcgtgccctagactaggcttggcatttctatccagttcatgctctcattatgtaataagcatgcatatggaaagtaactttgtgtgtgtgtgtgtgtgtgtgtagcccttcaaataaagcttcacctgctagacaggcttgggcaggtccccttctgggaggatgggagtttcttggttgagagaactagtaagtgagccaatatttggactcatgcccaccaccacctttgagcttcctgaaggtccactattacgatttttaagcaattgctccaaaacagaattctctcactgtctaccagtctaggccttacttttctttttatttcttttttttctgaagattttattttcctcttttccatgattaaaaatcctctgaagagaggcaaacacttcaacactcttttactttaataacttgtcttctgacttcccactggagtaatagtcaccaacactcccatcagttttgtgtctgtcttaaactaacttgctctctggcattgccactccacttcttgctgattttcatctcctggttctcctcacctcagttagcaaggccagtgttgtgtgtgctgtccatagctcctttcctctaggtggaaagtaaatctcatataaaatcatctttctcctctactatgtaaagctcaacatgtatttaggtatcttccagtgaaaaagcacttttctggaggaaggaacattggagatgagaatactcattaataataaatattacttttgtcttcagtggaggtgaaaatctcgaatgcataggcattttctaaaaggttacataggatgatgttaaagggtttaaattattatcatctccatggagtggggctaggatataaggtcaagagtgaaagattgggaagagcactacccttctgtactgtgttggggttttttgtttgtttgattttgttttgtttttgccatcagtgtgttattactttaaagttttaaatcactagttaaaataatatagagactggctgggcatggtgactcatgcctgtaatcccatcgctttgggtggccaaggtgggcagatcacttgaggccaggagttcgagaccagcctggccaacatggcaaaaccccatctctacaaaaaaaaaaaaaaaaaaaaaaaaaaaatacaaaaattaattacttgggagactgaggcacgagaatccaagggaggcagagtttgcagtgagctgagattgtgccactacactccagcctgggtgacagagtaagactctgtctcaaaaagtaataataataatatagagaccatcttgcttttttctaagcttaaaattataatattattaacaaatttcaaggacatttccttctctataagagtttctgcttttcctaaagtgatgcaatggaacagatgacttttaaaataaagattcagagaatatcactgaatcaagttatataactccaagtccaaatgcaaatcatttttaaattgtattttagcataatatgagaaaagatggtagaatttaattttaatttttttctgtatataaccccccccccccaaaaaaaaacggatgatatttatttatttatgagacggagtcttgctctgtcagccaggctgtgatacagtggcatgatcttggctcactgcaacctctgcctccagggttcaagtgattctcatgcctcagcctcccaagtagctggggttacaggcgtgcaacaccatgcctggctaattgttttttttttttttagtggatacacggtttcaccatgttgcccaggcttgtctcaaactcctgacctcaggtgatccgcctgcctcagcctcccaaagtgctgggattacaggcataagccaccgtgcccagcctgtatactatactgtgtttaagtgtgaacagtggtcattactgaaagttagactgatagattttttctaatttttccttaaatattctataatatacatgatgagctgaccttataatcagtgatttttaaaggttacctctcactttcaaataaagatgctgttgtttctcagcttaatcacctacttttttgcttctgttcagtattttgtcataaaaacctggttggacacaccagatagcttcaaagtggccacctacttttttcaatggattagactctgaatgatctctggcgactttctaaaattaaatcctctatcaaacaaggaaatttctcatcattgagtatagtcaaaagaatgatctgtagactccagaggaaattctaaaaaaagtttcataaatctattaattaaaaggggttttgtttaatggaagcattattagttcatagtttttctttattgaaggaagaaattactttgatgggtaaatgctggaaaatgtttttttaaattacttaagttactatgtaacatttttgtttttaactgacatatagtaatttttcatatgtggggtacagtgtggtgtttccatatacatatacattgtgtaataattaaatcagggtgattagcatattcattacattgaacactcatcatttctttctggtaagaacaatcaaaatcctttcttctagctcttttgtagtatatgatacattattgttaactataataactctattgtgcaatagaacactagagcttattcttcctaactgtaactctgtacctgttcaccaatctttccccatccccacctcactcctattctcctgtctccaggaaactactattctactctctacttctgtgataccaacttttttagattctacatgagtgagatcatatgatatttgcctcccaaagtgctgggattacagatcggagccaccatgccatgccctaaaatacatatggcttcctgtgtttgccattgctccagggttctatgtgtacataatcagttttatttcttaatcatttgagagtaggttgcatacactttctgcctttatctcttatttcttcagtatttattctgtaaaaataagatacttttcttacagaaccacagtgcaaaaaaaaattcagtaaattttaacatagataccataattttatctttatactccaacttcttaggttgtctcaatagtcatatatatgtgtgtgtgtgtgtatgtatatatacatatatatgtgtgtatatatataaatgactatatatatatatacataaatattttttcccagtacagcattcagtccaggaatgtgtattgcatttagcaatgcacctttaattctcctggaacagttcttcaacctttgttttggaaagacgttatcattgatgaagaatacagaccagttactttggagaatgtccctagatatacatctgtttcctcatgattagctattcaggtcatgtgtttttgtctggggtaccacatgagcaatatgtccttctaagtgtaaaacatctggagttgtagtgattgtatgttgtcctttggttaaggtatggtcttgtttttccaatatgtagttatatttttaaaaaaatttatgtgaagatgcttggaggctatgtaagtatcctgttgatcatcaagcactccccagcgcgcgcgcgcacacacacacacacacacacacacacacacacacacacacaagtaggtttagcatacattgattactcttgcatgaatcagttttttatttaattgttgcaaaatggtgattttctaattcaatgtttcattctctgtttattagttgacattctactgaaggaaaatctttcacttacttccctttccttgtgtactgaaaaatttgttttctttaaaatgaagctaaaagttatgagcatggacctatgggtttgtatttttttgaatgggttattagctattatccttagttatttgggtcctcaaattgccctgggctaggccagtggaattgtcctcaagatggctcttatgttgttttgatctagcttgatttttttttagacacttttgaatttgccaacacaagacatcccaggatcatagtgaatctcccctgctccagccttggagtcagccatttatccaagaaactttggtttctctcagtagggaatgatagttagatcctgtggcacatatctttttatgcaaaaatgttattattgctcgtgactctttgagaattggtttgaacttcaaaagaggttaaaacgttttcacttaagtatatacaattttctaattatagaaaggatatgcatttattttacagaaaatatagacaagtataggtaagaagaataagaggtgccttgaacccactactcatgttgaccaccattggacgtaaatgtattttacatagccaagatcacatcatgtatatagaatattgcattttgctgtatctacatagcatgtcattgttttctcaaagtcatagaaattaacatttttaagtcacacattgtatattaaaatttctcttttctttcttgtttttgtttccattgatgcaatatcctaaagtagaaaaagtttgtctgctggtgttgagcttctttttctgctctctttaaaacccatattcttgcctatcctctgcccttccactaaattgcataagatgtaaaattaccaatttcagaaataaattgttagtatcagagactgggaaacatgtattttgtacattctaactgtacttttggtttgagatatgactatctagtgataaacttttttttttctaaaatttgacaccagtatttggcaaatacgagtaagtagttcaataaaatatgtgcttagttgccactggtatgttcagatctgggtgcaaaattttcagcccttgagagcagggaccacctctggctttgctcaccattgtttcctctctacagtagggtttctcaacctcagcacttcactgacatttcagacctaagggtcttaacgtatcgagagcagaagttttagggcattttgttaaagtaccctgaaacattatatttgagggacgggttttctaaaagccaaagtatgctacaatgtgggtagtgtatatgtgtttgtgtcttcagagtgttgaaagacctaagaatgacatcagtaaaattagaccatctggaagattgaatgagctggctagcccttgggggaagggcagggcctgggagataacccatctggggaaagtgcaagggcccagaggaaggaatgcacatgccttaagggacctcttagaaaagtagaattgcagtaactagagaccaggaagtgattcctagaatgaaaggattttaggaattaatttatacttcttaaaagtttttgaaaatagcttcactgagataaagtaagtgacattgtgtagttgccttaatttgtttctacatggatatttaaaatgtaatttttgtaatatttttatttttatttaaaaggaaattttaaaaacaagcattcaagcatttacaacttaggtcttctaattagtttaaggtgtaaagtagttttggaagtattataataaaatgaaaactttctcatggtgcctttatgttttctgaaaggagatttgcattaacagctctaagggaaaaataaggtcaaatgctcttttttctaatataaaaatattgctgtcggccaggcgcagtggcttatgcctgtaatcccagcactttgggaggccggggtgggcagatcatgaggtcaggagattgagatcagcctgtccaacatagtgaaaccccgtctgtactaaaaatacaaaaattagccgggcatggtggcgtgcaactgtaatcccagctacttgggaggctgaggcaggagaatcacttgaacccaggaggtggaggttgtagtgagccaagatcgcaccactgcactccagcctgggcaacagagcaagaatccgtctcagaaaaatgtatatatatatatatatttatatgttgctgtcatttccctattcctttcattcttatcctgaataatataaaagaataaaaataacttaaaaaaaaaaagcattaaacaggatcaggtgaggaatcccagcaatttgggaggctgaggcaggaggactgcttgagctcaagagttcgagaccagcctgggcaacatggcgaaactcttaaaaactaaaaaaaaacaataaaaaaagtatattctcctcaaaaatgtatatattttccagtgaagaactttaatggtggactctttacttgtgccaactatctaccttataaagagttattaaagcccaaataactcgtgtcatgttttgaattttaattttttttcaattattataaatactacaactttcatagtatttgttagtaattaagctttttgtactggctgagtgattttgagtaggcagaggctgttacaaaatcatgataaggatattaaacaagctaatgttatttcaggcaacaaattgtatagtgttattataggcatatagttagtttgttgcttagagtgtcaataatttaaacttttagaaccaacttaattattttttgtttctttggagagaatgataatacaatgttatcaacccaaaagattcctagattcctttattttctgtaaaggattttatgttacttgttcttttaattttagcattaatggaaaggaaaatgttgtatagttatgggtaatttttaaagtttattttaatagtagataattttactcatttaaaatatagaataaaaggtaattcttgaaacttgttattaaatacaaagtacttcatgagaacactgcagtgaagtgtctcaattttattgagttttgtgtgttgttattatatctttatgaaacgttttatactttgggaatgatattgttgccctataatttttgtttttatttttttatttttttttttattatactttaagttctagggtacatgtgcacaacgtgcaggtttgttacatatgtatacaggtgccatgttggtgtgctgcacccattaactcgtcattaacattaggtatatctcccaatgctatcccttccccctcccccaccccacaacaggccccttcctgtgtccacgtgttctcattgttcagttcccacctatgagtgagaacatgcggtgtttggttttttgtccttcagatagtttgctgagaatgatggtttccagcttcatccatgtccctacaaaggacatgaactcatccttttttatgttgttgccctataatttttagactccaaagtcttttttccaccttgggcaacatggggaaaccctgtctctatcaaaatatataaaaaattagccgggcctggtagtgtgcctgtagtcctagctacttgggaggatcttttgagcccacgtggtcggggctgcagtgagcagatatcacacccctgcattttagcctgggtgacagagcgagactccatatttaaaaaaaaaaaaaaaaaggtctttttttcctaaagtcttaaacagtattgactgcacacagagtgttactttggaatgtggtaatttttcttttttcctcactctagccacctggctttgaaatttgtgcagactactcttcgagctactttatttgaaaaatattaattaaaaatttctattctttagatgtatttttatctttgtatcaaatttaagtgttttgggacataagaattgcacagcctaacataagtaaccattagccacactgtttaaatttagttaatggaaataaaataaaattaaacatttatttgtctagtcactagccgcatttcaagggatcagtagtggctactatattagatagtgctgatagagaacgtttccatcatcacagacacttctattggatacaatgcgctagaataggagttcacaaaggacctcctgggggtccaatctggtccaccacttgttgtgttaatatgaagttttactggaatacagccatgaccatttgtctgcatattgtccatggctgctttcacactgtaacagcagaattgagtggttggaacagaaaccttatatccctcagagagagtaaaatatttttcttttatttctttacaaaaaatgttgtgttccctgctttagagtatatatgctcataaagttgtttgaataacatatgcatagcacatgttagtaatatagcatgttacgtaaggcaggttatcatagttcaaagatgagtcataccagagcagtcaaaaatagaatctaagaccaaagtgctggataattagacaggagcagtcattcccttgtagggacaactagaaggtaagtcctctggtagatcagtttctttccaaaatggagagaactaaagaagagtcccaggtaagactgatcagtctacatcgaaggtgctaatccacttaaggtgggctgggtaactggaaggattagtgcacagttgctatgagatgcatctgtgccagtgtggctcattgtcacacctgggcccagagtctcattgcaagttaagggaccgaatttgaaaaagatgctaggacagttagaagattaacagactgaggtaggtaacagaaataaatgtaataggttagacctaaaaacctttcaatttacacttaaaataggaatttatgcaaaagtgttcgattcattaatatagtatcaagtttctaaatatttgattgattggatcattttagtattcttatcgccttcttttaccttgtggagtatccaagaaatgtagtctcttaggtgacatgtgaaatacttaagtccattttgtttaccatttcacatacaattttaatattattttaaaccatggaactgttccattttggtagaatatgtgtgtattttgtgtgtggcttatagtttttaaaacagaagccaaattgtcatgatgcataggttgtaccaccatggggatttgtctctgaggatactgttaaacttttatttttttaaacttaagtatttttagttattagatttgaaaatacattgtagggcagtgtactaacagcctttgacattggcctaatagaactgtctttgttatcttcctaggttgaagcgagcagtttcttattcaaagtgtccttgcttctcttaggccagggcttttataagggcttagtgagtaccttataaaggctgacccttactggagcagattatagtgtagcatgaagagctaaatttagagggaagtggggcctctgctccaaatagtaacagctaaaggatagacactcttggagagcagaatatctttatttagtctgtcaccaccagtgggtgagtttttgtttgtttgtgttaattttgggtgttataccaaagtctttgcatacatttttatgtttacatgttatcatgtgtttctccacatggaatgtatcgagggtatgaaaagtaagcccacatacctgggttataaagaaacaaacttttatgcttagaaaggaagtaagtataaaagctaaacatttgaaaatagagtaattctttcatatgctgtgtttggtggtacttctccattaacagaaaaaagaaaaacaaggtgcaaagagttaattagggaattccatgagtttgtgttctaaaccccaaaacaaaacttttaggaaggactcacactttagaatttttgaaattacaaattaaaaaccatttttagcctggcacagtggtgtgcgcctgtaatcctagttactcaagaggctgagatgagagaattgcttgagtccaggagtttgaagtcaccctggtcaacatagtaacaccctcatctctaaggaggtagagagagagaaaaaaggaaggaaggaaggagagagaaagaaaaagaaaggacggaaagaaagaagaaaaacatctttggcagagaagtctgctggagagatttctgtccagttgagctacattctttttgcatcttggtacaagacccaacacccaaattcttgacacatatttttctttgctaacacaaatatattttgtataatatttgtgtttgggagatatggagacaataatatgtatatcatcatcacttttgcaacaataaagtattggctgattcagagtgaatctgtttataatgccagcaggaaagtttctgaatgaaacttttgcagtgaatataaatgatgcattagaagctctattttcaacatccatcaaatgaaatgggaattcattgattaagtttatagcatttgtaatgatttcgatatgttgctgttgcccccatacacataagcaatcaattactttattcttacactggtctgtgtttctactgtttgaactattacattgtgttgcaaatgtttgaattttatccttcctagtgagtttctcgagggcatggattctggcttaataacctttgtatccccaagcgtgatgtattaagttcattttactttatagggttggcaaaaattatttctcaagccatgtaattactttttttgttttatgtgacttttgattagtttctcttctaaaataatgattaacttgacgttttcaataataaacagattttttattatgtgaagctacaagtttctcttttatgtgtaagaaggaaaatttggtacataaataattttttcatgttcttaaggattttttaaaaaaaacttttgggagtaattaaattacttgaataatgtaaattttttattgtttgatggtataagtaattaaggaaatctagacatttccaagtgaatatctaaaagctttggaaggtaattaaataatttgcttgaataatgcatgttatattgaatgtttggacttcataattgaagcaatctagacatattttcagtttataatatttaagtcagcaagcatattctcagtttttaagaagtcttgtggagcaggccttacattttttcaaagataatatattgcaatttttaaattgtgtattaaatccagtaaaatagtataaagtactcaaatccctgtccattaaggtaaaccaaaaagataaaaaatctattaacagtttcttgtagccttcttaaattgttattgcatagaaaaccatatattctatacaccctccttttaaccaagtactttacattcttttattcagcttgcttttttccactatcaatatcccttgagcatctttccataacagtccagcaacttatttgaaaagtatttattatatgtttatactttgctcaatataaaagatacagaatggaggagctaaaggagctctatggaataaaaacctacaaggttcctgtcctagtggaggttacactcatggagggtatagaccccagacaaagagataataataaaatggcaggcactgctaaagaaaaacaaagccaagtaaggagagctagtgacaacaggccactttggtggagatggtcagagaagacctccattttcagggaggcatttgaatgattgcaaggagatagccatgtggacagctggggacgatctttcctgaaagagaggcaggaacagagcctcagaagccagaccttatctggcctattggaagaacaacaaagagatcaatgtgactggaactcaatgagcgatgagacgagatgtgtattgaacatacatataccgtcagaaaggtagccaggatcagaaatgtggtacagttagatctaattcttgctttcataaagcttcgtggtgttccacttggtgcctaaattataacttatttgaggacatttcatgttccattttttatgtatacaacaatgctgcaactaaatccttttacatatacaagtatatttgcattcttgtgtgaatatagctacaggataaattcctggtagagtactgctggaccaaggttatgcccatgtaaatgtttatagtaaatactcaccaaaattttcctcaaagtatttcatggagtttaacctttacatcaaagttggtgtctgtggttgtttttcctatgtcctttgccaacactgagtattagtaaactttaaaatttttgctagtccaagttaaaattagatctcatttttaaaagtgtatttatgccgggcgccgtggctcacgcctgtaatcccaacagtttgtgaggccaaggtgggtggatcacaaggtctggagttcaagacctggccaccatggtgaaaccccgtctctactaaaaatacaaaaattagctgggcgtggtggctcacgcttgtagtcccagctactcaggaggctgaggcaggataatcacttgaacccgggatgcagaggttgcagtgagctgagatcacaccactgcactcccacctgggcgacagcgagactctgtctcaattgaaaaaaaaaaagaggcatattcagtaatgagtgaggttgaacatatgttcaaccaaacttattggccatatgttttccatataaactgcttatctgaaatacataatctttattttctttgttttcagaaattttatgaataagcatcagaagccagtgctaacaggccagcggttcaaaactcggaaaaggggtaggttgtgtgtgtgtgtgtgtgtgtgtttaaagttgtaaccaaaatataagattggagaagaatctgaatgatccctgtttcccccagcctcactgattctactcatttgagctctgagtgtagaatctgaagtgctttagtgaaaccatagaactgccagttacttgttggacaagttatttaatttgcctgtgctacttgttttcatctacagaatgggatagatatctctgttcaggttgtcttaggaggttatgaaggcaattgataaattttactggttttgacattagcattgtatttggtttttgctttctttgtcgttttatgaaaacgttgatggcaaagatgataaaatgaaaagtaaattaggaagtgagatattgaagagttttttaatttttcagaaatgaagaagtcaaaataaatctactgccctaaattccccttaaaaaccatattttcaagtgtcttcaattgtggtaagagtagttatagacccattttgatgatgactggtaaaatttctatttgtgtgagtgactgtttttttataatgttcatcttagcattctttttgtgtaaataatattttatatatttttttagagacagggtcttgcactgtcacccaggttggagtgcagtggtgtgatgatagctcactgcatcctcaaacacctgggctcaagtggtcctttcacctcagcctcccaagtagctgggactataggtgcacaccaccacacctggctacgttttaaaaaaatttttttgtagagacagggtctcaaactcctggcctcaagcagtcctcctcccttggcctcccaaagtgctgagattgtggatgtgagccactgcacctggcctgtataaaagacttttatttatttatttatttatttatttatttagagacggagtcttgctccgtcgtcaggctggagtgcagtggcgccatctcggctcactgcaacctcctcctcccaggttcaagcgattctcctgcctcagcctcccaagtagctgggattacaggcaaccgccatcatacccagctaatttttgtattttaagtacagacggggtttcaccatattggccaggctggtctcgatctcctgaccttgtgatccgcctatttatttattattaattaattagtggcttatttatttttgaaatagggtcttgctctgacacctaggctggaatacagtggtgccatgacagctactgcagactcaacctcctgggctccagtgctcctcccacctcagccacccaaggagccacttttgtgtggagacaaggtcttgctatgttgttgaagctgggttcaagcgatgttcatgtcttagcctcccagagtgatgggattacaggcatgagccactacaccaagccaagaatattttaaacatgattttatatttagtcagttttgcataattatatagaggtcctcttggatgtaagaatagctgaactggggccaggcgtggtggctcatgcctgtaatcccaacactttgggaggccgaggcgagtggatcacctaaggttggtagtttgagaccagcctgaccaacatggagaaacccagtctctactaaaagtacaaaattagccaggcgtggtggcgcatgcctgtaatcccagctattctggaggctgaggcaaggagaatcgcttgaacccaggattgggaggtcagtgagccgacattgcaccactgcactgcagcctgggcaacgagtgaagctccatctcaaaaaaaaaaaaacaaaaaaaaaaacgctgaactggaactcaatagggaaactttttcaaagaggaaacatgatgtgagtgattaaattaaataaagttgaagggaattactgaaaaatatttaaggaagtatgtataaaggtaaaagatgttggagcagaatcacatgtaatgatcttgcaggactaaattatctctttaataactgactttatatgcctttggcagtcagtgctaagcagcctgtgttctcttgcagtgctgtctccatttaagtaacaagtctagtcacgtagacggaaaagaaattgcaatataatagatcatttggatcagaagagtttgtaagagtcactaggaagcagtaagactgaatttaactgtgtgctatctgctgggaagcttcatgttcaaagtaaaatataaaaattaaaaaaaattcaagtgaccggaaaatagttactttgtacagtttttctgttttgcactctcccttttctatttttttcatttctggcctatccgcatgagaagaataagtacaagtatagcctgagccacttctctatttagtcctcatcttactcttacaaattgtgccccactacattgccccttgccatctggaagcagatatcaaacacaaagtgctaaccagaattcattgtcttattgtttaaagcagtcttggaaaaaaggacatggatgattttaaaaggatttatcagtaatgaccaatatagttcagaaacctaattacagtgaaggtattgtggagcctagtaatgtgataatagctaatatatgcccagctatgaggcacagaaacgttggctattgcctgccgctgggggatcgtgttaatctcagagctggatctccacctcaagcatctttattagtgtgacgctaattcactggaactgagctcaagagagggcctcagaatgtgttgcacaacagcagacgtgagtcagcgagtaaactggcccttacgtttgtcttcagttaagaaccagaaagttttctctccttcagaaccggtttgcctctgaatcacttggtggtcaagattgtgctgttggagtgctcagggagagccactgagaaatatatattatttgccagttgatctagattcatataactcatatctcttggggattgaagcaacacttgagccattttgtgccaaactcctgatgggggaataaaaattgagtcaacttcattttctgctcttcttagtagtgaaacgcctcctgatgatttctcatccttaacttttctttgctattatgaaggggctgacatcaaataagtgattagcaattttgtagagctggggaaaattactactgaggatatttcaaggtccttgtgataggctgttttctgaagataggtcttcactttgaaacatttcctagcaaagccagtgctcctgcatgccaagttagtatgacaatgtatttcttattgcattgtcgttactgcttagcattaaaatacaaacgtcatggcaggacacattatataatagaactctaatcagattctcttttcctttatgaaacacatctcacttatgatatattctccaaagtaattatgttttttcctgtgacttgtgaaaatctgaaaagatgaaaatttctcccatgagcaattggattatgctttgctaaatgaaacatttaataatcaaactgttctttctgtacatttttagaaaaattggattacaattagtgaaaacaagagagagaaaaaaaggccaaactgcaggcattcagcatgaccatgtgctcaggtttctccctgagactttagctctgtaaataatgttttttgtttttgttgttggagacagtctcactctgtcatctaggctggagttcagtggcgcaatctcagctcactgcagcctctccctcccagattcaagtgattcttgtgcctcaacctcccgagtagctgggattacaggcgtgcaccaccacacccagctaagttttgtattttttagtaaacctgaagtttcatcatgttgctcaggttcgtctcagaacgcctgggctcaagtgatccatctaccttggcctcccaaagtgctgggattacaggcgtgagccaccatgcccagccatgtaatattggttttaaatcacttttagctttatagtaagtggtgttaataactaaatgagcaaacctttaaatcttgaaatatatgtgcaaatatgagtatgtgtatatatataattagaaaatacatttgattttacaggaaaaaagaaaatatgtgatttttaaaattcattgctacatctcagtgacatccagaaagggatgtaggttctgctattatatcacttcactaatgtgtttttaaccagttactgtagttcccacagtaagcaagttaggtaatgtatacgcatatttgagtgtcagaattaggcccatttcttctctatgtcagtacaagggctatgatgactaactcttgagtatcacaattatgattcaccagcacagtttaaattggagaccctaattatatccttctcacttcaaggcagacttgaactgccaaatggaaatccaaggaggcaatggcatattttcattcgaattttgttagtatttctgctagactgtcctctaataaaatgcaaactacatttactgtactttcagatgaaaaagactctttagttccaaagttgtcttgtttctcaagttttcattagtgttcttgccattttcttatatgggaattttctagtccttttgatggtcactttgttttagcagctgggagcttttttcagcctgcaaaacaattattagtcctttcggtccatcataagtttttaagatttccaagctgtaagtaatcattttgacctaccacccttattgctcactgttgaaatatccttggctgtagtatgctatcttcctttttctgtttgctggtaattcttttggaatgggaggatgaagatctttttacaaacaagtttttaagttgtgtcttacattgaaaacaaagtcctctgcattgattcttggcataatctgggtttttcctcatttatccatttacatttcccaatgcctccatttgtaattttcaaatcatcaaaatctgttctaccacctgaatcaacatccaaccatgtggtagggcctttgtgggaatgactttatttgattttggaaactggtcacaagacttaatataacagcatgtagttgttttatttccacctttctcatattataggaaagaaaatatcttttttcaacaaggaaggagaattgcctgttggctagaccctgagtgggaggtgaagttttctgtgcttttcagtgggttccttttgtgtagaaacccagttatcccctcctcccactccacctaatgtattcctctagaattcctatgcgttttcctccccctctacacaacaagaccctaattatattttttctgcagtcaccatttgcatgttcttgactgcataatgttttgcttacagcatcaaaaggactttttatctcttgttcatgatgaatattgtcccagttaatttatgtgtgtctttatggtatctcacgctgcgtgactctgactggtactgggaatgccattcttctctggttctcatgcttatgtgactagtgttaaccacttacaacccagcccttctgttagaccacttacaagcagtacaaactaggcagttgctatatggttttaaaatgtagtttttaattttatcaaagttatgcatgcacatagtatggctagttcttgattttttctgttggagatagtagatatgccttttctactatggaaaatgatgattcagctctctttcattgcttgcttccccccatccccatacttcctgtccttctctattctttcattgtatcatatagtttcagctacaccaatgtttagggtttatatttttgtgacattgtacatgctattcacagctgaactatgatatgactgcatttttaaaaaataacgttattttgttatctcttgatttaataaatgtaattatctcttgagttggggggccttagttttctgtgccttaaaactagcccaccctaacctttccctttgttgtacgaatctcttaatacaaaacacttaaggaaaagcttgaaatgtcctttcaccattatccacaagagtactattgcctgtcttgttttttccctcttgcctgggatctcatgacttactcttcagttattatccatttttgaggccttgggtgtttcagtatatgtatgttcgtattgctcttacccttgattagtagtttggctgggccaggcacagtggctcatgcctgtaatccgagtactttgggaggccaaggcaggtggatcttttgaggccaagagtttgagaccagcctatgcaacatggcaagatcctgtctgtactgaaaatacaaaagctagctgggtgtggtggcatgtacctgtagtcccagctacttgggaagctgaagcaggaaaatcacatgaacccaggaggcagaggttatggtgagccaagattgcgccactgccctccagcctgggtgacagagtgagaccctgtttcaaaaaaaaaaaaaaaaatcggaacactaacaagaattctaggctggaaatacttttccataagaattttgaagaaatgtcttctgtgtctggtatttctgttgagcaatttagttgcttgataagttttacataccacttgtttttttatcaccccggaaacttcagataattgctttgttcccagtattctgaaatctcacagtaatcaatgtactttgtgtgaatccactttcagtctttgtgctgggttcccagacagccatgtacttggaaacaatctttcatttctgggagatttattgagatttttcaaaaaatttcctttcctttgttttctcattctgtctattcgatgtatttttttggatatttgacaggtctgccctttttctcttctttttgctactattttctaggtctttgaccttttttctattttctgaaagataatcttaggtttctcttaatgcttccattgagttttttacttttcctatcatattttttatttccaagaactctttatttatgaaatatttttatagtattctcttccctccatccctcccacttctgttgcagtatctttcacctttctctctagagagatctgtgatacaattttttcttttgaagttttgggttcatcctttgctcctctctcctcacatccagacttattctccatgggtttggaaaaaaagggtgatgtcctttgagttgaactacagaccctttacctttaatccactcattcttttccaccaaatctgacatgtggtttgtcatcttcacttcttatcaacagtatatgatccctgctttgttcaagacctggctccaagtcgaccttccacaaggttttgctagagtctaaaccaaaactctttccaaacccaaacttccagtcaccacaccaaactacttctgcagactcatgtgtccatttcactgtgacagctcatttatgcttttcatgtgtgcctttgtgattgctctgtgtttgtcttatccactttctttttttttttgaaacggagtctcgctctgtcacccaggctggagtgcaatggcgcgatcttggctcactgcaagctccgcctcccgggttcaagtgattctcctgcttcagcctcccgagtagctgggactaacaggggcccgccaccacccctggctaattttttgtatttttagtagagacggggtttcaccacgttagccaggatggtctcaatcttctgacctcgtgatccgcccgcctcggcctcccaaagtgctgggattacaggcgtgagccaccacgcccggccttgtcttatccactttctaaggaaaaaaagctacataatatctatatccctgtcagtcctctgaagccccacaaaatcaaaaccatttttataatgataccaagatattcacgtctttcacacattctctcatacttttacagtggagttttctagagtttaaagatgtgtgatattgcagtaaattgaatgcagtggatatgaaaattgatctgtctgccattaagccaggcattaaagagaatttgcaagagtataaaacagtactatccttctcactaatttttttttgttaaataaatactataaaatgttttgttttaatttcttaaaataaatatccatagattgaacctccataaacaaaaactccctttggaatgctttggagttaggattccaaagagtttttgggttaggatccaaaactttggaattagggttccaaagtttagaatcctaatcctttgtaattaggattccagagtctttttccaaaggatactttggaatcctaattccaaatgtacattttaagtgtcaagaggtcatgagaccaaaaagtttagcacatctgtcctgaagctgtagatatacatatatggctcattacatctattaaatatttaagtactctgcaataagttattattattatttttaatttttttgagacagcgtttcactcttgtctcccaggctggggtgcaatggcactgtctctgctcaccgcaacctccacctcctgggttcaagtgattctcctgcctcagcctcccagtagctgggattacaggcacccaccaccatgcccagctaattttttatatttttaatagagacggagtttcattgttttggcgaggctggtctcgaattcctgacctctggtgatccacctgccttggcctcccaaagtgctgggattacaggcgtgagccaccgcgcccggcctacagtaacttattttaaaagagacatcccttcttattcccctatgccatctttatttgtttgtttatatttgtatattctcgtacattctttggcgatgctctgtggatttttttttcctatcttagataaaatagaattaaagttttgattgttatactctcagtatttatttatttatttgactgttattttgaattgttttattttagatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttggtaaaccatgcattatcgcttcttgtagtatatttatatatttttaattctgttgaagtatttccttataagatagagtctttataagtttatgtttattagagttaataaaaatacaaatggaagcctataattttacctggtttaggatttggaatggtattaatgcagatgtgaaatgattattggttaatagaagcatagaatggaggactttggttgacgttacaacaaagttggccactttgcttctcctaaaagccgcctttctcatatgtccctaatctttcagtgtttttggtggggccataaaaggggtaatttctgcaaaatactataacttagtgtataaatttccaaggtttaattaatgccatttcatccataaataaagcatataagaaatatagtttaaacctggtttttgaaaaatcatttaaattttaagtaagtagaaaaattaaagatagaagattagaaattgttaaagataggtgaaaacaaaataaaagctataccttatagaacagaggcatcaggaaagtaggcttcaaatgctatttaagtttattaagtagatgattctaatatttattaagtataatagccacccatttttcctctcatagtcattcttagatctgagttcttatcgttagttcctgtcgtagctgtaaatcactagaaacggtcaaatttcctaggccaggaattttcagtttgcaaatgtgtgcaagtgttttagttgttaaaaagacttaagcggggagggcaggtatttgtctacctgctatgcaaagaacatgcaacataatgaaagattgccttgcccaaagtgccatcattgcctttccttgagaaaacactgcttaagccagcctaccttggctttgaaaaagaatgtgcatacattcctccatcttgaggtggaactgcccgtaaattcctttttctctgagctcttatttcaagcaatctgtttggtacatggccccattgactactaggccttctgtcattctgccttgctagttttcaccacatactgaattagttttgttgttcttattgtttatgaagagcttacattatgactgtaaataattcaagtctaagtataacagctatctatattgagctcaaatcccattacccgggaaaaatcattgttaacattttggttacttcccttctggaaatctctttagcagccgggcgtggtggctcacgcctgtaatcccaacactttgggaggctgaggcgggcggatcacctgaggtcaggagttcgagaccagcttggccaacatggtgaaaccccgtgtctataaaaaaatacaaaatttaacaggatgtggtggcggctgcctgtaatcccagctactagagatgctgaggcaggagaatcacttgaacctagaaggcagaggttacagtgagctgagatcgagcctctgcaccccaacctgggtgacagagcgagattctctctcgaaaagaaaaaagaaatctctttacctcataaaattttgagactgggtgacattatgcaaatacgatattctgcatgctgatttgtatttattcagcaatatgttgctgccttgcacacccatcagtgttatactggatgattctaaaaagaattaaagccaaacggatgttaaagaatatttaggggctgggcacggtggctcacacctgtaatcccagcactttgggaagccaaggcaggcagatcacctgagatcgggagttcgagaccagcctgaccaacgtggagaaaccctgtctctactaaaaataccaaattagctgggcatagtggtgggtgcctgtaatcccagctactcagggggctgaggcaggagaatctcttgaatccaggaagtggaggttgcagtgagccgagatcacaccattgcgatcttcaaaaggaacattatatttaatattttatcaaaaattatgagttcctatttacatacacctttaacaatgttagctacctaatttcatcagttctctagatctctgtcaattaggtaagggatgagtattttcattttaaaactttaatagtggagttgaatatttcctaatatattattgacttctagtatttcgttaattatgatatatttttatcagagtgatcttcagcgagttttggttcttgccaaagtcacatgactgtagtagtcacttatatggacccttttcagactgagtgacctctaggcagcactgttggcccttttgtcattcttgaactcttttattttcttcccttacacgagaccacttagacctccttctacctctctgcatgccacttcttacattactcctggcttccatcgttaaccacctccccatataaaattatctgtataatttgtgttgagtttcttaaagtttcctttaccatgatcagcagatttatctctgtagcccagatttctttttttttttttttttggcagttgcaagatttaatggagtgaaaacagagctcccatacaaagggaggggacccaaagagggtagccattgctggcttgaatgcctgggtttatatcccagtcattatccttcccactgtgctctcaggcaatagatgattggctatttctttgcctcctgtttttgcctaattagcattttagtgagctctctttactacctgattggtcgggtgtgagctaagttgcaaaccccatgtttaaaggtggatgtggtcaccttcccagctaggcttagggattcttagtcaccctaggaaatccagctagtcctgtctcttagtaccccctctcaacaggaaaacctaagtgctgttggcgaggttggccaacgaccgctctaacttcttcctgctgaattgaggtgtagtaggggttgtgtagttgagatttcctcgggaggggtgccttcaatgtcattaacattggagcatgggctagcaggccggtccaggggtccacggtagatcttattcatggactgcatctggggctccatttgaagaacatttttagttttacagcttcgattctggaagagacaaacttaacaaggaggttaaagatacagggattgaaatgtatggcctgcagtgcaggggattatttctttggcacacttcacaggccctgactatctgcttgatagttttgaaaaggcctggtccagtaaataataatttgggcgtctgggtgctatcaatgcctaagtgaaaggtttggtgaagggttttaagtaatttccattggttagtgcagcccagatttcacttcttcactgcatgtctatacattcaagaagaacatagggccaaacgttttggtataagctatgcaacaccagatgtctactgagtccggacatgtgacgtaaggactgaagccagctaggtgcattcttcttacataaatgctttgtttaattattatgtagaaattttcctgacactcacaatttaccttcttccattgttctttttttttttttttttttttttttaatgctgtcgcccaggctggagtgttggctcactgcaacttccgcctcctggaatcaggcaattatctcgagtagccgggattacaggcgtgtgccggcacacccagctaattttgtaattttagtagggatggggtttccaccatgttggctaggctggtctcgaactcctgacctcaggtgatctgtcccaaagtgctgggattacaagcatgggccaccacgcccggccccattgttcttaaaatagcagctatcttggtctttcaatattacccttcgtatagtaaatacaataaatgtattaagttcacttctaccttgagaaaaacagcagtcactccaaaaacgttagaaatggcaaacaatactttgtcctaatatcagcaaaaattttaatgcaagatgtagcaatattattaatatgtaataagtgttttctttcattaaacaatgtaactttaaaaaacatacctctcaaaagtctgtagtttcaatatcaaacttttcagttttataatttctatcaaaagcaatagcaataattagcccagagtttttagaagatcattatctaagtttgttccatatcaggggaaccagcccccaatatttcaacgtgggttcttttctgttttccctaagtgttggccggtgtgagaaatagagaaagagtacaaaagtaagaaattttacagctgggtctcggggggtgacatcacgtgtcggcctgagctgcaaaaccagcaagtttttattagcgatttccaaaggggagacagtgtacgaatagagtgtgggtcacagagatcacatgcttcaaaggcaataaaatatcacaaggcagatgggggcagagcaagatcacaaggccagggcgaaattagaattactgatgaaggtccatgtcccgctgggcacacactgtcattgataaatatcttaacaggaaacagggtttgagagcagacacaactggtctgactagaattttgccaggctggaatttcccaatcctaacaagcctgggggtgctgcaggagaccagggtgtatttcatcccttatcttcaactgcgtaagtattgattggggaagtgataaatgtccatgaaatcttcacaatttatgttcagagattgcagtaaagacaggcttaagaaattataaaagtattaatttggggaactaacaaatgtccatgaaatcttcacaatttatgttcttctgccgtggcttcagccggtccctccgttcaggttccctgacttcccgcaacagttccaggtggttatattcatttaaaagggctaattaaatctcatgcataaattaattgagtgaaaatagactcttgaaggggctgacttctccaaaaactaatttacttactaaactgtatgctgaagtctgaagcccatagaggggatgataagctaaggaaagtataacttgattgaattctcatttgcctatgcctgctaagaaaggtggctatgggtggcccttttaatccagagatctgaaatcacaagttaaatcaaggtgattatacactaatactcaaacaaataaagggagtggctaatgagtagagagtgtttgtcttttcagctttgactattattgtatccttggtgcctagcacagtagctggtataagtatatacactagaaacatttgttgtgtatatgaaagatattaatctaactacccaaaccttctaccttaattacaacgaagtaaaattagaaaataaaaattcctaatgttctcattctgctcttctaatcaactaatgcttctaatggctaccattgaaacttacaggaggaccctttgaatatggaaagttattgaagaaaaaggcatctaatctattgagtccatggggaaaaaaagatgagagagaataaaataatttcttctagccaacatagcagctgggcgatcaaattcaaatagcaagcatcggagtccatgctattcaaccagtcatgggtaactgggttagcaaaggagggagcaattgtaatagctacccaagtagaaggcaaaaagattctatgagtcagatctggtcagttctgtagttggtgatctaggtagagtatctgcaaaatacttgcaaaatgttagcaagcctgaagaaagaactatgtcctggagtgggaagtgtttggagttgcattgagaatatttactgaatattactgaatatttactgaaaaatttactgaataaatgttgttctttgcttccatgattaagaatatactttggaaagaaccagacttatagtgacaggatgtagtgaaggcaaggatgtggaacaaaaatgaagtacactatggtgggagtatgaatgaaacaactaatttgtattatattagaaacatgaagtatacaaggccaactacagtggcttacgtctgtaatccaagcactttgggatgctgaggcaggaggaccacttgagcccagtagttaaagaccagcctgggcaacatgggaaaaccctgtatctacaaaaattacaaaaaaataagctgggcatggtggcacacacctgtggtcctagctacttgggaggctgaggcaggaggatcacttgagcaccctggaggttgagactgcagtgagccataattgcaccactgcactccagcaatagagcgaaaccctgtctaaaaaataaaaataaaaaaataggccaggtgcagtggctcacacctgtaatcccagcactttgggaggctgaggtgggcggatcacaaggtcaggagttcgagaccagcctgaccaacatggtgaaaccccgtctctactaaaaatataaaaattagccaggcatggtggtgcatgcctgtaatcccagctactcaggaggctaaggcaggagaatcgcttgaaccggggaggtggaggttgcagtgagccgagattgtgccattgcacaattgtcacagcctgggtgacagagtgtgactccatctcaaaaaaaaggaaaaaatgtacagcaacgtgtgtacatctatacatacatgtcattctttgaaattttatgtgactcttagattttacatctactttgattattttctttcatttgccagaattgatgtgttctgcaaatgctgttctcaatttcagtattatcctaattacaattacctttctctttttagcccctggaggaacgcgcatagatgatggtgacaagaccaagatgaccaaccactgtgtgttttcagcaaatgaagatcatgaaaccatccgaaactatgctcaggtagagcctgtttgagagactgaagcatttgaagaggactgaggaaaactctatagaagctctacagtccacccactttttaaataggaatcttagaaagcctttaaacttatgaaaataatgggcattaaaactacaaaaataggcctagcagtgtggctcgagcctataatcccagcgctttgggaggccatggcaggcggatcacttgaggtcaggagtttgtgaccagcctggccaacatggtgaaaccccatctctactaaaaaatacaaaaattagctgggtgtggtggtgggtgcctgtaatcccagctacttgggaggctgaggcaggaggatcacttgaacccagaaggcggaggttgcagtgagctgagatcgtgccactgctcaaccttggtgacagagtgagattccatctcaaaacaaaacaaaaagaactacaagaatataatgctttttttttaacctctcttgtgggaatttaaatatttattcttggatcaggagaattcgtttttcttgtatacatgttaaggaatatgtaagtattagtgtaagttggaaataaaatttatgggattttaatgcaatttatttctttttcttattgtgtgttaattccctgcctgagtcattctttctccataaagggcaaccatattttttactcttggactccatcttgattacattaggaaacgaatacaccaagagttgtaagtaggaatatagcctgtgtgtaggagaaaaaggaactagattaagaaatcatttccacagttattaaaataaccaatatttacaaaatcctcatttacataaaaacatcattccacttagaaaactgtctagaatcttactaatacagttgcaaactttgcttcagagttctaacaggactgtaggggccagtcatcctttattgccagtaaattataacacgttttgctcatctgctagaaacatgtttgttgtccacctagagtagaatctgtcctgcactttgctctcctccccatcacatcgttgtctaagtggttatatctttaacaccttcatttccgtgatttttagtctctgcatctcacagtttaaaaatcacatttattttattttcgtcgaatttttttttctacctgctatattcttgaatgaatttgttttatcttacgtgtacattttgatcatatttgttcccctaggtcatgatagcatctttgaaatgcttatagttcttatattacagtgtgagcctgtttaactatacacttttattattatagatctatggtgtcattatagtgagtttctattacctacttctgtgtctttttggttgacctaatatttaatggttgttttttttttaggtcttcaataaactcatcaggagatataagtatttggagaaggcatttgaagatgaaatgaaaaaggtaaaaattcaaatataatgcctatctgttttatagtaatgacatgggggtggataaaaattttataagtggccggacacggtggctcacgcctgtaatcccagcactttgggaggccgagacgggtgggtcacaaggtcaggagtttaagaccagcctggccaagatgctgaaaccctgtctctactaaaaacacaaaaattacccgggcatggtggcatgcacctgtaatcccagctaactgggaggctgaggcaggagaattgcttgaacctgggcagcagaggcttcagtaagccgagatcactccactgcactccagcctgggcaacagagcaagactccatctcaaaaaataaaataaaataaaattttacatgtacaatgatattgcagaagtgccatatatgtaataacatgtatgtgaaacacatagtgagtttttaatacatgtttggtaaataagtatgaaagatcattagctaatagctataggaagaaatatgtgattattctggactttttccattaatatttaatgtaagacagtgtgctttgttcagtaagaatagttttacgggctataacctctgaccttgcagagattaaaatgaaaactagataaagtgatttaagtagttaaagcctatggaagaatgtagcacagcagctaatgttcagcaaaattctttaattgtatgcagtttagcaaagggaataaaagcacctctttggagatagagtatataggtgtaattctcaatactctttctcatcagtgaaatccacagtagcatctccttaaagatgtcctcttttgagtaattgcatgttccctcttccaatttgtaactcctgtatttatatatggcacccactacctttacttgtttcagatttgtttgttactttgtcattgcttccaattttagataactatctaaagtaaaaaaccaagtgaaaaaagtaaccataacatatacttacttcttccctacttacttactctccccgctcctccccacctaactgcaccccaccccacccagttcaaagtggttctgtgtataatattgaagagcaatttggcaatagtcattaaaagaaatgtttcttacatgacccatgacccagccgtcatgaatttataagaatccattagcatggatatataaagctatatgtatgaagatgtcaccacagtattgaaaaatagcctaaatgttcattggtgggagatgaagactgtttaattaaattacaatctatctatacagtggaatactatgcagtcttttatacttgtaggcataactacatgtattaataagggaaaatgcccatgacaaattaagtggaaatgcgaggtgcaaagcaaccatttggtagtagtttgacctggggcaaattacttaatatctttgtaccttagtgttcttttctgtaattggagatggagactgttgtaggtattaatacacataaagggatcagaagagtgtctggtccactcaacaagttttagctatcattagcatataatgcagtaaaaaacaatatgtgtgtatacatgtaattatgttttaatgttgattaatataattgagcaatgtggttattatttttatgatgatctaatttttgtaccatttctatgtgattaagtatattttaaatgaatatggttatatgtgtgagcttaaagaagtggtgttaaaattttattttagaggctaatttttattattctcgtttaaatgttatttatttttataatggaggaaaaggacaaattgacatgaactgtctatatttatgttagttctttcattcttccccatttctgatgctccttggaacttaagcctttcaatccctcattccctcactccctggcacttacttagatgttaacttctttttaatttgttgagaatttaataggtataaattgagaggcaaatggactggtttgtttccagttctgccactttcacataatgtaaatagtctataatataataatccttcaattcttggggaatagtaagttaatattttcttatcccctacacagttagtggaataatcatgtcatcagggtggagacacttaagtctctatcaatgccagtgaattttgcattggcgcaaaataatggaaaatcagcaaggcccctgtggtgatagtggcccctgaggaatttccatggcaagcctaataactgctgaaatggagaaagtaacagtagaatgtagtcaaagcacaaagcagaggagagtcaggagagagaagggcatcccacagggctgactactcttagaatttaatacaggaagtgggtttttcgttttatttgctttgagcttacattcaaattttctagggttgctacttttttagttccctgcctctggggcaagagaatctaaaagtttaccaaaaaaacatcaagaacctagaaaacccctttctccctcaacagtcttgttttgaagactgttgtattccgtgagctcagaaaagtatatattaaatgtcaaaagcttaacttcgactctttcctgttttttttttttgtttgtgtggggcttttttttgtttctatgtttttgccgtacaaattctattcagagaaaatgggtacatgtagcaggggaagaggtagtcgcccaaggaagtggaaaaacttgaaaaacaatacatttcagaaaacatgtccatcatgtatacttaactctcttgcatgcacatagtcaaacataaatccatctgtttacatatcatccaaatatctcttttcctttccatgaatgttatctacagctgtgagtaaattaactgagaagaaaggaactctgcctgctcaagtcactttccacagcatccagtttatcatgaaatgaattactatgctttgcatatgaccttctgtttgtgtgccacgtagccatggatgttcacagtttatcttcccacttcagtcctttgcttcatagacatggttcctttttttttctttttctttttctttttttttttttttttttgacccacagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggtaacgaggctcctgttttctcgcctgtcagacaacaaaagaaaaataaagtcacagatagttagaaaaatgccagtggctctttttggtgtcctctattactcattcttcatttaagagaatatctttgtatgggtgtatattgcctttcaaataataaaaggagtggacttgttaattgtaggaagtttgaaggaaaaaatatgcacacctgtacaaagacatattaagaaagactaatagcaaattaaaatctcatggaagacttgatgcctaggtcaaataccccgaaatcgatctggtaatctttttgcccttcgacacaaaatggcagcctttaactttcacccctattataagaacaaaaactgttcccctctcaaggtctagagaaactgatgctcagatattcattttgattgcactttttaagatactcattgtctcagttttagaaaacaattttaagtctgctgcattagaaggagtcttgttttaattttaaggcattaagggttggataggcatgcataccatggtttggttatagaataaaataaaagtcggctgtttacttgtaggaggataatgatagtcaaattacaatgcaacacaaaacagttatttttccttaaaaataaattaaaagagcttttgtgagaacatctgtttcttctgagaacttaaagttttcctcctacatatatgaagtcctagcttcattcatgcctatagtgaaagaaaggagtcatagttttcttgtagctaaggaaagaatagtaaattgagagtcaattggtcttattcagagactcttcctagtttttagcttaaaatcactcagatttatgacaattcagactctgtaattgttagatgttattagtattatgacattttaaagtatttccctgaagaaaattcacaatacaacacacatcttatttttgctattagccattttgcacacagaaagtcaacatagaatataaatgttaatcattaattattttaaattatcctagccaacataacagaaaataattgcctttctagtttttttaaaaacctaagtgatgtctgtaacttcctttgtaatatatccaaaaattacgttattaggtggatagatatctgataaagcaaatacggcaaaatattagttatagaaactagatggtgggcatgtgaatgttcattgttcaatttgttcaacttttctgtatgtctggaaattattgtagtaaaatgtttggggggtggtgaggagaaaaataactttgctatggaagtaacatagtacctctgttatatggcttttccttaaactctgccatcttttacaaactagaggtttaaacccttgcttcctaattggaaaaggattaagaaaatgctgggtatggtaactcatgcctgtaatcctaacactttgggaagctgaggtaaaaaaattgcttgaggccaggagtttgagaccagtctgggaaacaaagcaagactctcttctctacaaaaaaaaatttaaaaactagccaggtgtgttggcacacctgtacaatcccagctgctcaggagactaaggcaagaggattgcttgagcccaggagtttggggctacagtgagctataatcacatcatcttactacagcctgggcaacagagaaagactatctaaaataaaaaaaaagaaataaagaaaatggttaagaaattaatcattttccccagctcatccaataaatgaccaagggagatgggattatcctactcagaggagtaactataaagaaagttaaatctcagttttaggctcctagtttcaagcgtagtttttctttacgatacagattacagcctagtgttaatttatattaaattttatattggttttatgagctaatgataatgctaaaaattcatcttaagttgtttaacatgaactttcagttaaggtgtaatgcatgttttgttgttatagccgtttttgttttttttttaacttagtttctttgcttattcaagggaagaaaatcaggtttagttggtgtctatatgaatgatagaccaattaaatgcttttactttccagttgctggaagacctgggtcaaattggtatataaggacatggatttcttatgtaacaataaatagaaaattaggacagacctcaggctgaacagcagtatcattcaggacttaagtatttttctcctgttatcattcatagcattaacttcatcccaaggatggtgccccctctagttgttataagatgcctgctgacacagttatggcatattcttcctggttcaggttcagtggaagaacacttctcctgaacagaggataatttatctttccttcagctgattggctgacacaggctgcatgactagtgcaggtccagtagcaattgccaggggcgtgccttgggcagatgagcttaagcgaggtcactaaattaatcatcagaaaggggtggtaccaggacttagactaatcagtagtcacctggactggataaaaggggacctcttttaggaaggaggtaaagagaatagaggctgcttaggccacattatcattagctcataacaatagtagaaccttcagtttagaaaaatcagttaaatgtttcagttacatcttaactcttcattaaataaccgcaacataaatttagaaatttgaagtgttcatagaactgtcttcttgttatctgattatttctatttggaaataagtggtaatgtaaatgtggacatgtgattaaatggtttcctgatttaacataactagcttaataatgatttttttttaaatccagaagagtttaacttgaaacagccttggtatttttatagcttaactcaagaatattttaaaatgctttttatggctgcgtgcaatggctcatgcctgcaatcccagcaatttgggaggccaaggcaggtggatcacctgaggtcaagcgttcaggactagcctgcccaacatggcgaaaccctgtctctactaaaaatacaaaaattagctgggtgtggtggtgcatgcctgtaatcccagctacttgggaggctgaggcaggagaatcacttgaacccaggaggtgaagattgcagtgagccgagatcgtgctacttcactccagcctgggcgacagagtgagactccatccccccaaaaataaaaataaaaataaataaataaaatgctttttataaaaagcaaaactaaggtaaatgatatgtgttcatctattcgtagcaatacttattgtatctatcactatcagtgttcttgtactggcatcctttattagcaaattacttgataaaggtgacattacagttttgtgtctcctaatttactttcttgtgcctcaagatcactgttataaagatgaaatacatatgaaccagagggtgaaataaaggcaataacaccaaagatactgggtgtgaaatatgtttttgaccaaggtaaaataaaataaacttgcagttagaccaggttggattcaaggagtccaaatttgaaaaatattttaatttattttccttttcctgaaaatgttctagtttgagtaatgagaagaggagaatttgcctagaggtctattgacttttcatttgtaccaaaattagtcttttagttatttacacatttcaggaaacctggttgctttgcacaccatcacaattggttttgctcgtaaaaggaatgaaattctcttttgtttttcaacaggcattgcggcctcatttgctgtcaagcttttcaaagcatggatggcagaaaaagatgccaactctgttacctcgtctttgagaaaagccaacttagacaagaggctgcttgtaagtgttttctggttaaagagttgtatgtatgatgcctttcttggagcttaagcaatgcctgcaatgtagtatatgagtaagatccctggatctgtgttgacttggagcactgttccttttatttctgtgtaattggtagtagaagctaatttcattttaatctttattttgtgaacaaatggcacaataaaattaaagaattgtgaagaatatagacttccaaatttgtaagtttgttgacatagtattaacatttcatcagaattaagactttgttttatagccataacttttttactttttttttttttgagacagagtctggctctgtcacccaggctggagtgcaatggcacaatctcgctcactgcaacctctgcctccggagttcaaacaattctcctgcctcagcctcccgagtaggtgggattacaggtgctctccaccacacccagctaatttttggattttttttaatagagacggggtttcaccatgttggccaggttagtcttgaactcctgacctcaagtaatccgcccacctcagcctcccaaagtgctgggattataggcgtgagccaccacactcagcctataatcataactttctagacattttaaggttttaatatgataaaaatttcatcaatctcacttaatcaaatacttgtgatgtctgtcttgagtagcagtcagactgtgctaatctcaaatgtgtgttaaatagtttgctaacaaaataaaagtttaaacaagatttccctggaaatacttaagctgttgcagaaattaaacaagttaattgtgtcacaattgcttgattatatttttatttctccatctttgtgtttttctaagaaaatccagaaaaatattttgttcttgtaatttctatctgctccctacaatttctttcttcttgatgcagcagctgtgaaatgccaagatttctccaggtggaattgcttttacagttctaggatgaagtgtaaaaataagacacagcgctgccatctcttcacctggcctgttctctgttgttctcttccaatgtgtttcagtgtgcaagggtccagtcccatgagataattctaagactatctcttttcctcaagaacacatgaaagtaattttaaatgtaaatacttgcaatttaaatcacttaagaatactttgtttcttgaagtttaccttaaatagatttgtgtgtttaaagtttttagattatggtaaaaaaggtacagaagtctagattctagttcataataattttcattcctcatgtttcctgaatgtctaccctgtgctgggcatggtaccacaagctgcagagccagtagagaacaggatagaaaagttgcctgccctcgtgaaacctactttctagtggacttagggcaaatccctgtaaacagaagcaaaagtcacagaagataagtgaataggttgctgaggaaggtggaggttcatatgaagggaacatatttcttgtccatgaggctgtgggttgtctatagattagctctatcttggctaagcctggcttagttccacatgccttttcattcgggcacaggctgagggagcagctcccatctgggccattctgtcttcatggcaaagtaccagaacacagagactgaactgaacgtctcaagtaccttaaaaactcacctatggacgctgccatgcctggcaatagattgggaaaatccaatccactaataggctgcttctccacctctgcagatagacatagcaaggagggggttctcttaatactcttttgaagaagagaaggtgtatgattgggaacaaagatacaatctatccggttatttcttaaagcagtaattttcttaaagatattcacaactatagcctggttagcttaattagatggcttcatttataaaattcattttctttttggaaacacatgtcatttagctgtttttactaggttctgtgtgtgtgtgtgtgtgtgtgtgtacatatgtgtgtgtttgtgtatatatatggaacataggtggtggtttctgcgagaaacatataaactgggtgagaacagcgtagttgcctatgcactatgcctgcctgatatttgttgaatcaacaaaagaatgaggaactagtgagtcagttccactctttaggaggaaattttgttttatgaacatatacaacaaaattctctttaactgtgaactactacattttaggaaaagttgtgtattactagactttagctatcacccactattacaatacagaagaaagagcaatttatagcaactcagagaggtgaggggatgggagaagccaacccttattactgacaaagagaatagtgattaagaaatcaaagatattgatctcttccattatttattcaataagtatgtatcgattatattatatgccagaaacttccaagagatggggagattgaaaggaaccaaaccaacagaccctttccttcatgaagcttatattctatttcaggagagtgggccataaactaaaaaccgtaaaatatgtattataataaaggtaaaaattaagtaggggccaggtgtggtagctcacacctgtaatcccagcacctcaggaggctgaggcaggtggatatcttgagatcaggagttcaagaccagcgtgaccaacatggtgaaaccttgtctatactaaaaatacaaaaaattagccgggcgtgatggtgcacacctgtaatctcagttactcgggaggctgaggcaggagaattgcttgaacccgggaggtggaggctgcagtgagctaagatcacgccacttcactccggcctgggtgacagagcaagactccgtctcaaaacaaaacaaaacaaaattaagtaggaaagagttaaagagcttccaaatgtgggctgtaactttcagtggtggaaagccctctgtgataagatgacattggtgtaaagacttgagggaggtgtggagtgaactgtttaaatatctccacatagagcattccaggcaaagggaatgggaaatgggaaggccttggggcatgggatattggggaccgcaaggggagagcaggtgagagcaaaagtgtagataagctcagagaagtagcaaggcccatatcatctagggctttggcttgtattccaaataagatagaaaacttttggaaattctctgcagaatggtgtgtaatgtgattttgactctcaacaggatcactcttgctgtcactttgggaatagactcaggagcaagagcaaaagcagagagaccttaatctagggatgagatgatacagatttgtaccacggtatggtttctctaaaaaaatacaaaccatgttccaagtcaaaaaatgacatggtatgatttagacgggcttcccctcaacttaatctgaataatgattttcaatgtattatatactattcataagaatttggaatgtagttcataagtgaactacgagtgatatgtttaatggcatattgctctgaacataactttaaatcaaactttgcagtcacactcttcctaaatagaatattgaatgctagcacagagtaatggaataagtattgacttgggggcacacagctctgttcttaaatatttttggtggcataaattgggtcaagctgcttaaccttgttgaaacttggtttaccgtctagaaaaatgtctgctttacacagttattatgaggaaagtgccagtacattttgattcatagaagaaactcaataaaaatacattagttcccttccctgcagatttggaagatgtggagcagtagaggaaatatcagtgacgcagtttcagtgtggtataaaatgtttgctttattatgaatgcgtgtttgatagctgctcccaccagctctcttctgacatttttgaaacatatgactcaacaggggaaattaataggatgatagaacattgaaatttgaatcctgacataggagccctccagctgtgttcctataggtggtggcaaacccattgcagatctactgaggctctttctggaaccacatagccattggccatatatatgcaagtctaaccaatacaaaagcttggatatattttttagaccctgcagcagtctgaaaaatgtgagaactttgaaaatcatcttaatttcatagatgggagttgaactcacccaggattagatcatgactaagtgttactgagattctgccaaactgtgtagggtaaaatggaaatgaggtgaaaatatgagagcagctatggtatattgctctttttgaaaatttccatcagaattatgtaataaactagagttggtagggtaggtgtcttagaccttttctattacttataacagaatacctgaaactgggttatttatacagaaaaggaacttatttcttaacagttatggaggctaagtcccatgtcaaggggctgcatctggtgagggccttcttgctggtggggactctgcagtgtcccaggaaggctcagagtatcacatggcgagggggctgagtgtgctagctcaggtctcccctcctcttttttaaagccaccaggtcccctcccaacataacccactaatccatgaatggattaatccattcatgagggcagagcccttataatccagtaactctttaaaagcctcatctctcagtattgccacagtagggtccaagtttatctcaattgcttaccctttttttctttttctttgtgaaactgcctgatttcagaagatgtttagctcagtaaatataccagagatttgttgttttgtaaaacagtctttattcttttcttccaaatgtgagatattctaagtgaaatgaagacttttgtcctttatgcttgctgaaatttgaatggcttgttttatagcagtcttttttccctttttcaggaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtgggagaccacgggcagacatcacctcaatacacatgaatgagaggaattacatgggctgtgtagcaaaggctttccttaacaagtctgtcctatgcttattgctgtaaactttgtccacttattcctaccatttaaattaactcagcttcaaagtattgatttagaatcctccatttttgttaacactctaggatggtccagaaattaatagtgatttccacacaactgacttattttaccaggctgctatgattttcaaaatatttcatctgtcaaagagatttgaccatccactatcagtatagcccattatatggtagttttaaaattttgttgcaggttatctaacctgattaagcatttgtctagtgtttggaattaacactggattttttgttcatcactctgtatgaatatgtaacaggctttttatttgaaaaaagtttgaattcctgtcatgggaaaagactagttggatcagtgacttgtttaatcccactcacacttggaagagctgtgtttccctataatgtaaaagctatattttttataatacgcatatacatagtttatatatacatgctatagttcacaaagcaatgactatatcttttttttatttttagtgtatctggagagagctttctatttgaagttttaaaatctttcatgcaacaatttaaaaattaatataaagcgtcctttctttttttccacgtgctctaaaatgcctgacccacacctccttccatgctccaagccctgcttggcagctcacatggttgaagcctggagaatgtaggactgatactatccagcaggtggaggtgttggaatgacaaatattcttaagtctcatggtattaaggatagcagtatatttaatcatatttctccaagcaagaatttgtacattattttccatggggaaaagaagcaaacataaaaagccttgtgatgcttgtagatgccaggatgtcacacttttatgtggcttcctccagccagcacagggactgggactgcccggctccttctgcttttgaaggctgctcaagtcactgctggcatttctacactccaggccagaagtcaagaaagcaatgtgtttccagcaaaaaagaaaagggagggaaaaaaaaggtgttactactactcacaaagtagtatgctggagatatacgatgactttcaatcacttctgaggcccaaacctctatttattattttattttaaaaggaaaaagcctttcaaataaattttaggcaagcctatattccatactctcagggttgagtataaatttgcatatttatacataattcaaaggagaaaataagttgctgaatactgctgaattgatgtatatgaaatttaaaaattgcctttgcacttacaatttatttacaaattaacttttcactgagatggggcataaggatcatcaaaagtaatcattgaagaataaattgtggagaatggacctgtacaaacccaagatggtatccatcaagaggttttaaagtttagggatgggataaaagttcacaacgctgttgccttctttaaatctccaaaaagtcaaactggctcaagtatccctactctactagactcaaaggggtttctctatgaggaaacaaaaatcctctcttactccacattatccagcagctcctggccagagctaagcctattaattttgggactaaaaataaatttgctttgagaacaaatcattatagtttttctccctcttccagtctgagaatgcagacaaggaaaggagaagctaagcagattgtttcttagctgccccaaaaccttgattgactgggcagctagcggggagatgggagccctccatctgcctgttactttctgaccccatttccatgtaatgtaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaaggtaacagcccttagcaaggaactgacccagccaagggcaaactgcagctttttttgtttgtttgtttgtttgtttgagagtgcagtggcacgatctgcgctcactgcaactttgaactcctgggctcaagccaccctccctcctcagcctcccaggtagctaggactacaggcgcgtgccaccacgtctggctaatttcttcattttttggtagagatgtagtctcgctgtgttgcccaggctggtcttgaactcctgcattcaagctatcctcctgccttggcctcccaaagtgttggattgcaggcatgagccaccacgccgggcccaaatttgtcttaattgagagtatgacaaatgggttccaactacaattaccctagactcagactaaacatatacttcctaatttttttccaagtttgcacccagcgttcatgagaacatagcagtgagtaaactgtccatgttactttgatcagggaaggccctttggaagagataagtattgaattgagtaagtctcagaaaaacaatggctatgcctcagtgtcagaaagtcaaggatatttctaaatgaatgctttttatcccagcagctcatcaagattccttccctgtacccactaagagaccaaatatgagaatctgcctatattaaagataattgctggcctgctatgtctaagggatatttcgaaaatgaggtcatatcctcatagaatatccattgtattattggactgtggctctgccattgaaaaaatgtgaatcttcttcccagttccctcacaggtcgactatactgctttgttcctactgttctgttcccctcaccccattgggcacaatatgatgataaaaggtgtcaatcctgaaagtcagtcttttctaagcaaccctccaggttactgttatagttccagcagtgtcggctctgtacctcccacgcaagtgacggcttttactctccacttctgttctagcaatatgctcccctgctggccgtgttcagctcccaaggccagtcagagctgatcctcctccagaaggttcaggaatactgctacgacaacatccatttcatgaaagcctttcagaagattgtggttctcttttataaaggtatccatccacgtgccactgctgtgcttctgtgttttgctgaagctctttgagaggcagagcaggcaatgaggcagaggaggtcatggggctctgtttagagagggacagcaagatgctaatttgtgaaagttttattgaggcaaccataccatgtagagagaggaggcatacacgccatatatgcgttgccttggaaaccctgcttaggcccctgggcacttctcattggtagatgaactggtaattgtttcttggggttggtggaaaaaaaatgtaattatataaaattgagcctgtttttgaattgtaaggattagctctaataacaatgattatcaaaatagtatatatattatgttcagactcttttaggtaccataaatctgactttaaaattactgaagtaattagcctttttactttgtattttagttacttggcccagccattctcctgttttccaagggaatggctatttttaggttttcacatttactgtcttttcattgtatttataaggattaggttgctatgacaactggcactaaaatatgaatgctaaaggttttaaccgatcccaatctgtatacctacagcatacagaaatgtcctaggctattttttgggcctacatttatgtagttttgtgagggagaaaaaggaacacttaagaagtggtacattttgaacattataacatgtttattttatgttattatgttcataaatatcatatcagaaaagttaaaataataccagccaaatgtttattttccctttcatgtgttcctaaatttgtctcttttgaattatatcttgggaatttggaaaataaaggttttagataaataatagctcttttaaaaatgcttaatagcatttcacaatgaatttttattggccacgtagattcctcaaatgaatgaatcttgtccacaagtgtttgggtgatattttactttttcagggcacagaggtattcagcaacaattataatagtcaggaggaaaatatgatggccacccattgccacttgaagttcagtaattggtattttctccaaccagacctgagttgggtcttcttggatttagtcataagatagcagtgtcctaaaactaggccccacccaatgatacccaaagtgatccacccatcagaaccaaacctgcaagccatgttaccaattcatagatggtacccagcagccaagaacgagaagtggggcccaaccttctgtggccacagctggctccatttgtaaaactggcagagagacctatgggacaggtttcacatttgttttgagggtggtcaattttttccactacggaaaaccaaactgttcgtaaactagttagttacctgaacatagtttgctttcttgtcatataaaagataacccaaccagtgtttctcaccaatttttttttttaactgagacatcgttgtcggagtctcatcttcaggagcaccctatcgtattattgtaatgaaatcacaaagaatcagcaaacccattgttacgggaaatgacatctaggtggcacatgaactattaaaatccttcagatttctcattttaaccactaatgccaacctccttttcctttagacttagacttcttataacaactactgacaggtagtaaaactggctactttgagttttttcttcttcatcagccccagatgctaagggtcagtatgacctgaaattagaaaataactcaagaagtaagcactaggaagtaaaaagaagaggcatgagctcttaggctcattgattaactaggtaatcagcgtttaaataacctaaagttagtgaggtctgtggcaagtatgacctggccccagggaacacaggaagggtgagtgtcaacatcaattttatttctgccttagttatttttggaaatgaaattgggaaacttttttaaaaatgtaaacctaaaacacatcactgaactaacattttcaataccattttctaggtaattttgtaattttccacagaatgatatatatagtctgttttcttaagtgaaatgattccatgttttctctggagaacatgcaatccctgaggaatgattgttccataccaccgttaagagcgttactgtgttaactatgtttaccatcttgtctcttttttgccagatttttactttcaccttattttgtccaccaaacacttgtgcaccaggagacatgtatttgatttgtttctgtaaagatttggatgctctcattccgtgttttatatgcctagagggagacttagtaaacagtgagtgttaaagcactcctttcctaatatgcctaagaattacccagagagcttgttataaaacacagctcccccagagattctgattcagtagggccagggttgggcctgagaattttcattttaacaagtttccaagctgatgctctgactgttgtaccaggaccactggtgtaaagtgtatagcattcaagaagcaacagatgctatgaactccagtgacatgttcaagattatacttacctttgatttcatgtacatacccacattttacacatatggagtagtgtcttctctgcttcttttaccaagtttctgtggattccttttgtttgtcataaggaacgtagtgctctaaaacaagtttttaaaatgtaatggaaaccgttgctccattttaattttcatttttatctctctctgacacacagagcacacacaaacatatacatggacacacacacacctcccctttcccaacatgtccagaacttgatgatagcagaaacttgggcatatgattagccatgtcccccttggcaaatctaattacttaattgaatatcattattgaaagatttataaatcttttacataaataacagtggaataaaagcaaataaactaaataatgctagtcagcaaagaaaaaagtggtgatgggtcattttgcaaagactctctgtattaaaatctagatttgcatatttttaaggtagtaagaaacagtaaatccattgctaactttcaagcatcacattattgacttttaaaaataattttctcttcttttttccctgaagataagtcccatagactcagcatggtctaaaatgtgtaaaactaccttgtcaagtactgttattatctctatcatgggttttcttgtttgcagaaattttttaggttaaattctatcctgcatgcaaatttttctaaaaggagttttttattctagttctaaaaaagggtgagtgcccttctcagcatatattcccagcattcttagggtaaattatttttgacttgtgtccctatgtgacattcctaataaaaaaatttctgaatttcaagagtttcaagtgacatagtttcagactaagtttctaaataactaacatgatctaaaatttagcagttctcaagccacttttacagtattgtctcttcgatcctcatgaatacattagaactctacaaattgagaaatatttattttttctcatcaagttaacaaatttattccttaaacgtgtgttgaatcgatactatagggcaggtctttcattaaatgctggaaatgagatgaacaaaatatagtccctgacttcctgaatttcaggatgtagaagaaaacaaagaattacactcaccatgtcaattgctgaaataagcctcacacagagggtgtcagaagggataggaccacagagggagggcacctaacttgttaaaggtaatttggagggggagaagtgaaggctctcaaggtacatgtatctcaccagacattatgaagaagttggccagatagaaggggaaaacatatattccagtctctatgtgccatcatacaatgtcttcctttcttactgtcttttactgttattctatattcctaataggcatttatgaaatatcccaccaaaaatggtttctcagttttaattaactcttttccctactttatccttagtgagggaaaaaattgtctgaattctttgtccctcaaggagttccttccttttcagacctttcctttcactaaatagaagtttaatttcttcttaaactcttcgatgttcatactttgcctcatatggtgctctgtgtagatacttcagtagcttttaattaataattctctggtactagaagtttgatctttcagcaagtagttgttactaccctgggttcttctaagaactccacattgcgccgttaatatgtagacttattttaaattctccttcctattcttaacattaaatattctcaattaatggtaacttaagaatatcaaggcacaagatttgcaataaacaatgcatttgataggttttacctatcatttagtgtgcttttcacaagcactgacattgacaagcattttagtagttgcatggtctccttcagcctctgtgaggcaataaaacacaggaatgtgctctcaaccttcaaaaggaaagctcagacaaatagtatcactaaactgcagtctacatcagctttccaacctgtactttgtatcatcctcaattcattaaggtgtggagaaaaaaaacaattctcctttccatgtttgtcacagtttaaaattatattgtttgtgcagaacattaataatgatagtttaatagtgcatgaatataatttataaactcaaaaatatacatatgttgggtgtatatgctcaaaattatcctacaggcaggaagacatgatccaaacagtttgataattactgatctaatcataagcatcttaaagataatttacaagttatataaaagggtcttttaaaatccctgttaatgttctttaaaagtctctgcaaggcagtcttacacaataacaggtcacttcctcgggacacaactgcctgctcctcagctctatgacaattaggctctgatggctggtagaaatttcttttatctcagtggagagctggaaacaaagagctaaaataactagaagctaagaataagtctacaggacccctgattgtagctcttacatccaggctctataagtaaatccagacttcttgcttcctttgcaaaatgtaatgtttttagtgatgataataaacatgtttttttaaaaaaccttttattttcataaacaaatcatgttcattttagtcagctcagcctcttcaatttaattcaagaacattttccaagagccaataattctttaaaaataaaaaaagccaatgtttttgttatgaaactaccagtgatgttttaaatgaaaacaatattaaattgtttctgtcattttcataagttgaaattatattttaactgaaaagatatcattaaagtaatttattaacattatatggctttatcagtatttgtaatgaattgagcacatctcggggacaataataaatgctttgtacctgttttctgtctcgtttcccactacagattcccaaacaacaacccattagaacattggaacattagaagaatgttagaacaacccattagaacattgggagactatgtacacttatttttatattctccttcctattcttaacattaaatactctcaattaatgttatgttgagaatatcaaggcacatttgtggaatttagagttttagacaaaagatagttaacattttttgttgtttttagaaacctgtaggaaattagctaatatgtctattttgtcttaatgtagtagaggaaaaatattactcttgtaatttgggatatactgtgggaaaataagtcgtgatttagtgatggagaaagtgtagaacttcagtttaggtgtgtattactcccacaacatagcccagaagttcctctttatatctaattgctaacatcattattgcatactatctacatttttttcctttgtcatttttctcctaaaaaaagaaaatcccaatctccttaaaagacactggtcatttgaggttactctttaatcaagatatggttgaacttggcaggacccaaaatgttctaaaatgctggaattgctggttcatttgcaaaattacaaaacaattctatttcctaccagcaaattagcactgtgagagatttccaagtcctagtagtgagctataggcttgcattatatcatgcctaagaagatgtatatcatcatcatcagtacttaagcctttagtaagctatcaaaatatggcactatgctacatgaaaatcaacttggttcctctcttctgataagtaacagaatgctttatatttaaaatgattgctttctattaaactgtaatacatgaagttgttttgaaacatgacatttgtatagtaactttgaaatctttgatttaaaattgcagctgatgttctgagcgaagaagcaatactgaaatggtataaggaagcacatgttgctaaaggcaaaagtgtttttcttgaccagatgaagaaatttgttgagtggttacaaaatgcagaagaaggtatgattctgtttacaaacattgatgacctttaaacactgtctcattatatgtcaaaatatttacctcttccacagattttacttgattttctaaaactaaaattctagagttatctttcgtatcaaacattttgccaacatcttagctttcctttctgaaatcacggcaataaaaatctctacatgtaaaaacaaagaaagaaatgaaatgcttaaattatccactctgatggaggacaataaggaagaaatgattagtagatgtgaaaggagaaaaatacatttagcttaatcacgcattatggaattctatagatttttatgacacctttaccaattaactggcaattttaaataatggaaatataaagtggaaggataataatgagtaagagtgaattcaggccaggtgtggtggctcacacctgtaatcccagcactttgggaagcagaggtgggtggatcacctgaggtcaggagtttgagagcaggctggccaacatagtgaaaccctgtctctattaaaaacacaaaaaaattagccaggtatggtggctcacgcctgtagtcccaggtactcgggagggtgaggcaggagaaccacttgaaccaggaggcagaggttgcagtgagccaagattgcgccactgcacgccagcctggatgacagagcaagactccatctcgataaataaataaataaagtgaattcaattaagaataaaaagttcaggccaggcacggtggctcacgcctgtaatcccagcactttgggaggccaaggcgggcagatcatgaggtcgggagatcgagaccatcttgcctaacacagtgaaaccgtgtctctactaaaaatataaaaaattagccgggcatggtggtgggcacctgtagtcacagctactcgggaggctgaggcaggagaatggcatgaacacaggaggcggaggttgcagtgagccaagatcacagcactgcactccaggctgggcaacagagtgagactccatctcaaaaaaaaaaaaaaaaaagaataaaaagtttatcttaggtgatccaaagaagaaaagttatattgtttaattttatatatattcaaatttttatataatttatatgtataaatttaatatatataaaatgtattcatttataggtatttgtatatgtatgcatgttgcatttttagacaggcaaaatttacgtgaaagcagaaaagagcaagagtttgctatctgccctcatgtgactattttaccttataatgggtgcctagggtaaaagtatgctggtgcaatggcagggttctgggttggtgactgtagtaacttttgaccttaattagaggaatctgggaggaaatatctcacttctttcttctctcctagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctgg

SEQ ID NO: 38221 - DNA, 27167 bp, Homo sapiens
tgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttggtgagtatgtgcactgggccccggccaccccgccgcgcctctgctcggcgccattggctacgcgaggccccggcttcgcggcctaaatggccgcatcttcgctggcctcgtagaactgtgccggcgcccttccacagccagccttctcgcggccccttagcgcggtcaggccgccctccttttccaggtataactgctcacttgttttttgcctcctagaacagtgggaatggggaaggagggcgcgagaaggttaaacgctgaaaggcgaagactgggggacacctgttagtacggaggactggttggcggcgtcacgccatagccaccccggctgcctgcggagatggggatgagtaggcgccgcgtcggcggaggagcgccaaccgtttgtcagttcactttttctgccctcttttccggggtaatgccgggcggcttcgctgcctggctagatgaaggttaattcgggtcattggagaggatccgggagtgacagacgccgtttttctcctgaacttgctggggggactgttgagtttgcgaatggggcgtctgacagctggagggggtggaaggaaggtctggggatgctggttctgtttgccatttccaaagtgtcagaaaaggagcacgttgttcttctaaacattgacagttcgctcgcattccctcctcacctgcctcccaggagttgcctgctctggcatctctttctacctttcagttgtcttgtgtatccagcagatctcggcagttttcgacagtgttctttaaatgattttgtttttaacctaatcgttagaagcagggcaatgatgcattttatacggtaagtggggttgcgggtggggattgaaaggctctgaagatgggggaaaaaacaccaaaattgtaaaattatagaaatgagaatcttacacctccaaagatgacattttctcaggataaaccgaccatcccagaatagccagattagtaaatcatcagagtccggatacattggaatgttggtgttggacatcattcatttaaaaccttcttttaagaacttcatgtattagtatattaaagttttgattttctacttctccaactagctttttacttactcactgaagaccaagcaaacctttaaaataatttttaaaaatcggcttaaggtgatgtttgagttagaaaataagatggtgagactttatttttttgagtgaaaactaaaacattgcaatttctcctgattaaaaacaaacaaggccgggctcgctggctcacgcctgtaatcccagcactttggaggccgaggctagcggatcacctgaggtcgggagttcgagaccagcctgaccaacatggagaaacccccatctctactaaaaatacaaaaattagcctggcgtggtggcgcatgcctgtaatcccaactacttgggaggctgaggcaggagaatcgcttgaacccgggaagcggaggttgcggtgagccgagaacgcgccattgcactccagcctgggcaacaagagcgaaactccgtctcaaaaaaaaaaaaaaaaacctccctgtacaatgtactatgtttctggaatatatcatctttcatgtaatactgcaaatgggagaatggtttatccattaacttttttccttaatttttaaattagaaggtggtaatcatcttactaacctaaagattgttaagggttgtgatacttacggatttaagtgttaaaaaattgcagttttcaaattatttaatttttctgtatcctacttttatctcttggttgtatttttgcttttccaaaataccccttttacgtttgctttttttggaacacttgtcacaataatttaccaggtgtatcttccaccaaggctattcatagcaaggttttcaaaatgtgtaaacaaacgtagggaagggcattcagtccttcaaattaaacttaaaaaaaaagtagtaagtacttcagttaaacttttgatactttgtttttctttgtttttaagtacagacctgtcccaaaagtctaataattttcttttacagtcactctgagcatgttatataacaaaaatgcttccatttaaaaaattatttttatttttatttttctgacactatccaccggagatcattttttgtttaatctgtagatgggaaataacgttattaataagacccaccaaatacagatcaacttagcttgttgtttgttgcttttccccccagagattaatctgtttatggtaaagtgaatattgggtttctggttttgctagaatcttgtggacattaatttgcaagtttgtttgagaaaggacaggaagctaatacgtttgaggataaacatgagaattttaaaattccatttgaagtcagtattataaaatgcagcttttcattaattaccactgctaacaatcaaaagagaactattttaccttcatttccactgactttttccccttatagtgatcatgagtattttatcaaaaataactatacctcaatatatcacctggtaattgtaccacttttgcaattgttagtcaacacaatagcaacatagtgctgagagatcaagcttgtagagtagcttacgacagagtttcctattctcgtttttttttttcctttctttcttcctttttttttttttttgctgagacagagtcccgctgtgtcacccagtttggagtgcaatggcatgatcacggagccttgacttcctgagttccgataatcctcccaccacagcctcccaagtagctgggactgcagacgcgcaccaccacgcctggctaattttcatattttttgtagagacctggtcttgccttgttgcccaggctgtgtgtaatacctgctgtatgccaggaattaagcatgctaaagatgtgaccatctcaagaagtctaccagactggcacagtattacttgtgtatctgagtctgtggtttattatgttgattgagcaatataattagatacttttgattatattggcttcatacttggaaaaaaatttattctgcttatttggacgtttaacacttaacatagaaaaaggaagttctctaatcagagcttaaaattccattgtttttgagacagtgttgctttgttgcccaagctagagtgcagtggtgtgatctcagctcactgcaacctctgcctcctgggctcaagagattctcatgcctcagcctcctgagtagctgggactgcaggtgtgcaccaccacgcctggctaatttttgtatttttagtagagacggggtttcaccatgttggccaggctgattttgaactcctgacctcaaagtgacctacccaccttggcgtcccaaagtgctaggattacaggtttgagccactgcccccggctgaaattccctttttgtgttttccttttattgatttttataaatttgtattgatagttactcttaggcatgatgtttgtcatacatactttctccgtatatgcgatttaacatgtaatcagatctacagcatttaattagttgcagtttaaagagattattggctacaaccctttacagttaatatttacttgaacatttgacaactgaattgctgagaatagtagattaaatgaaattgagatttcaaaacataagtagaatatggcgggattttcaaagttttgttagtttgagaatctactgctgtaattttaggacagccaacttctaaatgtagttttaagaggtaaatgaaacaactgtaccaaaacagatttttatttaaatttacaactattcagccttggctttcatagtgtgacagcaagaaaataaagacctaaggttgatttggatgttgatactcatcaagattagtagtaaaatgctgaattggagaaattgtgagttacagagatcatgttggttactgtagacttgatatttgcatattcaacagatattggagcacttactctgtgcaggcactttgcttcctgcggagaattcaattcagtgctctcgtggacttcacaggcaagagcagatgcagacattaatccatggactgaccacacagataaaattcaattggtgttaagtgctgtgaagaaagattatgtggtggtatgagagatgcctagtcgggatcagggaaggtttccatgaggaaatgaactttgaactgagattcgaaggataagatttatttggcgagaactttccaggcaatgggaataacatgttcagtgtacttatagtaggaaagaccacagttttaccagagaagcctaagcctactgacctcagagacctaaaagaaggtgccgttaagagcttgagggtctggcaggccatgcttaacaaagaccgtttggttttcttgtggaaaagacattccaggagacaaagaattgatgggaaaccatttagggcggcttttggagttgtccaggcaagagataatggaacttggaaaagtaaggaggtggtagaaatagaaagagatgtatttgagagatctttatgtggtaaatttaacagctcttaatgatgaattgtatgtttgtggggaaagagaggtggcatgaagtgagagatgtcaaagatgattcctgagttctgtggtgatgctataccattcactggaatgataattaaaataaacaagtattatgaatgtttttggtgggagggaaggaatcctgatttttgaagactaaggacatagtagccaggggaaaacccccacaaagaaatttttatctccaaaatagccatgataactgaaactaagaaacttaaattaacagttactttattacatcaaacctaaaatacataatggattgtaagatgtaccatgattttatatgccatttagaagaaaaaaatactgccatttaaacggacacactaatgattataagataaatcctgtggctttttttgtttgttattgtttttttaatttatagagatgctacatgtagccacgtttagtggcttacacctgtaaattccagctactcaggaggctgaggtgggaggattgcttgcggccaggagttcaagaccagcctgggcaacatagcgagactttgtctctaattttaaaaaaaggaaaagtagagatgctaaatatggaaaagtatgcttattggtatcaatgaaataaaggagtagtaagaagttggtgtagatagcaggttagtagtagtagagtgttaccattaaaaaaatagctgcagcatgtaattgaactccttgcacataatagttgtttccacttaataatgaattaagtacttagttcaaagcttttagatataggtaaacatgactgaatgatcttaaaggttttataaccttttacaaaaaattgaaacataatttcctaacagtttgccattaaggcaagtgctggacaattgagttgaatatattatttagaaataccaagataacccctaaattttgattagtacagtttctttctctcgcctgattgttctgcctaggacttctagtattatgttgaataggagtggtgagagtagacatccttgttttgttccagttcttagggggaatgctttcaacttttgcccattcagtatgatattggttatgggtttgtcagagatggctcttactattttgaggtatgttcctttgtttaagttgttgagggtaaaacttaagttttgaatacactgcgccatcagtaacttttcggcctggcctccgtgcctctacaggtgggactataaacttccagaattctctgtgctactgctagtccttttcctgctgccctgaaactgacacacccttgctacttattctgttgatgttttctttttctttttttgagactgggtctcactctgtcacccaggctggagtgcagtggtgcagtcattgctcattgtagcctcgactgccgaggctcaagtcattctcccacctcagcctcccaagtagctgagattacaggcgcgcactacatgcctggccaatttttgtatttttttgtagagaggaggtttcaccatgttggcaaagctggtcttgaactcctgggctcaagcagtcctgcctcagccttccaaagtgtcgagattacaggcaggagcccccttgcccagccttggtgttttctttctttttaacacatcctctgtcaggatatagaaagttgggaatgggagcatggatagtatcttacttcactgaagttgaccagctatttggttctccctttgggatgagccttagatctgtgagctttcagataggaattttcctgaagcagagtttaggtaatttttcttaatcttgacctttctgtctaccttataattaatataattttctcctagattttgtcattaggttgttggttaaagtgtcagtgtttggtatgatttatttttgtgaatttttgtgatttcagaatttgagtaagaatttgataggggctatgtaccaaaattacattacattagagaatttcattagtttaatgttttaaaaggtaattttggctggtagaaaaaaatgaggaacagagtgaatgatatcaaagattcctagtagttatgtgaatgaaaatgaaacccaactgttttacttatgattggtctctattgtcacattacagtgcttacttttgaaggtagcttaactaattttgttatagtttggcattacgaaacctagcatttgtaccacaagcaagacagtcttttcattaggtataaaggtacccttttcttttcattttgacaaaggtgttcatttgataagtagttgtgtcattaagcagaactacttatggttgatttgatttggttatctcagcacttcaaattcaggatggcactgtgtttggtttttcttcaagtttgcatcttagtaaccaaaaacagtcttaacatttcaatcagtctattagactgggttcatgtttcattattttcaattttgctggtagagagaaggaaaggatagaatatacataattgatgacctaagagaagtgtgatagaaagatacaccagtgaaattattgttctttctctccttgctctttaatttgtgtttgtaatttgtgcactgctttctgggcttgcttctgcattaccttataattgttccccagggtttgctgtgtatttgtctctctgaaattagattgtgaactctttcaggaaaagagactaaaaaatgttttactaacatttaaagtatccaaatgctgttaacatttttctaataatggtgataacctacctacatacatgtgtcacttttacatgccttatctcttgagtactctgagaactacctgtgtattgcaggtgtcatcctactcattgtacaggtgtggatactgtgacaaaagcaggttaatggacttgaccattgtcttgttggtcagtgagagagctgatttcctgactctgtatttaatggtcttgccacagtactattgcatcatgagtcgtgtgtgtgtgtgtgtgtgtgtgtgtgtgtgtatttgtttttgttttcttttttaatagtaataacctttatttaaaatagtttttaatttaggaaagctcattttacatgagtttccaactaattattagagtcagaaacaaagaaaataaaatcagaaaatcttttgcagaaaaaatacacaaagaacatttctacatgtgaaaaagcggtaaacagtgttaacatccaagtttttagtctcaattccacatctagtgaacaccactatcaaccttgagatctgatttgttcttgtcattcttcactgattagatgaaatatgttaaggtgtctttttcactcactggaatagacctaaagtggcaaccaactatctcaacaagttgtgctttattaagtcctggtctggttggtggctttaagtgtcttttgtatctcctaagtgtatttacttgtaattggtataaatcaacctctggggtatcgaaatcttgaacaggtgaatcacctccatcatcatcactcccttttctctttcttctgtttcgaatactctgaattaagtttttatgataatcacatatgtaaagatgcctgcgctcttatccagctcgatcttcaccttctgggatatgctcttctggatcctcttgctgaagctggcgttgcctgctgcccgaccgcaccgctcaccatcctccgcaggcagcacagttgccaggagcccggcctggccgcccccaggggcccagccgctgagaccgcccctgcgcccggcccctcagccccgatttcccggacgaggcactggcgaccacagcggccactgcggctgccgcctccccactgcccaggcgtgaagccgttcatgtctccgagctccggggtaccggcgctgacagaaatccccactctcctggccgctccgtcggcggcagttcactctgcacaccaagttagctgcatggcagaacaccaactgggcctgctgctgctggcgccgaaacagtggacagtgccgagggccgggactcagagtcgagcgtctcctggaatggagacccagctcactgttacatggggtcttcagctttttttttttttgagacagaatctcgctctgtcgcccaggctggagtgcggtggcgcaatcttggctcaccgtaacctccgcctcccggctcaagctattctcctgcctcagtctcctgagtagctgggattacaggcgcccgccaccgcacccagctaatttttgtatttttagtagagacagggtttcggcatgtttatcaggctggtctcaaactcctgaccctaagtgattggccctcctcggcctcccaaagtgctgggattacaggtgtgagccaccatgcccggctatatatatatatttttaatgttggtcattctttctaatgttaagacatatcctttgaggataattagattttggtgtcatgtaatttgggtggtatcacataatttcgttcatattctggatctgccacctattagttatatgactaaaacaagttaacctatctgagtctatttgctcaattataaagtgggcatgatagaacttcacaggattgtcttgagggtttaataagaatatagctagctagctagtttgttcaaggacataagtatctgataaatcttaatgtttcccctgttggtgagtcagaacagaaataagagttgaaactgctggtaagcctattttatccatcttcttattttgcccatagttaaaaagccacttttgttatattctgcactaacttccaaagttcattttgttttagcttttattcttttaattagacatattgtctaaaaccaaaaagtcatgtttctgaagcagagtttttaaaagatactttatatttctcattaagattgtgactagacagaatccttccccacacacaaactccagcttatctatttttcaatatctaagttagagttcttggcactattcacatttttactgtaccttcttgaagatgaaagagtccgaaagatttaaagatttttgagcagaattagacataaaaaactgtcatagtttggtgttgctataatagaatatcacagacaaggtaatttataaagaaaaatttctttctcatagttctggaggctgggaagtccactgtcaaggtgctggcatttggtgagggccttcttgctgagtcagctcatggtggaaggtcaaagagagggcaagcgaaagcaggtgattgaacttgcagcctcacctcccattagaccctgcctcccaacagtgttgcattaggattattttcatcctatgctttttgtaggacatattcaaaccatacatagcacaacatacttgttaaaattttaaatcactgttaaagcatgtttctttgttatatgtggaaagcattgcctagtaataacttactagtcttaaggtagttttctgaaaaaaaatatgagtggacgtagtacaaacatcttaatacattttttgatttgtttcgtggagtgttatgtgatataaattgcagttgcacaaaagtgaataaaggaagataattgtaaaatctgatgcagcaaaggttaaatactttagggacattctcttcactaaattatgcagaagatgggaacttttttttttttttttttttttttttttagagaaaaagacccagagatgattgagaggttcaggttaattaacatgacggtgcattcatctcattaggttccctaagattctcaacacatggtgtgttggccacttgattgattcacaggttttttggagagaggatctttgcaagatagctcttctgctcttgaagactggcagtagttacaggtagagatagatatgttactggttttgtacaagatgcaaaagataagtggtagtgaagccaccctggccacaggagaaagcacatgcaggagaaagcacattcatcaagagacagtacattttaggtttatttttttttttaatccaaggctttgggatcaagagaaggtaaggtgctattgaacagttttgagtagtggcaccacagtgccagaaaaagataaactgggcttatagacgctgttataataaacattataaaatgaaaatgctaacaagtacaaagaaaatggatacataaaacttttattcaagttagctggctattctgttggagattcttaggagctgtgaatggaggcaggtaggggatgactagtgagaggaagctcaagtgaggcacatccttcctattagtaattcttagaagctacagattagcttgtcagatttaaaatgttagtcaaaataaatatacctgaggtttcttgattggaaaagcaggtcagatgtgactagaaatggaggtgggttttttttttttttaatggaggattttagaaggcaatagtgtagaatttagagctagaaaggatcttacacatgaaaatacgaaaagtagactttgtaggtttatctaagatttttatttagtgacagagctagaactaggatccagggtttctctttcatggttagttcagctaggaagaatatttaaagaagccagggtaattaagatgaaccttgataggtataggaaagaggtaagagaacaaaaatccagtaggtaagaagatggaagaactttaaaatcatttttataagaaatagatattatttatttagaatttatgagatgtttcacagagggcttgaagtgggaaaataattgaaattatatagaccatataaatacttctataaaacatttgttaaaattgattctataattcattgtcattttatttatttatttattattattttttattattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaatggtccccagagtgtgatgttccccttcctgtgtccatgtgatctcattgttcaattcccacctatgagtgagaatatgcggtgtttggttttttgttcttgcaatagtttactgagaatgatggtttccaatttcatccatgtccctacaaaggacatgaatgcatcattttttatggctgcatagtattccaaggtgtatatgtgccacattttcttactccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcttatttctccacatcctctccagcacctgttgtttcagatttcctatacaccaacaacagacaaacagagagccaaatcatgagtgaactcccattcacaattgcttcaaagagaataaaatacctaggaatccaacttacaagggatgtgaagaacctcttcaaggagaactacaaaccactgctcaaggaaataaaagaggatacaaacaaatggaagaacattccatgctcatgggtaggaagaataaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactgcctgacttcaaactatactacaaggctacagtaaccaaaacagcatggtactggtaccaaaacagagatatagatcaatggaacagaacagagccctcagaaatgatgccgcatatctacaactatctgatctttgacaaacctgagaaaaacaagcaatggggaaaggattccctatttaataaatggtgctgggaaaattggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgtagccaaaaaacacatgaaaaaatgcttaccatcactggccatcagagaaatgcaaatcaaaaccacaatgagataccatctcacaccagttagaatggcagtcattaaaaagtcagaaattcattgtcatttaaataaagtgggcctgtgtcaatattaatcaagtgctatttgaatgtctactttcaagtagctgggactacaggtgcatgccaccatgcccagctaatttttgtatttcttgtagagacgaggttttaccgtgttactcaggctggtttcaaactcctgagctcaagcaatacacctcctgccttggcctcccaaagtgctgggattacaggcgtaagccactgcacccagccaaagtgagaaatggttttacacaggtgaatactatgatggaatctacactcaggcagctgaactgattggaggaaggataggtagaaagcagcataccaattattataatagttgaaaggcagctatgggcatgtggtggtaagcccagttgtaatagaaaaagcaaataacagctgagttggaggactgttttaagagaagcaggctggatatgtaaggaaaattatattcagagtgcatttgtttctctcagtctgtgttcctttttttctcatctcttgccaacctgtgtttcttataactagtcttaaatcttttctcttatttagtaatgatggaaatgctaaaaaaaaatttttgttttaacaaattgaggaaaggcatggtaactcatgcctataatcctagcactttgggaggccgaagcgggaggatcacttgaggccaggagtttgaaaccaccctgggcaacatagtgagatctcatctcaacaaaaaatttaaaaatagctgggcatggtggcacatgcctatagtaccagttattgaggagactgaggcagaaggattgcttatttcctgtttatcttgtacttttacctgttggttgtagattgatttcaggtgacatttgaataaacccaataaagaagccaggaccctccacgtcttagaagccacgttaggctcattttgtgtgtatttctacactggtagacactgtaatgctctaagagtgctgcagctgtaagagaaatcacctggtctcatataatatagttccttaacctgataagctactacttgtgtagtgttgtttatgcaacttaaaaaaaaacaaaaaaaaactgagcacgctttttatcttcattcaaagtgtttgcaactgtttttgtttggtttggtttggtttggtttttgacagtctcactgtctcccaggctggagtgctggagtgcaggagtgcagtggtgcggtattggctcactgcaacccccgcctcctgggttgaagtgattctcatgcctcagcctcccaagtagctgggactacaggcacgcgccaccatgccctgctaatttttatatttttagtagagacagagtttcaccatgttggccaggctggtctcaaactcctgacctcaggtgatccacccgcctcagcctcccaaagtgctaggattacagcactgcactggccgatagtcactttttaaaatcccagttcttcatttctagagaaggaactctgtttggatcttcttgttacaggtttgtatttctggaacatcagctatgacaaggaattaggcctcgttgtgtaaatgggacccaatgctatgcgtggatggctattgtgaatcaaacgagagagtgaattggagagattgtgaaaatagaaaaccacaaacaagtatttattttgtaacaataaatatctgagatcttgttcatgttgtcttttaatgaggatgcgagagattggggtttatgatgggcctaggtttgatataagtaggcatttgactccaattagcagcaaatgtaatagagaaggtgaaagtggaatggttggcactatgaattaggacactgaacacatactgctctgtcatccaggctggaatgcagtagtgtgatctcggctctctgtagccttgacttcttagactcaaatgatcctcccacctcagcctccccagtagctggtacttcagatacgtggtaccatacctggctaattttttctttttttttgtagagatggagtctcactgtattgcctaggctggtcttgaactcctgggatcaagtgaacctcctgcctcagcctcccaaagtgctgggattacagatgtgagccacgatgcccagcctatgatagactttaaaaagcacaaaaccaatttgaaatagcatggacaagagattttgctgtattttcgaaatttcctttctgttctgcatagatcatctaatatgtaagcaagatcttcttttagaaaagtactgtttccaaaatattttaaatcaagcaattgcaacagttgattccgtatagtaaggtatatctgtgttactagaaagggatttgcaaagtgatagcacttaaacttaagatttcttagccgggtgtggtggtgggcgcctgtagtctcagctactggggaagctgaggcaggagaatggcgtgaacccgggaggcggagcttgcagtgagccgagatcgcgccactgcactccagcctgggcgacagagcgagactccgtctcaaaaaaaaaaaaaaaaaagatttctttttggctaggcatggtggctcacgcctgtaatcccagcactttgggaagccgaggcgggtggatcatgaggtcaggaattcgagaccagcctcgccaacatggtgaaaccccatctctactaaaaatacaaaaaaaaaaattagctgggcacggcggcgggcgcctgtaatcccagctattcaggagactgaggcaggtgaatcgcttgaatgcgggaggcggagtttgcagtgagccgagatcgcgccactgcacgctagcctgggcaacagagtgagactgtctcaaaaaaaagaaagatttcttttcaggagttaggtttaattcctgaggacatttagtccggagcagaaggataggcagctgatgcagcatttttagtgtgttcatatacttatttggaggtgtactgagagaggcagttttaactcattgacccaaaaagagtggaataatttgaaagaaatgggtgagatggtagaggtgatggttactagctctttaccatgtatacctttaacatttgtccaccttggtatgttacattttggaagacatctgttagcagtagtgattgctgcttcacaacagaaaaattattttagggaaagcaattatataggaaaaagggttccttggttttcacaagtctggaagcaaatataaggaggaatatgcataagtaaacttgtctaaaagtatgatgtggctatcttataaactgctttatttttcagaagtaaggaaagttcagttttaaagtcctttttggaatcagattattagctaaattctatttggagtttcacacaaaggtctaagacttaactgaagatttagggcctgatgaaccaagtagatttatgcttctaaacacattagccagaaaagtgggtaactatagggggaatctgactgttagttcagcctgcgcatatgcacatctctagttgagtctcttagggtttcccttaagggacttcttggggctcataagcttggtcttctcagaagaatctctatatcttcatcatggaaaaacccaggaggccaattgtataggtacccgatggtggcattgtggacaaagggaacttacttcctggacatatgaaggatagctcttgaatcatctaattgttaaatttggggtctagtggaaagggcctaggaccccaaatcacaaagactgtgttctggtcccatccctggcactcagtgaggacaggaccgtatctgtgttactcaccactaaatactcactgcctgctacagtgcttaccatgtaataaataggcgttcagtaaatatttgagtgagtgaaataatacattggatgcataacttcggaaaagtcacgttatctctctgggtttcatttttcccccgttcatctataaaatacaagttttgactaaccaagtctctagttctcaaattactgcattaaaagttagaaagatacaattattttagataatcaactccattgtaaacaccagtgcaaacttgggcattgatatcaggtggcatttcttggttttaaggtagttaggcttataggttatctagattatttttgtaaaacaaaagcaatattaaacatttttttatatttgcctttgcttttttggtataaagaaaagattaatacatttttttgcagagaaagcaattgtggcagaatattaatatgtgatgaatctagatgaagtgtttatgtaagatctttatactaatattacaacttttctgtaaatttgaaattatattaaattagtaatttgaactcagaaaagcccagcatgtagtgagaaagaataaaaagtacaacaatggtaataataaaacattaggtggatgttaaggatagtatttggagattcataagttcacttaagtatagagatttgtatctctttgcgaaatatttagacttgtaagggacattcattctaaatgtaaaggaaatattcactgtaaagaaagactggtgaatttctcacttaccgttccctcacaccccccccaaaaaacacaggttttcttaaattgagatctactaacattttttaccattttaccgtgtcagatagaaactccatgctgttcctttggcttggtagtagtggttatcattttttttttccttgattgacaaagctggcacctcagattttactgtaacttaattactgaccctgcttcctctgtaccaagtggtaccttatgatattatctgttccttaacttagaatttagtgaactttagtgtttaacaatattacctgaatttgtaagttcttctgttgatataaatgtaccatcttcttttttatctcatatgcactctggtggcatatttccttttttttttttttttttttttgctggggcagcatctatctgaaagtgagttgcttagagactttagagactttaatctccagagtaattataaggattttctgtccatattattgaaaattatgttcccaatcttcgttttccttggcaaagtagaatcaaattttagagttagaagggttctaagtctaagttccttttcttgtgcttgggcaaacaagtttgcctggttaagggcagaatgggaataagaaccagagtttcattctctcatgccttgattttttttgtttgtttgttttttgtttttgaagtcttgtgtcccaaatttgaaagtctgtagttcagatgaataagaattgttttcatttcactgtttatacaagtaattgatactcccccaaaaaggccaaatctgtgtgagagctcaaagtatgctgaatgtgaataggtatttgctgttgtccaacagtaacccaaatctataaagtttaatgttcttttttttttttaaacaaaaaaatcaggccgcattactggcatatataaagtttaatgtcttaatggaaggatttgagggggtggtaactgaaatatgtgaaatgtatttaaaaaactcaatgtatttgtcatcctggttcaattattatgaatttgtgactgattttgagaaaaatttgtaatcttgataatttttaggctttaactaactacaaaataaatctagatgtatgctaaatgacttaatggaaacacttatttttctgcagtgtttcctgaggttataggcgggtgtttgaggagtacatgcgggttattagccagcggtacccagacatccgcattgaaggagagaattacctccctcaaccaatatataggtaagaaattttaataacttaaaaggaaaacaatgtatttgactttataagtgtttgtgaattggtttaattagctgtccttagttattgtaattacttagttggttataataatatacagagaatgctgttttatatataacaagtttatttgacccaatatagaaggctttttctgtaagaaggaagagggtcgtttcagagatggcaacccttctaaagatgtgttttcatatgtatttttaattgtggaaatagaataacaatcctaaatttttatagaaagtggtattaaattctgtatttcataaaataatagtatttttaaagaccaattctgtataaatttgtaggttaatttttcaggtgattttaaatatattaaacatttttgttttaacactgcacaataaactttaattgctttttctataagtaacttttagatttggtgtctagaaaatctttacatacacttgaattactaaattttaaagtagattggaaattgtggcttctgatgattttctttcttttcttttgatagacacatagcatctttcctgtcagtcttcaaactagtattaataggcttaataattgttggcaaggatccttttgctttctttggcatgcaagctcctagcatctggcagtggggccaagaaaataaggtatgtaacttaatagctttggtaactgtaggtttttatgttgtcagtgaaatattctaatagattttcttattttgaatacttgttattgattcacctgttaacatgtattattttaatttataccagttttatctctggggaagtcacttagcctcccttcaccttcatttccatattgatatattaagaatgattaggtcttaatctttttattttggggggatagggaggtgttaatttagtataacctgggcacaaaataatttgttatctgattttgattatattacttaggtcaaatcatatccagcaaaacataatatatacataatgcaggccttttaaaccaattaatgtcatattagtgggttgattcacattaaaaaggggattcccattaacttgttcttatcaaaactcctctctctttttaaattatttgtcctttgcctcttctgtttatggatctgtttgactaattgcctgaaagaaacaatgtaaatatacttaagaactttgtgctgtttctcttttccttttgtagggtcttattgccacatacattctttctagattactctgattttaatttattttacttttaagtaaaatattttaatattaaaaatgattttaatcattgtttctggagggcttactgtcctgtctaaaatgggtctaatttttatttttctcatggattagatttttctaggcttccttttatgaagtcttcctttttggagtcttctatctgatcttgtcctttaattctaggctgaatacctttagcagactcctgcatagctgtgcttctttttctttgggaaccatttctttccagtaacaggcaggacttcttaatataaatatcttcaagtggtatctctaattgaaatatatctctaccctgtaggttttatgacatttccttgtatattgttcccatgaaaatagacttaacattcccaaatggtagagtaattcctataaaaacaaaccccacctagctcctgtggggcagtagggaaagctctttctcatctgctgtgaacatttgatttatttttctgaaacagcttgctgtgaattggcattctcactgcatcctacttttagtcctgtgattttgttaaagtaaaattttctgtccaacaagaaacacttagccgcttttgggagagagtatagatttgcctttgaaaggtgaatgaatgtactttaatatgcctatgctttctaacctacttctttcttagtttgacttaaaatgatttgtttgaaacatatacaggttgtattgaatattatatggagttactaattttgcatcacaagtctcttatgaattcatatattataaaaatggtaaagtgaactcttatgcttgtattcttttgtttaacttattaaggctattatgaaatctctcaaattctgtgtacattatgaatatcatctataagtgcttcagcatgtatggagctgcaaattaatattggtttacttttgctctatgtatgttatctgaacatatggaatagcagtaatagtttttatgggaacttttaaagtagattaaaaagagcatttaccaaacatgactttgcctgttgtgcttaattatattttcttttaggtttatgcatgtatgatggttttcttcttgagcaacatgattgagaaccagtgtatgtcaacaggtgcatttgagataactttaaatggtaggttctgaatagtttgcattttgtgattgattttaaatgatttataatgagtatcaagcttttatcttttataataagataaacttctttagtgtttgtataaaagtaagtttatttgaaagaaattgaaaattcaggagatagaagaatttagaaaattttaacttttttttttttaatttgctccctcaacttaatctctttatctctgcttgaacttcacaccttcgaattccttgaggagttggccctattcttttatcagattgtctctgtgaactttatctactcccatggctttaaaataacatctgtatgatgatccctgaatgtatatctctcgatctctctcctaaaatgctatgctgaagaatcttaaacataacctactctaaaataaactcttgcttacttctccttcctataatgtctgtaaactcttttgctcctcctttgacatttctcatttatttagtgataccatcatttgtctactcagttgcccatgccagaaacctatgataatatcaccgtcttccctagtccccctattttatggattaccaagtcttctcagttccacctcctaaatttcaaaaatctaccttctgttcatcttaactgccaccaccctagtccaggacacaattaacttgttaccctcttctgcattctctaaaccaagggttggcaaatacggcctatgagctaataatgttttttacactttttggttaaaaaaaaaactaatgttttatgacacatggaaactatatgaaattccaacttctgtgcttataactaaagttttgctttgcatcagtgaaaaatttgtagaaatttatctttatattatataagtacctacataatgttcttgatttttatctcttggtccataaagtgtaaaatatttaccatctgccttcttacagaaaaattgaccaatatctgttctaaacaataactttttttttttttttttgagacggagtctcgctgtgtcgcccaggctggagtgccgtggcgcgatctcgattcactgcaagctctgcctcccaggttcacgccattctcctgcctcagcctcctgcgtagctgggactacaggcgcctgccaccacgcctggctaattttttgtatttttagtagagacagagtttcaccctgttagccaggatggtcttgatctcctgaccctgtgatccgcccgcctccacctccgcctcccaaagtgctggaattacaggcgtgagccacctcgcccagcctaaacaataacttttttaatgcaaattttatcttgctgcttgagtgttcccaattcattaaatgacttgactttgttctcaagataaagaccagaacatttaatctggccaaaaggctctgcatgatctatttcagtggttagcaagctgtggtcctatggaccatatcctctgctgcttgttttgtaagtaaagctttattagaacacaaccatgtccatttgcttgtgtattgttacagctgcatttaggctacaagagttgaatagctgtggcagagactatgtatcttccctagcccaaaatgtttactttctgtccctttacagtttattgaccccagtctaatcctttccaccttcccatcctcccttatatcactcctcttctatatttccctcagctatgctgattttctcttattttcagtgccaagctactttctggtctttacatttctgttctctccctcaaaggttttctactctcatgaatccccactctgtcttggtaatttttctttatcttttagatctcaatttaaatgatactatttctctgactagacagggagagccttgtgtatatgtccctcctagtacagtagtgccttttagttttagttctaagtacacaattgtaattttgtagccatttgtgtagttcttttgacatttcccctactggaatgtaaagtccctgagagcaagcagtgtacttttttgcctacttttgtatcccagttgtgtacatagatgataaatattagtgggatgaatgcatattataaaatcatctttaattttttggggggcggtgccatttatttttatagatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgtaagttgtttaaaatatagctaatgtataggtttctgttgattcttatgactcagcaagttagtaaatattacatatattatcacttgagtttccaatttaagattaaacagagggatgtattcttcattaaaatgttgaagtgtatgaagagagttcggccctgccaaaataaagtcaggttgttagtaattttatcttcaaggcttaatgattgggtctgtaaccttattttctttactctaaattcctaatggccagagttgatatattatgctagaggtgtgtatacttcctgtccttaccttcaagtaattagttcctgggagtatgcaaattctttgaacatactcaagataaaaaatttataggcaaatgtgtgaacacagagaggtattagttaactttttctttgtgatcaatgaattcactttctaaagagtttttatgagtgatttttgcaataaaatattcttttttctgtatatctttcaggcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaatttttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctgatttgaaagg

SEQ ID NO: 38222 - DNA, 32804 bp, Homo sapiens
gccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcaggtacaggcccggcccgcatgcctcggccattgtgtgaggcgagaaggagcccgactaggcccgggcccgccgctcctgggcaggccgagccgagccgaggcgtcgtctcttgcgggccaggtttcgggcctctcaggccggccgcgcccggcgcctctccctcagcctgttcttcccgcttctcctcgggcctcggagcccacgggccgggccgcgccgcgttcccttctctcggcgggcctcgttttccttccttgtttccttccccttccttaaagccctgggttcctcgcgtcgccggtggcgcgtctgccgcgttttctcccctgccccacgggcctggcgctttcccccgcctcccattttcagcctcttcctcactaccattcctgacgcctcccctcgggcctgctcctttattctcccttcgggccctgccttaatttgttcttccttttccatttctcctttggacaacttgctgctcggcgacgtttccttcccctgcagagaccaaaaggtcaaggaaacaaaggtaagtcccgctccgccggtggccctgagccgggagggggacgcggggcggtgggggcggggtctccgggaagcgccccgggcggaggacctttcggaagccgcttagttcgcaggtgccgcacacttaagtattttgaccctttcggtgtgttcttgcagctggcgaacagctttttcgctaacaaggagtaattcattaagggtgggggtggattgggttttgaaacgctccaggtccttagtttcctgtaggtcttagaaggcctttgtttttcatcctcgtggatcactctctggaagtactctcatgtgatgggggaggggaagcgggagggaatggaaatccagaggagccaataaaatgacctttttagatcaacttgctctgggtggagggggacattttcactggcgactgtcgcttcagcattcactgtcatctcttacccttttgaagttcaatcttacgtgctttgttaactagtaaggtttttctctggttagcatatatgaactaatttgaaaggaagattgtaggattgggacactcctaattgaatttttttttctttagtacaaaatggatctgtacatcaaaaggatggattaaacgatgatgattttgaaccttacttgagtccacaggcaaggcccgtgagtagttaactatttacatatctaatcgaagggtgtggtatattctttctccgccttctaccaataaatcccattttctgaggattcatttttttttcttttttctgttttctgtttttttgagactgagtctcgctctgacgcccaggctggggtgtagtggcgcaatttcggctcgctccaacttccgcctctcgggttcaagcgaatctcctgtctcagcctcccgagtaggtgggattacacgtgtgcaccaccgcacacagctagtttttctatttttttagtagagacggggtttcatgttggccgggctggtcttgaactcctcaggtgattcacccgccttggcctcccaaagtgctgggattacaggcgtgagccaccacgcctagccgaggattcactttcttaatacctgtattttttctctgccctctatcaggaaatcccatgttctgagggttcacctccttaatacctattaatgtattataaaacagttaactgcaaatgtcctaggccgttgagattcccatctctgtaatatcagcaaccatactgtattgagaacgtaatactgataacactctactggcagtaacatgtgcatgaataattgtcttcttccttaccaagaatgtagcagtgcagaatttagggattcttacagtgttaaatattctgaattttcaccccagagaactttggattcatatgatagggaaagttctaatgtaaaatcacctgaaggcgggaagatctcttgagcccagaagtttgaagctgcagtgagctatctacgatcatacctgtgaaaagccactgcgctccagccttggtgacagaacaagatctggtctctaaaaaatagtcacctgaacttcattcagtgctgcaggactggctgtctttcttttctctagtttatgggttcttagattatcagaactatttcggagttaggaaatttttttttttttttttttgagacgtagtgtcaactcttgtcacccaggctggagtgcagtggtgcaatctcggctcactgcaacctctgcctaccaggtgattttgcccgcctcagcctcccaagtagctgggaccaccatgcccggctaatttttttaatttttttgtagagatgggggtttcactatgttgcccaatctggtcttgaattcctgagctcaagaggtccgccctcctcgacctctcagaagtgttgggattacaggtgtgagccaccatgcccggctgagtcaggaaatttttgagttgagctgcacctacatctgtggagaatactttatttctcaccgaagggaggtgtaggatttataaaatggagtgaaagttaaaatactgtttagcacaaatgaagatcaataacgttggaggtttttgtggcatagtcttttaaagttgcatgtagattcaaatactaatatgacctgtgcatgtagaaacttgtttgattcagcagttcttttgtattattatctctgattccaaagacagttacactgttgtaactaatttaactccccagattaataggccaaaaggaaaactggcaatatatcttccaaaatgccctgaaaggtcaagaaatttataagttctgaacgtatgctgtatgaaacatagttggtagtcctgaataactgcatgcccatatatggatctgattatcacataaaacttgtagaatccctgtgtaaaattttcaacactgaaagtatagaaaccacttgagcaagtgattggaaaaaagttttcacaaaacacaaccagttaatcaggaaaagtagggaaggaagtagaggaatgaactattaataggttcctgctattgaagtagtttgcttacataatcattataacagggagagttggagcatttagaagcataattctaggtagttcttgtaaaacattgtgtaattcaaattttttagcttgagcatgtgggagcctgccagttcaggtacagacattcaactgtgtcttggcataacctgtgatattaagtgcatttgatttttctttctcaggtaagccaaagcttaaatgtctttgtttaaaaaaaatttggctaataatataaatcttagatgagtagatgaggaagggtaacctgagaatctagttcattgtctagagtaagtcatctactttttagccaatttttcattaccctattttggaataatacttcaagtttaatctgttgattataggctgaatttcttatatatgtggatttgggtctgctaaaatttttaaccttacctttgtgagaaattttaaatgtgaaaagggtatgtgtgaaaagacctcacttttgtttttatgtattatttatttatttatttttgagatagagtctcactctgtcacccaggctgtagtgcagtggtgcgatctcggctcactgcaaccttcacctcctgggttcacaccattctcctgcctcagcctcccgagtagctgggactacaggcgcccgccaccatacctggctaattttttgtatttttgctagagacggggttttaactgtgttagccaggatggtctcgatctcctgacctcgtgatcctcccaccttggcctcccaaattgctgggattacaggtgtgagccaccgcgcccggctatttattttttttgagacggagtcttgctctgttgcccaggctgcagtgcagtggtgcagtccggcttactgcaacctctgtctcctgagttcaagcaattctcccaccttagcctcctgagtagctgggattacaggcaggtgccaccacgcctggctaatttttgtatttttagtagagacgggctttcaccatgttggccgggctggtctccaactcctggcctcaagtgatttgcccgcctcagcctcccaaaatgctggaattacaggcgtgagccactgtgcccggcctgtttttattttatttttttgagacagtctggctctgttgcctgggctagagtgcagtggtgccatctgggctcactgcaacctcggcctcttggattcaagtaattctaccgcctcagcctcctgagtagctgggcctacaagtgtgtgccaccatgcctagctaattttttgtctttttagtagagactgggttttatcatgttggccaggctggtctcgaactgacctcaagtcatccacccctctgtctcccaaagttctgggattacaggcgggagccactgcgcctggccatatttctcattttacatcctccagaaaccactgtgcatttccttttcaggttataactgagtagtgggatctattgatattcccagatagtttgccaagaggctagcactataaactggtagtgaaccttgctttttggtttatgattgaggaacggctgtacagacatttgggctagaacttgaaatttccatttctttttgttattcttgttttattatcacctggtttgtataggaagttgataaaaggattatctcaacactcaggacttaaacagtttgtgaaatgctaagttttctctttacttagttgtagtgctaaagctaaggcccatattcactgtatcagcttaactttaaatgtttaaacatttcagttattacaccaaaatttcttatgatataaaaaatgcccttgtgtttataggaaatcatctgatgtgctgcacactttttttttttttcctggagatggagtttcactcttgttgcccacaggctggagtgcagtggtgcgatctaagctcactgcaacctccgcctcctgggttcaagtgattctcctgcctcaggcctcccaagtagacagggtttcatcgtgttggccaggttggtctcgagctcctgacctcaggtgatccacccgcctccacctcccaaagtgtagggattacaggtgtgagccaccgcgtccggcctgcacactcctttttatagtatatttgaattgcgtgactaggtggggggaggaaatagcctgatgttaattttttgtgttttgatttgcctttttttttcttccacagaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggtaacccacttcttcttattaagatttttagggaaggaggaaccagagagaacagaagaggtattatatagtgaaccgttaataaaaactctgtaaatgaatacagtatcacctaacagttcaaggctttatagaagtataattggttttaatacttgaaccctaatgtgaaggaatgtgagaacattagtagaggacagaaatacggactttgaaaggaaagcaaaaacagtacaaggaaatcagacagaaacagtacatgatgcagaaagaggtgaagaatgagtcaaagagatgcagaggggtaatggaagtgataaaaccatagaaattaaagcagaagattgagtctataatatggcagagaaaaatcgaaatgttctctgttggattaacttggcctagctggggttttgtggttattttcaagagtcaatatgtcatcaccaactcttgaaatcacttctgtcttccctgtgacaattggcggtgtaaaagagtcacttctgatttcctctgtaacaagtgggaatcttgggcagaatgatgaggaatggattcaaactagagttgaatttgaaagagttggtagcgtttgctctgtgagtattgagtgaatgtaaactttaggattataagaggatgataaaactggttggagcagataatgatatattatctgggatttatacttacttttttttggacagggttctctgttgcccaggctggagtgcagtggcatgatgtccgcccactccagcctccaccttctgggctcaagtgatccccccatctcagcttcgtgactagctgggatcacagtcatgcaccaccatgcccggctagtttttcatgttttttgtagagctgggttttgccatgttgcccaggctggtcttgaactcctgagctcaagtgatctgcccctgcctcccaaagtgctgggattacaggtgtgagccactgcagctggcctagacattgttaaatgtaggaagtaggtgaaaagtttatgagcaaggagaaatttttctttgaagatctgtgtattagtggttgagagaatcctgagttgattaatctcaaatataaaataaagtctaacaagcaatgttttccttaaatttgttatgaattcatagggatcttatacgtgatctaggatctgaggcattgttaggctgctctatgagaatttactccttttagcagtggaggaagggctcgttggtacaatcttcttggaggtacatagttgttaaagtagggatggttgctattttatctttcagtgggtacagattaataagaaatgggagttacacttgtcagtgacactaaaagcattgggaatggagaaccagattattgaaaagttggctaataaacttcctttttgatagtcctttaaactcctctcttccccacagtttaatagtttaacttaaagtcttccatattaagcctggcgtcatggctcacgcctataatcccagcactttgggaggctgaggtgggcagatcacctgaggtcaggaccagcttgaccaacatggagaaaccccgtttctattaaaagtacaaaattagccgggtgtggtggcacatgcctgtaatctcagctacttgggaggctgaggtaggagaatcacttgaaccccgaaggcagaggttgcggtgagccgagatcgtgctctagcctgggcaacaagagctaaactcccatctccccccgccccccccccccaaaaaaaaactaacatattttggcctggcgtggtggctcacacctgtaatcccaacactttgggaggacgaggcaggaggattgcctgggcctaggagtttaagaccagcctgggcaatgtagtgagaccccatctctctaaaaaagaaaaaattagctgggcatggtggcacacacctgttgtcctagctactttggaggctgaggaaggaggatcccttgagtccaggagttagaggttgtagtgagccatgattgcatcactgcactccagcaggggcaacagagtgagactctgtatcaaaaataaataaaatttacagtattttgtagaaaaagatagtttattggtgctttttgctagacatctgaagggctctaaatggtcatcaggcttctgtttctagagggacaagtaaggaggccatgatcttttaggcatcttttagtagcatagcagatttatagacgtctgaggggcatctaggtgcttggtttgtccacttgaaatgtgtactatcttattaatctttataataaaattctgtcctacatcttgtgattaaaagcaggaaggaaatgatgaatttaatgcacagcatagttgttaagatagacttgtatgtgttagggccagtggggaaatacagggtgattttcttttcaattttgcattgctggggccagatgaagaaatatgggtttagaaatggagtagcaggctgggcgcaggtggctcatgcttgtaatcccagcacattggtaggcagaggcgggccgatcacttgaggtcagcagtttgaagccagcagtttgaggccagcatggtgaaatcccgtctctactaaaaatactacaaaaaaaaaaaaaaaaattagctgggtgtggttgtgggtacctgtgatcccaactacttgggaggctgaggcaggataatttcttggacccgggaggcaggggttgcagtgagctgagatcctgccactgcactccagcctgggcgatagagagagactctgtctaaacaaacaagtagcaaatttaggttttgttaatttagcttttggccaggctctggctcacgcctgtaatcccagcactttgggaggccgaggtgggcggatcacctgaggtcaggagtttgagaccagcctgatcaacatggagaaaccctgtctctactaaaaaatacaaaattagctgggcgtgatggtgcatgcctgtaatcccagctacttgggaggctgaggcaggagaatcgcttacacctgggaggcggaggttgcagtgagctgagatggtgccattgcactccagcctaggcaacaagagtgaaactctgtctcaaaaaaaaaattcagcttttaatcaagtatgtattttgattatgtttgctagagtggttcagttaatgataattgaacttgatatgtaggtgtaagattcgtttgttggaattgaccagccttttaatgttttcatagaatgagtgcaatagtaaacagaatttagcgtctttggtaagctaactaatggctctttttaaaaaccattgcccagcgcggtggctcatgcctgtaatcccagcactttgggaggccgaggcgagcagatcacgatgtcaggagttcgagaccagcctggtcaacatggtgaaaccctgtgtctactaaaaatacaaaaattagctgggcatggtggcaggtgcctgtaatcccagctactacttgcagtgggctgagattgagccattgcaatccagcctggtgaaagagcaaaacttgtctaaaaaaaaaaaaaaaccattccataaagacttttttttttttttttgagagacgaatctcactctgtcgcccaggctggagtgcaggggtttcactgtgttagccaggatggtcttgatctcctgactttgtgatcctcccgcctctccctccgaaagtgctgggattacaggcgtgagccaccacgcccagcccataaagactcttgataagtgagtatcctagttctcagccggtgagcaaaccaccaaataaaggcttcaattatacttctgtcaggttactttttagtttactctcttgtaagaactgctggcactggccgggcgcggtggctcacgcctgtaagcacagcactttgggaggctgaggcgggcagatcacaaggtcaggagatcaagaccatcctggctaacatggtgaaaccccgtctctattaaataaactacaaaaaattagctgggtgtgatggtgggctcctgtagtcccagctactcgggaggctgaggcaggagaatggcgtgaacccagggggcggagcttgcagtgagccaagatggcgccactggactccagcctgggcgacagagcgagactccatctcaaaaaaaaaaaaccaaaaaaaagaactgctgggatttcaggaagatgcctatgattgcttctaagcccagttaccattttagttagtactgccttactctcctgttggttactattttccttaacatctttacataactgattgtaaactgttcttacaatctttattaggctttaaagaacaagcaggttttatgagaatggggctcatagctcattgagatggtagactcccttaggtgaagtgtttgtgtgtgtacctttgtagtatttacgagattgcagaagctttcatgccagatgggtggtaaccccataaagaagtagggaagtacttaaacttcatcctgaaggtgtcacagctgttttaaagttccatgattgggcagtatcttggcagaacacactgaagcagagccacagccatttttgcctagcattattactgacttgttctgcatgatctaattaacatagaaccttcaagcattagatctgtcaggcttgaaacttagagcaaattttagtgacatgtttgatagatgtgacttacttttatttttttaaaaagcaatatactgtgctttaggtgtggtttaccttgttgaatactgcagatactattgtgtgacctttctgcgtttatttagaacttttccccagttaagtattccctatgacatcacttttgttggcttcatagtattgtcagacttactataatttaccaatccctaattgttgaatatgtcaacaatttgtattttattttttctaattaaaataacactacactgaacatccttttgtataaatatttacatctgtcctttagtagttaaatgtgtcaaaggtatatggttttttaaaattagtatttaaccacaaactcagaaattcttactaaaggggtatgtgctttgtggtcttggctaatttctgtatatattgctacataaacctttttcctttttcctgaaaagttttgttgagggaatcattgtgcaactgttatctagaagaaggcaacagttaagagcctttctttcttcctttttttttttttttttttttttgatacgggagtctcagtctcgctctgtcgtccaggcgggagtgcagtggcgcattctcggcccactgcaagctccgcctcccgggttcacgccattctcctgcctcagcctctcgcgtagctgggactacaggcgtccggctaatttttttgtatttttagtagagacgggttttcaccgtgttagccaggatggtctcgatctcctgacctcatgatctgcccgccccggcctcccaaagtgctgggattacaggcgtgagccaccaccacacccagccgtgtttctcttttgactcaactttggaatagtctgggagaaaggagagttaactttcctgaatgagtgaattttttaaaagaaatttcataaaataattggtttaatttttgtcttgtttctagccctttaactacaagtaaaaatgagggaagtagtcaagaataagggaagcagtcaagtagagaggacaaaggactaattcttttaagtccagcatcttgttagattcaatgaatgatggagccgtgggagacaaaaattaatgaaatagaaaaaaaaggtagacttaattgggtacttgggtaaatgatttttctgaataactgcagagcaaatggagagtgaggagagagttgagttacagaggaagtgtgattgtggtggcaacagtttgagttttagtctaaaaaaaagtcattggtattaaatgggaccagtaggattttttgacttttcactgtatacccttttgtgctattgaaatttttgaaaaaaaaggttgtttttttttttttttttttttgagatggagtttcacttttgtcacccaggctggagtgcaatggcgtgatctcggctcactgcaacctctgcctcccaggttcaagcgattctcctgcctcagcctcccaagtagctgggagtacaggcagctaccaccatgcccggctaatttttgtatttttagtagagacagggtttcaccatgttgggcaggctggtcttgaacccttgactttgtgatccgcctggcttggcctcccaaagtgctgggtttacaggcatgagccaccatgcccagcccaaatttttttaagactagattcttcatgtcaaaagacaaagctagaacgaatggatagaggttatatggagaaatatttttgtagatggaaaacttgctaaaaacgaagttcttagtcacagaatttcaagaaactaaaagagatgttatagaaactaaactagggatgttgtagagggggttcatacatagggtagtctggactagagaaaccaagggataaaagaggattagctgactcaggataacatttcaggtttgtgaagatgaatttgtcctttgaaacagatctttttagaaaggttgtttcataatttctgaccgaagtatttgttacacgtaaaataagtaagaacggactgaggccagaaagctgtggatgacagaagggattggtgcattctcagtgaattttgatacaaattaagtatgtgggtagtttttaaatacatttactatatatatatattaatgaaaaattgtttcctaaactgtgaaaaggcttattaaagaaatttagaggctggatgcggtgactcatgcctgtaattccagcattttgggaggctgagatgagcacatcacttgagcctaggagttcaagaccatcctgggcaacatggtgaaaccctgtctctacaacaaataaaaaaattagccaggcgtggtggctcgtgcctgtaataccagctagttaggaggctgaggtataagaatcgcttgaacttgggagatggaggttgctgtgagctgagattgtgccactgcattccagcctttgtgacagagcgagactgtctcaaaaaaaaaaaaaaaaaaaaggctgggcgtggtggtgcacgctagtaatcccagctactcaggaggctgaggcaggagaatctcttgaacccaggaggtggaggttgcagtgagcagagattttaccactgcactccagcctgggtgacagagcgagactgtctcaaaaaaaattcaagtttctgtgatataaaagaggaaaacatcctcacttgagctaaatatattaaatccttaggaagtaaataaccatgtgatactgttggctcccatttagtatcttaccaccccaccactgttttattgactcttcagatctagtgagtgggcatcctgttttaaaccaggatgacaaacatgagcattttttgtaaaatcctaaggccatctatgtctatttttgtcttgcagataaatatacttgtttatctgccaaaagggttaaggaaattttatttgtattactcatcaccttccttgctttgtgaatagataaaacgcctctttctgcagcctccttaaaggaggactagaagagaatagataacattgaatttgtatctctgaaccatgccccttgtatctatctttcaacaaacgtttgtgttaattgctgggatggaacagagaaacaaggcaccatctttgccttagaagcagagggttttaggaggacagcaaaatggataaaatatgggataagagctgtaatagaggaatgaatacatttttggcattctggagaagtgattaattacttgggggaaattaagaattcatggaggcaataacattggaaccctgccaaataagtaataatagaatgataagcactcaaatggcagcacagtgcttggcacatagtacacacagaagcttagctatcttatctaacactgtaattctcatatttcagataaaggaagaggctcagaggttatttatccaaagtctcatagctagtaagtgttggagttggtctttaacagaagtctctccagcgatgtgttggagctggctagttggagccagctgtttagctttcaagaatacctttctgtacattaaattacattataattaccatcgtattaggtaatattcaaattccttactcttgaggttatttacagctgttgtatcaatatataatatgctgttgcacactgataacacattggtaatctgaaatcagctgtggtgtttttgttgttgttgttgtttttgagacggagtctcacttgttgcccaggctggagtgcagtgcagtggcatgatctcaactcactgtgtcctccacctcccgggttcagggctgcctcagcctcccaagtagctgggactacaggtgcttgccaccactcccggctaatttttgtatttttagtagaagcgaggtttcaccatattggtcaggctggtctcgaacccctgaccttgtgatctgcctgcctcggcctcccaaagtgctgggattacaggtgtgagccaccatgcctggcccagctgttagttacatcgtggaaattgacaaatgctgtatataaatcaatgtttaatttttgctgattgtctagacttcatagtgatggagaaaatattgattgcagattaaatttgtgtgtcacgactgtagctcttaaacattttttttcaataacacaaaaatttgtcctgcacagtggctcacacctgtaatcccaacactttgggaggctgaggtgggaggattgcctgagctcaggagtttgagaccagcctgggcagcatagcgagaccttgtctctacaaaaaatttaaaaaaaattaaccagacttggtggcgcataactaaagtatagctactcaggaggctgaggcaggaggattgcttgagtccaggaaatgaaagctgcaatgagctgtgatcatgccactgcaccccagcctgggtgacagcaggagactgtccctagaaaaaaaaatttttttgaggaaatattctaatatttgaaaaactattacccagtttagcaaagaagttgctcaaaacatgtttcatgtttgtatattggaacttacacctggagagccactgagtctctaaccccgaagctcatggactactccatgatctatgaagtttgccagatagaaaagtagagaaatggctaggtgcagtggctcatgcccgtaatcctcgcactttggggaggctgcagcaagagaatcacttgaacccaggagtttgagaccagcctaggcaacataatgaaatcctgcctctccaaaaaaaaaaaaaaaaaaaaaaaaaaaaaaaaaaaaaaaatcagccaggtgtgatgaggcacacctgtagtcctagttgctcaggaggctgagacaggaggattgcttgagcccgggacgtcaagtctgcagtgagtcatgatggtaccactgtactccagtctgggcacagtgagaccctgtcttccaaaaaatggcattctagtaagagcatgttaaaaacatagtcttgagaatgcttatggtatgttttcagaatgagaagtttaatgtggtctagaatggtaagtgataacgctggagagattggttgggcaagtatatgaagagtttcaggattttattctttttttttttttttttctgagacaaaaatctcgctttgtcccccaggctggagtgcaatggcgcgatcttggctcgctgcagcctccccctcccaggttcaagcgattctcctgcctcagcctcccgagtagctgggattacaggtgcctgtcaccacgcccagctaatttttgtatttttagtggtgacagggtttcatcatgttggctaggctggtctcaaactcctgacctcaggtgatctgcctgccttggcctcccaaagtgctgggatcacaggtgtgagccactgcgctcggcctaggattttattctttacctgtgttttagtttggttgtaagggagggtagttaattagggaataacagtttggaggatgggaaggatgaaacacttactgagcattgaccttgttaagcaccatgctaggtactttcatagccttactttaatccccataccaacctgggaggcagtatcctgtatttatagatcaacaaatggaagcttaggaaagcaacttatcaaaacatctatgaggctgggtgagttggctcacgcctctaattccagcactttgggaggccaaggttggcaggtcatttgaggccatgagtttgataccagcctggccaacatggcgaaacactgtctctactaaaaatacaaaaaaattagccgggcgtggtgacgggcgcctgtagtcccagctactcaggaggctgaggcaggagaatggtgtgaacactggaggcggagtttgcagtgagctgagatagcgctactgcactccagcctgggcgaaagagcgagactgtgtctcaaaaaaaaaattggccgggcgcggtggctcatgcctgtaatcccagcactttgggaggctgaggtgggtagttcgcaaggtcaggagttcaagaccagcctggcaacatggtgaaaccccatctctactaaaaaattagctgggcgtggtggtgggtgcctgtattcagggggctggggcaggagaatcacttgaaaccagaaggcggcagttgcagtgagccgagattgctccactgcactccagcctgggcaatgagagcaaaacttcgtctcaaacaaacaaaaaaattagccaagagtggtggtgtgtgcctatagtcctatagtcccagctactcagggagctgagggatgagaatcacttgaacctgggaggcagaggttacagtgagccgagatcgcaacactgcattccagcctgggtgacagctcaaaaaaaaaaaaaaaaaaaaaggggtgggagatggctcagagactaaacgagatgcttttacagtattctggggaaaaaaagatgatgagggcctgaaccaggacagtgggaacgggaaactggatatgaagaatgtggtagacatatttgttgactagtttttcaaaaattaaagatgatgagaggagcagcagtttagggttaggatttggggttgtattggcttttggaaatagtttcaggtgcctgtgatagtagcagcagccaggtgatagtaggcagctgggaatctggagctcagattgttgacaggaatttgaattttcaaccctcaggataggtaaaggcatggaagagtttgacttttcaaagattcttgtaataagaatggctaacagttattgaatgctctgtacagtgtctagcatacagttgtcttgaatatatatttaaatgtatgttcatttaattcttgtatccttgtgaggtaggtataagtagctcagttttactgatgaaaacattaaaacacagaaaagagtaaataactttgcaaaggcacatgagatacgaaagtaaagctggtgttctaattctgcagcgtggttctagagccaacacgagtgagagaaaaggactatggaaaaagttccccagaaataacaaaatttgaagaataaagagggagcaagtgaaagagattgagagagaatagtttgagtttcagaaagagaacaaggaaggggctattcaggttgagtattcctaatttgaaaatctgaaatgccccaaagtctgaaactgagtgcacacatgacactgaagaaaatgttcattggagcatttcctattttggattttcagattagggttgctcaaccagtatgtatctacaaatattcaaaaaatctgaaatccaaaacatttcttaccccaagaatttcagataggggatacacagcctgtatggaacttcaagcagtatggtagagtacacttaactcagaggctgcagagaggtaacagatgactgcagatgccagtgatgtctgttgaataaaaagttgctttgctattagagacttgaaagttttgatctccgtacttcattcaaaagactctgcatgtttctttatctttgtgtttgcagagtcggtatctttcaacctctgttccaagccttaaagagctattataaagctcttttgtttgcctagtatgggctgttttggtgaaatagactatgtaaaaatgtctgaaatacagagttgaatatgaagaatggcagcattttgattttgatgtggctaaagattgatccagggaggactgctatttttccatgcttaaacatttgtgggacaagggctagttggcaatgctagaatcgtttagtatatcttgaatagtttaaaccaagaatcactcaagtatgagccattctgcttacctaccagaagtaaagattactcctctaacagtttttagcattggaattctttttttccctgcaaacaaaacttttcttggaacctcatgaatgatttttacatgttcagcttcccttctcccagaagatacctgaagcatctctcctatgaagcataatttgaaacacactagatgacagtgaatttttaaaaatgggaatgatgcatggaagatgaggtagagggatctgttttgatatgggagaagtatgaggattcagcaagttcagcatctcttctaaaggtgttgggtgatttagtctgggcgcaggtttggagggatgaggaagagttacccaggagggagatagggaaggcttacagcattggctttgcctgcctgcctgcctgcctgcctttaagggacagcatgatgaaggactgttcttatagttccttaggagtttatgcagaggagaaaaaaaagctctgttctttgaattagggcaaacgttctcttcctgcttttttacattcatcattgaaatcctgtaagtctgcacaatgagcaaggaaaaagtggcagctcagatcgttgcttctttctcctacacaaagcaggtaacagtttaaatatgcatgctgctgccacctcctggaccaaattctagttccagtgggcccaattagtagtaccctaatgcttttcattccttgcggaataaacaaatagtccctcgttgaactgatttaactccagttagccattgggaaaagatatcaaggaattacgatgtatcaaatgaaacattctagggcagcatatattaaagtactaattgacagtgtgagaccaagtatagaaaaatagcaaaatcagttagagctagagttaccaagaaacttttatggaagacttaatttgaattgggtctaaaaggatgggtaggaaaagacagaaagatgaagaaaatggccaatcccctgtgtgaactgttggatatagagtgggaagggacaggggctggcagttgttctactttccaactcatttgcacttggtattgcaatttctgttggttctcaagagatgttcagtgtgcctactgcttatgtcagaattccgattttgcctatatcacttggtgtactacatgaagccattttaagaagatagacttaaaagctcttcatgtgagttttttttgagtaatgtggatagcatatagaacttaagcgtttgcatgtaaaaatcttgcaatgtgcaaactataaatatttgcaagttttgcatttgtttttattataaaatgtaaccaaattataaaaagcgtagaaaacaaaagaaatcacctgtaattcctgtactacaacaaaactactcatcttggcattttttcttttctttacctatgtaatttatacagttataatcatcttgtatatagtgttcatttcatcctctttttcttagtgctttaggtataatatttacccatatttaggcatttgctggatatctataaggcgcttgtcatatatcctcaatctcttgtaataatcctgtaaaagagtgaagattatcttcatcttccaagtagagacctgagattgaataaggaaaaactagatcactacctaggaagtagaactgggatttgttttgccccaaggctctttttgtttttaggccatgctatatcttcatacttatttaaaattgctaactggccgggtgtggtggtttacacctgtaaaccacctaggatcacttgaacctagaagttggagaccagcatgggcaagcaataataaaaagaaattagccaggtgtggtggcgtgcacctgtggtcctagctacctgggaggctgaggtggaaggatcccctgagcccaggaagttgaggctgcagtgaactaggatcatattactgcaccctagtgtgggcaacagagtgagaccctgtctccaaaaaactaataataataaaattgctaactgtgttttagtatctgctgatgcctgtagtcagtcccctttgtggacatataaagagaacataattagttggaacgtaagtatgtaagcactcagttttaattttcccatcacaagtctcaaaatggaatgaattagatctactctacatgacctccatgaccatttgctgaaggttgtaaaagttgctgctaattacaggcagcaggaataaggaagagtgtaaacagttctggataatgcacagcgacaggttatcataagtaggaccgttttagtctaccccactgtcatgttatacatgaactgcagggttacctcactttggtggcagagctagaattagaacctagacaagttcttggctaattcaaagttttagttatggcaaaagttactttagttgaggtcggtgggcctgcacagtggtgaggagaggggaagtacggtggacctggacgtgagagcttcagtatataaatgccaaaaaatggtaactgatttaaaacaacttttgagtcaccttgaaagtttaaaaaatacattgataacctaggttctacttacagacttaactgaattagaaattttatttaataagctccctaggtatttcttgtaggattagaaatgattgaagagaagtttttcagttagtacaaaaagtaccctctgagagttcttactttgagattcttgttctcccttacctactgaatgagcatctttggaggtgaggccttggaatctgcattttatcagctctacaagtgattctcctgtattttaaatttgggtgtataaagttgatattggtagagcatgaattatggattttgtggtcttgataataaatatataggtactggaaagacctggagctctggaggaagagttggtttcatatctgccgctgtcaccaatattgaagatggaaaatcctctgagcctaaatatctttaaaacttagggaacatacctaattgggttaataggaagatttagatatacaatcatgcatcccttagcgatggggatatgttctgagaaatgcattgtcaggtgattttgtcctgcaaacatagtgtacttacacaaacctagatggtagagcctactacacaacttaggctatatggtataatctgttgttcctaggataccaacctgtacagcatgttaccgtactgaatagtataggcacttgtaatgcaatgataagtatttgtgtatctaaacacagaaaatgtacattaaaacacagtataaaagataaggggactgggtacggtggtgcacgcctgtaatcccagcactttgggaggctgaggcgggtggattacgtgaggccaggagttggagactggcctgaccaacatggtgaaaccccatctctactaaaaatacaaaacctagccgggcgtggtggtgcacacctgtaatcccagctactggggaggctgagacacgagaattgcttgaacccgggaggcggaggttgcagtgagctgagattgagccactgtgctccagcgtgggcaacagagcgagactcttgtctttaaaaaaagaaaaacaaaaacttacatttttaacatctttttaaaaactatggcaaacacattagcctagacctacacaggctcaggatcatcagtatcagtgtcttaaccaccacatcttgttcgattggaaagtcttcagaagcagtaacacacagctgtcatctcctaaaatagtaccttcttctggaatacctcctgaaggacctatcagaggcagttttacaattagcctttcttttaataagtagtacattctaaaataatgattaaaagtatagtatagtaaatatataagccaataacatagtaggttgtgtgtgtgtgtgtgtgtgtgtgtgtgtgtgtgtgtgtgtgtgacggagtcttgctgtgtcgcccaggctggagtgcagtggcgctatcttggctcactgcaagctccacgtcccaggttcacaccattctcctgccttagcctccagagtagctgggactacaggcgcccgccaccaaacctggctaatttcttgtatttttagtagagacggggtttcaccgtgttagccaggatggtctgaaatctcctgactttgtgatccacctgcctcggcctcccatggattacagtcgtgagccaccacacctggctttttttttgagacagaatctcactctgttgcccgggctggagtacagtggtgtgattttggctgcttactgcagcctccacctcccaggttcaaacgattctcctccctcagcctcccaagtagctgggactacagccgcgtgccactacacccagctgattttgtatttatggtagagacagggtttcaccatgttggccatgctggtctcaaactcctgatctcaggtgatccgcctgcctctgcctcccaaagtgctggaattacaggtgtgaaccactgcgcctggccgaatttgttattaagtattatttattatacataattttacgtgctatagttttatacgacttgcagtgcggtaggtttgtttacaccgcattaccacaaacaagtgagtaatgttttgtgctacatccttacagtggcttcgacatcgctaggtgataggaatttgtcagctccattataatcttactgatctgtcattgactgaaatgtcattatatcgtgcatgagtgtgtgtgtgtgtgtgtgtgtgtatttttttttttttttttttttgagagaaggcctcactttgtcacccaggctggagtgtagtggcctgatcacaactcattgcagctttgacctcctgggcttaagcatactttttcttgcagccttctaagtagctgggaccacacaggtgttcgccactatgcctggctaattaaaaaaactttttggagagataaggtttcactgtgttgcccaggctgttcttgaattcctgggcttaagtgatcctcctcctttggcctctcaaattgttaggattccaggtgtgagccaccatgcctggcctaatgtttaaaaatttctggctggtgcggtggcccatgcctgtaatcccagcacataacggaggccaaggcaggtggatcacctgaggttgggagttcgagaccatcctgaccaacatggagaaaccccgtctctactaaaaatacaaaattagctgggcatggtggcgcacgcatgtaatcccagctactcaggaggctgaggcagaagaatcgcttgaacccgggaagtggaggttgcggtgagccgagattgcgccattgcattccaggcaacaagagcgaaactctgtctcaaattctagtagagtcaggttctcagtatgttgcccaggctggtctcaaactgctggtcccagcctcccaaagtgctgggcttgtaggcaggaggtaccatggccaaaatagatatttttaataaaatattatagccttgctttaaattggagaactgatgaaaaatactttgtctctttatctgggggaagttagcatcttaattatatatgacttgatgtttcatatatatatgacttgaagtctaaagtcaagtcattagacttatttaacttattcacggcattggagactataaaggttgattctattaaaccatatcaagcaatggaagtaatttttgtgtcatcacatcacttttaaaaacacattttcctagccgggcgtggtggctcacgcttgtaatcccagcactttgggaggctgaggcgggcggatcacgaggtcaggagatcgagaccatcctggctaacacggtgaaaccccgtctctactaaaaatacaaaaaattagccgggcatggtggcgggcacctgtagtcccagctactcgggaggctgaggcaggagaatggcatgaacccgggaggtggagcttgcagtgagtggagattgtgccacggcactccagtctgggcaacagagcgagactctgtctcaaagaattttagaatgagactccgtctcaaagaatgactcccgtctaagcattttatattgtcagctggggtgctgaactttgggtttctttcaaggttcatgggggcataggaaaaactagttgagagctatatagatttaattttgtgggagagataaacatttaccagattttaatgttaataaaattatatccaggtgaatatgaatatgcctcagttgtgttttatggcccacttgaaagtgaagggagagggagggatagaacagtgcagtagtaagtagaaaggttattaagcttaaatagagggaagctaaataggcagatttactgtttttgaatattatatgaagagattgcatatgtgcagactttaacattgccaccttatggctttttgtatatttcctccagagactgaattttctattttattttattttatttttaatttttatttttgagacagaatctagctctgttggctaggctggagtgcagtggcgcgatcttggctcacccgggttcaagtgattgattctcctgcctcagcctcctgaatagctgggactacaggcatgtgccaccacgcttggctaatttttgtatttttagtagagatggggtttcacaatgttggccagccctgtcttgagctactgacctcaagtgatccacctgcctcggcctcccaaagtgctggcattacaggcatgagccactgcacccagccgagttttctattttgtaatcatagatttaaagtgaggagggcctaaggtggatgggtggatagagatgtcgacattatttctagttatttaagccacagaccagatctgtctggacttgtagtttcctaatttattcatagttaatatctttaatgtttttatttgagacagagttttgctcttttgcccaggctggagtgaagtggcgtgaccttggctcgctgcaacctctgccccctgggttcaaacaattctcctgcctcagcctcctgagtagctgggattataggtgcctgacaccagggctggctagttttttatttatttttaatttttattttttattgagatggaatctccctctgttgctcaggctggagtgcagtggtgcgatctcagctcagtgcaacctccaccacccaggttcaagcgattctcctgccttagcctcctgaatagctgggactacaggtgtgtgccaccatgcccaactaattttttgtatttttagcagagatggggtttcaccatgttagccaggatggtctcgatctcctgacctggtgatccgcccacctcagcctcccaaagtgctgggatcacaggcgtaagccactgtgcccagccaattttttttttttttgggattatgggcgtgagccactgagcctggccgacaatttataattgtatatatttatggggtacaaagtaatcttaattttttcaaagaaccaacttttgtttttttttttcctattatatatactttaactcatgccagctcatatctttattattattattattttttaaatttatttattttatttttttttgagacggggtttctctcttgttgccaaggctggagtgcagtggtgtgatctcggctcactgcaacctccatctcccaggttcaagcgattttcctgcctcagccttcctagtagctgggattacaggcatgtgccaccacgcccagctaattttgtatttttagtaagagacgggggtttctccatgttggtcaggctggtctcgaactcccgacctcaggtgatccgcccacctcggcctcccaaagtgctgggattacaggcatgagccactgtgcccggcccaattttttatttttatttatttttatttttatttttttgagacggagttttgctctgtcacccaggctggagtacagtggcgcgatctcagctcactgcatcccctgcctcctggatttaagcagttctctgcctcagcctcccaaatggctgggattacaggcgcccaccaccacgcccggctaattttttttttgttttttttagtagtgggggtttcaccatcttgcccaggctgatcttgaactcctgacctcgtgatccacccacctcggcctctcaaagtgctgggattacaggcgtgagccatcgtgcccggccccaattttttatttttagtagagatggggttttgccatgttggccatgctggtcttgaactcctgacctcgtgatccacccacctcggcctcccaaagtgctgggattacaggcgtgggccatcgtgcctggcctcaattttttatttttagtagagatggggttttgccatgttggccatgctggtctcgaactcctgacctcaggtgatcccaccttcctcggcctcctagagtgctaggattactcgggtgatccaccgtgccaggccttaatgtttttttgttttttgttttttgttttttttttaagatgaggtctcgctatgttctctaggctgaagtgcagtgactattcacagctgtgatcatagttcattacagactcaaattcctgggctcagatgatcctcttgcttcagcctcccaagtagctaggactgaacaaggtgtaaggccctctgttcctggtttaaatttatcttcacctgttacccaggctggagtgcagtggtgcaatctcggctcactgcatcctcctgccttcagcctccccagcagctgggactataggtgtgtgccagcatgctggctaatatttgtattttttttgtagagacggggttttgccaccttgcccaggctggtctcgaactctggccttaagtgatccacctgcctcggcctcaaagtactgagattacagacatgagccaccacacccagcctgtaattatataaacattaaagtgttattaagtgttaaatataacttagtgcacctaacttttttgcagaagaaataaattcatttcttcccttccccccagttttatgttttgaaatacatttttaaaaaaagttttgagagacagggcctctgtcacccaggctgccaggctagaatgtagcggtggcatcatagctcactgtaacctctaactcctgggttcaagctgtcctcccacctcagccttccaagtagctaatccaagtagctaggattacaggcacgcaccaccacacccagctaagttaaatttgttgttgttgttgttgttgtagagacagggtctcactatgttgcccaaggctggtcttgaactcctggcctcaagcacgtcccctgcctcagccttctaaagtgtgagtggcagatgtgagctaccatgctgggccttggaataatttcagatttactcttccacattttgccacatttgctttatcatttgaatgtttttaaaatgtgtatatataatgttttcctgagccagagagttacagtctagacatcatgtcttttctcctaggtattttagtgtgtagttcccaagaacaaagacatgcagttacataaccacagtgcatttatcaaaatcaggaaatttaattgacacaatgttgttacccacagatcttattcagactttatcagttgtcttaatgtccttgatagcaatttttttgtggtccaagttctagtccacgaacatttggagaccgtggtttcatgtctcctaagttgttatttgttgttttcattgttttgagatagggtctcattctgttgcctaggccagagtgcagtggcacgatcatggctcactgctgccttcatctccccgggcttaagtgatttcccaggttgctgggactacaggtgcatgccaccacacccagataattttgtgtgtgtgtatgtgtgtatgtatgtatttgtaatgtaagacaagggctttgccaggttgcccaggctggtcttgaactcctgtgctcaagctatctgccagcttccgcctcccagagtgctgggattacaggagtgagctattgcgcccagccctcctaagtctgtcttcactggtttcaagtctgtcttcactggtttcaagtgaggttgtatccttctcagtgcatcatactgggaggtacaagatgtctgtttatgccattactgataatgttaactttggtcactttgggtaaagtgttgtccaccaggttctccacttaattttttttttaatacgtgggaaaatagttgacactatgtaaataacttgtttctcatcaaactgtctccttttaattctagcattgataattcttgcttgattcaggtattactatgataggtgtttacttaccattaatattacgtaatgctcaagtcacagatttggccagtgggaggtccttcaagaaggagcctactgatgccctggcttcccactctgtttccaatctatacttttccttctctttttttttttttaatgatggggtctcattttgtcacccaggctggagtacagtggtgtgatcagggctcactacagccttgacctcctgtgcttaagccatcctcccagctcaccccccaagtagctgggaccacaggcacatgccaccaccatgcctaattaaaagatttttttttttttttttgtagagacagtgtctccatatgttggccaggctggtcttgaactcctggcctcaagcagtcttatctgccttggcctcccaaagtgttgggattacaggtgtgagccaccacttctggctgttttggtattgttgtgttaaaattgagaaagtttgacttttgaagcaatattgaacataggtatttgtgagacttaaaattgcacattataaagaggaacaaatttggtgtttaaagaatgagacagtgctgtagtaaatataattgcatgatgctgttttgaattttttcttgactattttaaatgctattaagtatgccaactaacttaaatataaacatgtttcttaggaaaaaggacatctatagtctaagtttctaattcagtgttacaatttgggacaaataatttattgtctgtatttctggagttacattaagagataataggtggaatttcattttatttatttttattttatttatttatttatttattttttgagatagagtctcgctttgtcgcccaggctggagtgcagtggcacgatctcggctcactgcaagctccgccttccgggttcacgccattctcctgcctgagcctcctgagtagctgagattacaggtgcctaccaccacgcctggctaattttttgtatttttagtagagatggggtttcaccgtgttagccgggatggtctcgatctcctgacctcgtgatccgcccgcctcggcctcccaaagtgctgggactacaggcgcgtgccaccacgccagctaatttttgtatttttagtagagacggggtttcaccatgttggccaggatgtctcactctcttgacctcatgatccacctgccttggtaaaaatgtaaaatttaaaaaattctgaggccgggcgcggtggctcacgcctctaatcccagcactttgggaggctgagtcgagcagatcacaaggtcaggagttcgagaccagcctggccaacatggtgaaaccccgtctctactaaaaatagaaaaaattagccaggcatggtggcggcgcctgtaatcccagctactcaggaggctgaggcagaatggcttgaacccgggaggccgaggttgcagtgagcgaagatcgcgccattgtactctagcctgggctacagagcgagactctgtctcaaaaagaaaaaaaaattttttttaaaattctgtgcatgaagtaatgtgtgaaatggaagaatttaggataagtttctgaaagactcataaacagtgattcttaagaaaatgagcattgggatttatttcagggaaaacataagtattgtagtcagattaccacctccctagggaaggaggccagatgtgtgggtttgtttttttttttctgtctgtggactaagggctttctatatgtcagcttattaattctccataaccctgtgagatacttaccttcacttttcagaaaaggaaattgaggacttatgagtatgtccaaggccttgggactagtttgggatttgaatttaggtcagtctgactctaacactctagtgtactatgtatgtatgtattctgctttatctgaccagtcatgtatgtttgggttacttccattaggcccatatttttggggggcctgacaactaagtattaatctaaacagtataataggaaagcatgtaatgaattttcaagtcaaaagtaattttgcattaaggtgtttaagtgtttaaaacaaagtaaaagccagtttttctttgtggggaatgttctacttagaataattaattttctaataattctaaataattaaatttctgttgagttattctgtgaagtttttaaattcataaagcatgttcagataatttttaaccatttcaatttttttcttacctctgtaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatc

SEQ ID NO: 38223 - DNA, 166312 bp, Homo sapiens
gggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgaggtgaggggcgcgcggggcgggggccgggcgggccattgtgccgcgggagccgcgacccccgttctcctcggaccccgccttccctctcccggcccggcgcgtctcccctggtctccggtctgttcctcccccctccgccttttgtcccttccaatttctctttctttcttggaaacctccccaacccgtgtggtttgggggtctcgcttcatcgttctctcatttttcctcaaatgctcttctttcacccaggatttcccttcctaaatttaatttgcgcctggctccctcccccaagcctttgcaagcgaaacccgggagatggggaggggttcgagaatcgaagcgtgcgtgttgctgggaaacaggtattttttcgtatatatgtaaaaatttcatgcacttttgcctccgaactctcgtgtttaattaaaaaaggaagaaaagtttgaaaggtctgaaatctctgcgggtaataaagtgcctctggtaggggtaggtgaaggagctgtgaaaggtgaaatttcacgatggtgggggaagggaaagaattgattaggttcacgtggtgggggcagtaaaagactgggataagtaagttggtaggggtgtgtaagcgggggcggggaagggatctgtttggaaaagccttttctcccctttctctgtagcagcctgtgttgcattgcagcagctgctttttccctttgctctgtactcaataaaacaggagctaaattatttttgcggccccgaagaattgaatgtactgtcgtaaaatatttttttaattgatacgatgaaacatatggtatgatatttttctttattgtttctcaaattgtgtaggagaataaaccgtgatgtggtgtgtcattcattggagattttttttccagcctttcctaaacctgttctgtgtccataaccttctcttttcggattggtgcaagacttcgtgtgaaatgggacttggtagactgaaggctgatccattctgcgttatcatccttaaaggccttccttttgggttaaacaattgtggataaagtaaattactccatttctctctcctggaagagatagtcttacagttcatttggatttgaatctcctttgtgttaaagattaatggccaaccgttgctaagacctttataatgtaatacaatgagatttgaatgatataatctacaaattccttcgctttggcaagaaaatgtcatgtcattggaattctttctcaatttcggtagtttccattttaaactttgcttttcattttttttttctatcaaggttaaacgtgtttccattttgcttttatatatatattgtgatatatctttgttgaatttttacttaggcttactgtgaatttgaatttttttttctgattccaagttacctgtatttatgatggccttaaagagtgagtttaatgtggtgtctctaggcgactgaccccttttcccttgatgatttcacacaagttattttcaaatataagcgatgagtttaaatagtaattatagcatacgaaccaaaaaacacaatctttgtaaaatatggcttgaaaactttgagtcgtatgtttgagcatgacttctttttttttaaatcaagttactgatgtccttaaactcaggaactataatatacatactgttatatcttgtaatattatatgttgttggtttctgttttagagatctaatgccgtagggatcttgcagaccagaagttatcagttgtttcaaactttgggtaaacttatcttaacattgagaaatataaaacagggaaagttttttttttttttttttttttttttttttaaatgcagtcttgctctcttgcccaggctggagtgcagtggcgcggtctcggctcactgcaacctccgcctcctgggttcaagcgattctcctgcctcagcctcccaagtagctgggattacaggcgggtatcaccacgcccggctaattttttgtatttttagtagagacggggtttcaccatgttagccaggatggtctccaactccggacctcgtgatccaccagcttcggcctcccaaagtgctgggattacaggcgtgagccacggtgcctggccgaaagtgggttatttttaaataaaaacaggaatagttgtctaattcaaagattgtgaactaaaaaaaagttaccgttttgggtattcagtgaagtttaatcactgtcatgtatagatgtcagtctgtcacaggtaaattatgtcttcacttgaaaattccttttctaataaaaagtaacttctgtttttcaagctcttttcttgctctgttccttatgaagtgtagagagagaggaaccacgctgatgttttccagtaacgtaaatatagaacttggtacacaggtctgaaaagtttatttaagcagtctacagtaattcttcgtaggctaattttgaataagagcaggaaagagggtcagcttttcactttggaaggtactggattatttggcaggtggttaggtagtacttagatttgcttagatacctgtaaaagtgagattggtatgggataaaacgttcttgtgctgcttgcaaaagtctttggaatattctttgggatattttggtgcttaggaagtgcttttcaggttatattaatatatgcttagtcttcatgctttcaagtcctgtgggacgttaatgttagtcttttaagttgagtcctttttggttatattaagaggtagttctgatgtttcaaaggccatccagaaataggaatgcctgaacaggaatttccaattaagtcggtcagaatcctgaacagaggatatgatgaatatattacggtataactattagtggtatctgtcagatgactttaattttaggaatagcatgatcactgtgtataatcttatacagaagagaactgaataatagtttatgttcctgaaacggtcataggcatttgagtaaaatgcagtatatagatttacttgttaatattttgcttaaagatgaatatttaaaaaatgaaaaagcatattacttatacaggacagtggaaaggttgagaccaaaaagctggtacttttagtgtcctgtctgtttagttctattcttatttttcatttatgcaatgtttcaaaagtgtaagatgctttgtgattaaagtgtgcgtgtatgtatgtgaatgcgtttgtatgcatgtacatacagtgtgtgccttttaagtgcatttttaaaattagttggtttgttacttaagatttttttttttttttaactgaaagaggagcttgtctgatctaaaatagttgcatgtagcctggtggctaaggagagctcagaagattttgtatttacattcttggatccgtattaaaatagtccaggcttccactagctactctgactttctcatataaaaaggtatagtagggttatgaggatttgtccaagccatttactagctgggtgaccttgaagtaatcacattatttcactgatgcctttttaaaaaatatgtaaaaatagagataattcttaactgagtagtgaggatcaaatgataatagaaggtactttatacactggtaagccttaaatttatgttactcctcctgtttccaggcctatttctatgttagactatttgggtaaaacttctgggcagtgggctccaccttgcgaccttatttagctcaaggatgtcaaaaagaccacatttttattattttataggtgaggaagctgttcccttcttctgtgtttccttccttagggtctttgaagtatctttatttgtggtaatcataaattttatatacatttcagagtgtggtacaatcaagggtcagaagatccaggttttatatgctgacctgttaattgagtaaactggtaaaaaaaaaaaaaaaaaaggagataatcttatatttcacaggattgttttgtgaagtgtcaagtgagatatccatgaaaggatacaaatagtagtctctttgttcccatgggtcttcatttatactcgtagctgttggatgtgtgactttcccacagaggtttattttaggagcaagagccaaatcttcattttttgaatgtcagtattgtaggaatttactaagtgaataaatcttgaagaagagtgtggattaatagagaaaattcactaaagtttattcagtattcaaggtgttggataccttgttggcccagttggattaagcaaaataactatggaggcaccatttggctggtatagaagaaattacatactgaataggttttggtgatttatcttacagaaggcttaaaacaggtgattgtataacttgtaaaatatctagtctgtatcatgagtgtaagaaagatttgaaaaaatgtgatttcaatttttatatggttgtaggggagtaaaagggtatttaaaccctacttgtgccaacttaaagttgtcttttcctcttttttctcctccttgtttgaaattgatgaatggaattaagtggaagtaaaagttagagaatatgagctgaggctgtacttcagtggatgcttcttcagataagggtttacgaaattttcctgactagaaacaagaaggggactccttgtcagacctgggatatagtccttgacttgcccctaacatgctcccccaacccccttgtcccccactattcctgtgtgttccagtgcactttacatgtttttttgctattgaatttattctgtcttataattatgtggttctttttgtccctcttcattgtaagttccttgaagaggatttttatattcatggtactagcaaaatactagcatttttatattcatggtactagcaaaatacttggcaaatagtgggtggcctgtgtaagtgtttgactttgactgcgttgctcttttatagaatctgttcactagcaaccccatttttggaatacctgtagtgttctagaagctctactggatattgtagggtgtagtgtagtatttggtggatactaaatgttaataacataatttaattaagcaagcaaaaactcacatcctgactccaggaataggtgtagaatttggttttcttttgttcttttttaaattttaatttaatttttattttgtagagatgtggtcttgctatgtggaccaggcaggttttgaactcacctggccagaatttatttcttattctaacacagagcttggaagtggctacaagtgtcaggattgtctaaattctaagccctttggaggataccatgtttacttgactttatgattaaattctgaattactgaaagggccatcaatctgtttttaagtctctttgaccaaagaacttgtaaatattttcaagtaacaagcatatgcatctctattggtttaatttatttttaccccatttagtgcttgctttgttttgattctttttttgtttttgttttttgagatggagtctcactcttgcccaggctggagtgcagtggcatgatctccactcactgcagcttccgcctcctgggttcaagcaattctctagcctcagcctcccgagtagctgagactacaggcgcgtgccaccacgcccagctaattttttgtatttttagtagagatggggtttcaacatgttagccaggatggtcttgatctcctgacctcgtgatgcgcccacctcagcctcccaaagtgctgggattataggcgtgagtcaccgcccccagccctgctttgttttgattcttatcagtgcttcaaataccaatcactgggtagtgtatgatactcttgaagtattagtgtgggctgccataacaaaataccatagactgggtggcttaaacaacagaaaattattttttatttttatttattaatttttttgagacagtctcactgtgtcgcccaggctggattgcagcggctcgatctcaggttactgcaagctctgcctcccgggttcacaccattctcctgcctcagcctcctgagcaggtgggaccacaggcgcctgccaccacgcctggctaatttttttgtattttttagttgagatggggtttcactgtgttagccaggatggtcttgatctcctgacctcgtgggattacaggtgggagccacagcgcccggcctagacatttattttaaggttctggaggctggaagtcagagatcaggttgccagtatggatgggttttggtgagggttctcttcctggcttgcagaagatatccttctctctgtgtcctcacatggtagggtgggtatgggaatcctggggtcggggagatgaggggggatttctctctcctcctcatttcataaggccattaatcctattgaattagggccctgtgcttataacttaatttaacattagttacctcctaaaagccctttttccaaatagagtcacattgagggttagggtattaacatataaattttaggggaacacagttcagtctatagcagaagataactacattttttttttttgtcagtgcatacaactttggaagaaaataatttgtttaatatttaggtgaactttagataagttttgttttaagtaaccagaagttgtttactaaagaagataaattaggggggttgattgatttatacaagatatccgttaaattttctagaaatctctttacactgggaaccttctattttacaatgattaaagtaagttttattaacaggcaacttttccaaagactactttgggtatgaggcaatgtatgtatatctaagtgtagagattgaatggtgtagggtaaagaggacaggctttgaagttaactctgggtttgactctagtttgacatttactaaataatttatttttgagtgggttataaacattttttgggatcgaatatactttgtgaattatagagctgttgagaaaattaaataaaattctggcataacacttggcacacaaaatgagcttgataagagtaaatcccccacttttatgaaagtctgacatctcttaagtttatgttaagaatgtgaaaaaccatgtaagatggtgcagctgctttagaaaacagtttggcagttcctcaaaagttaaacatagagttatcgtatgacccagcaattcctttcctagaaatgaaaacatttgtccacagaaaaacttgtacacaaatgtctatagtatcgttattcataacagccaaaaagcagaaataacccaggtgtgtctgatttcatgaatagatcatcaaaatgtggtatgtccatacaacagaataatatttggccatcaaaaggaatggaattctgatacatgccacagcgtagatggaagcattatgctaagtgaaataagccagacacaaaaggcgatatatgccatgattccatttatatgaaatgcccagaatagacagatctatataataacaccagaagatctcatttgctttttacgtgagttgtttctgacatttttattactttggattaatattttgaattgacatcttcgtgctatttaaagaagagagattgaagatagaaccactggacatttctctgtagggaaacaagcacgtgggaatgctgaggtggaaaccttggtagtggtggctttgaaaggcctgaacaaattttggagctgtatcttcgtgctaaggagacagccagccatctctttggtaggcctgttgtaagtaaggatgactaaagtcaccagtaaaatgtgatgaagcaaatccatcagaatcttcagaaaacttaaatctgggtggtgattttctggggtttgtttacagtagtctcaaataccaaaagttttgtctttggggaatgaggtaatcatgatatttttaaataaactgagcccttttccagtggtaaaggccttatagaacatctggtcttggtaagaatacatctgatgatgtgaaatcaaaatgactacctttaactgtgccttagaggtcctcagtcttctgtcctttttggtatctgttacatttgcaacttggcagcgggggagctttatgaagaaccaagaacttaagtaaaataaaatgaatagctcttgaggtcaaatctcaagggagtccaaattgctccttttacagttcagtgaagggatctttttatgcagtcttaataattattatatactggttatttgaatatctgctttgttctgcagtctttctcctcctcccccaaattctcatgttagactgatattgcaagcaaaattgtgaccgttcagtttttaacaatttaagatttatgtatcttaagttttcatttaaaacttttacttacagtctacttaattgtggtctttgcacaatttttttagaattatttttagaaaaataaatcaattactgttgtccatatgtctggtcagtatttttttaaattacttttttccttccattgtaaagtagtacagattttgaacagattttagaaggtatggaaagtataaaacatttatttatgaaatgttaaatccaagccatctagtattttaatattttaatgtgtagatttctaaactttttgtagtgcatttgcagcattgcagatcattgtgcgtgtgcatatgattatatataaaagtaagattatactatttaaaaatggaattatactatatttgtattgtgtattttgtagcttgtccctttccatatatataatatctatactttttacattttattatttttattttttaaatagggtcttaaactgtcacccaggctggagtgcagtggtgcaatcatagcttactgcagcctcgaactcctgggctcaagcgatcctcccatctcagcctcctgagtagctgagactacagatgtgcgccaccacaccctctaattgttaagatttttgtgcagagacaaggtctcgctatgttgcccaggctggtcttgaactcctggcctcaagtcatcctcccacttcagcctcccaaagcactcggattacaggcatgagctgctgtgtccagccagtaattcttgttcctaactatatagctacataactttaagtgactgcataatattccattgctttggatggatgactttgtctacttaaatcttaaagatggacttttagatttgttccattatttttgttattataaaaaacactgctgtgaacatctttggttatatgtctttgtgtacatatctgatactgttttaggatacattcctagaagtaaaatcaagaagtagtgctgtgttttgtttttttttttattttttgtttctttacctttctgtatccagtctatcattgtcctaccaggtcaccttcacttgcttctgtccatctcactgcctcaagtccaggccactgttatctcttacctgaactattagtgtttcctcatttccattcatgtcccctgttcttcatgcatcactcagaatactcttaaagtggaaatcagatattgttatttcccatgtaaagccttcagcggcatcttagactaaaacccaaatttgtcataaaaccaaaattattaaggtcttgcgtgacctggctctgcattccaagttcccagcacaggcctctgtgagtatgcataagtatttgagtgaataataaacaaaatgactaaagggagttgtatcagtttttgatacacgttaccagataagcaagagtagatgagatttctagttaccccacattctggccagctcaggccattatcggtcttttaatctttgccaatgtgataggtaaaaggtgttacctcattggtttaatttgtatttctttgattacctgtagggtctctttgtttgtttattggacagctttatttttgtgtggatgtctgttcatgtgctttttctgttttcccaatgagatgtgtagtttttcttctaatgatttataataatgaggatattaactcttcatagtgcatatacatatatcgtatccgatattactgctgtttaacaaagcatctcaaagcctagtaaagctgttacccgggctggagtgcagtggtacaatcatagcttactgcaacctcgaactcctgggctcaagtgatcctcccacctcagcttcctgagtagctgagactgcagatgtgctacggattggctgggcagctcttcttacctggactcattcgtgtgttttccttcacttaggttcatctggtgtgtctatcccatccctctgcctcatcgctcacttaacaatagcagcctcctcatgacaacatgccctagtatgaaagctcttaccagacctcagcttgcatcctgtttgcttatgtttctttggccaaaacaagtcatatggtcaagcccaaagtcagtgggggaggtgattacacaaggacagatcaagaggtgcgattcattggtggtcataatgtaaactttactatatgtatcttctttttttttttttttttcctgagatggagtctcactctttctcacccaggctggagtgtgtgcagtcatgcgatttcggctcactgcaacctctgcctcctgggttcaaacagtcctcccatttcagtctcctgagtagctaggattacaggtgtgcgtcaccatgcctggctaatttttttgtatttgttcttatttttatttttgagatggagtcttgctgtgtcccccaggccggagtgcagtggtgcagtcttggctcactgcaacctctgcttcccgggttcaagtgattctcctgcctcagcctcccaagtagctggaattacagatgcacgagaccacgcccaggtaatttttgtatttttagtagagacagggtttcaccatgttggccgggctggtcttgaactcctgacctcaggtgatctgcctgcctcggcctcccaaagtgctgggattacaggtgtgagccacggcgtccagctttttttgtgtttttagtagagatggggtttcatcatgttggccaggctggtctcgaactccggacctcacgtgatctgcccgcctcagcctcctaaagtgctaggattacaaacatgagccaccatgttcagccttgtatcttcggtaatactgagttttccattctttttttcatctgtatattaagatttaaaattttatctttagtgaagtgtgcggcaactcattggttttttttaattaaaaacttttttttttttttttttttagagatggagtcttgctgtgttgctcaagttagtcttcaactcttggccttgagtgatctgtttgccttgacctcccaaagtgctgggattactgaaccacagtgcttggcttagtttctagtttaatgggttcgacatggtacctttaaaaaaacatgtttagaaggaaaatgcataattttttactatatagacatcatataaaagcatatataatatgcttttagctttcttttttatcgttaagtacatttgttctcatttttctttgtcttaattttatttaaaatgtgtgtacttgtatttggccgggcgcggtggctcatgcctgtaatcccagcactttgggaggctgaggcgggtggatcacgaggtcaggatattgagaccatcctggctaacacggtgaaaccctgtctctactaaaaatacaaaaaattagtcaggcgtggtggcgggcgcctgtagtcccagctactcgggaggcggagcttgcagtgagccgagatcgcgccattgcactccagcctgggcaacagaacgagactctgtctcaaaaaaaaaaaaaaaaaaaagtatgtacttgtatttaaaccataaagcttgtgtttttaaaaatgtttttcctttgctaattaacttaatttcagtgttggcatttatattcttcagttttcttagagtttaaaaaaaatgtaatcgctgttattgagtacttactgtatgaaacctttattaactcatttaacactgatagaactgttatctccattttatagatgaggaaattaagccacagagagttaagtgacttgcccagggtcacccagttagtagagagtggaactgggattccatctcaggcagtcaggttccagagcccatggtttttaaccagtaagctctcatacataactgtttgtaatggttaacttttgaactgaagcttatatttgaattttccaaatgttaatgtgtgagtgagtaatttatttttccttgtgatttcattgtttagggggtctttactttctgaaaataattggcgtaagaacaagatcttgtaggatgaattgacctagaacatttcagagataatagtacatagttggggtggggagaaaaggctttatttgggtttaatcttgaaaaatgaaacaaaactatgaaaacattcatgttatggttgcaactatgtgttaaattattagaatgaaagaagaatgaatcaagtgttggttgcttaaaaaattttacataatttttctgagaaaattgtaagatcacatgaaactatccatgttatgatggacttttgcagtatgatcataaagacagtcctttttgccaaaatattcaagggcttcattagttttcctaactttgattttcagattttcttttgacctcctggtaatctcatctttgttagttctccagttattaatttacaatctgttaaaatgctttcagctccaagtaactgtttaagacttaaagtgcttaaatattgagaaaatttatcccatataattagaggtccagaggtaaggtagactccacacatactacagtcagtgggtcactgatgtctttgaggacacgggtacattttgccatctttggtgttcagtcatctttatattggtaacaagtggaccatagggcttccaggattcacattgagacccagtaattcttggaggaagtaggaccatccttcttgtgtgtgtgtgtgtgtgtgtgtgtgtgtgtgtgtgtgtttaatcccgccatagtccattttgtgctgctataacagataccacagactgggtaatttataaaggaaagagatttatgtggttcacagttcggaggctgagaagtccaagatcaaggggttgcatctggtgagggccttcttgctgtctcataacatggtggaaggcatctcagagcaagatggtgtatgctcaaaacagaaaaaaggggttgaattcctgtggtaactaacccactcccatcataatgttattaatcgattgatgggggtggaatgcccatggccgaatcacttcttagtactgttacagttaaatttcaacatgagtttcaagattcaaaccatagcagctctcttaaggtatcatttacatacagctaaatgcataaatcatgtatacatatagcttggtacatttttactatgtatacatacctgtgtagccaccaaccaggtctggatatagaacacacttaggccattaagttccctcatgccccttcccagtcagtatctttccaaatactcatttttttcagttgctttgtaaagagttttcatcattttcagtgacttcataaaggcctacatcttttggaatgtttgcactttcactttgtagatgatatgcattgtgttgctttgtaattgaaataacctgtcaatcattgagagactgacagggcaaaggtgaaatggcctgacatagaggctaatgctgctttgggagggatgtttaatggggactgatattataaatgtttagttcattagcggatatttttgtgttaagaatacttttgcttccctggcaacttctgtgtctgataatgaactttgattttaagacccttgtacctattttgttctgtattacatttttacatatatgtcgttatagattctctaatttattgcattggtctattattcctatgcaatctgttagctgtgagccgttagatctttatgaaatttagatttgatcagctcagccttgagtctgaactacttcagtgccttcccattgctcttggaattaagaccaagctccactaagctcctcctcattatggcctaagtcctgcacaattttactttctcagtgattccaaagtaagtaaaatgacccaataagaaaaatcctcaacaataacttacaaaaaagtaaaaatgtgcataggtatgacccattgccttagacttacagtttagtgggggaggagacattaattttcaagagctggcagagcatagtggctcatgcctataatcccagcagtttgggaggccgaggtgggtggatcagttgagcccaagagttcaagaccagcttaggcaacatggtctatctctacaaaaaatacaaaaaataatattagctgggtgtggtggtgcacacctgtagtcctagctatactcaggagattgaggtaggaggatcacttgagcctggaatgttgaggctgcttttttttcaaggtgtttgcattttggggttagtcaagtttaatagaatcagcattgacttcagagccattctgctatttactggctgtgagaccttgactttcccaaaccttaatttctttttttgcaaaatgggattaataattcattgccttgttttgaaatttgctataatgtagttagagtttttatggattgggcatattctgtttattgttttctttgtattgtaccatgagattaaaacaaaaaataaagttcaagcttctgaatgttgttttgccctttttgcttgcttgctttttcttgttttgagacaaggcctgactgttacacaggctgaaatgcagtggcgcgatcatagctcactgcaacctggaactcctgggctcaagccatccttgcacctcggcttcctaagtagctgggactataggcacctgccatcacacccactgttgccttttttaacttaatatgaaagtttctgttttttaggcactctgaaagcaaatagccagttaaattcttagagtacctgtattttaaaatgatgtttataatttaagatgaatatttaaattaaaaaccagcacccagacatagaatggttatttgcattacttagaactaagttctccccctagatctgtcaccctaccttcccttcataatgtgtggttcccgtgtggtcagccatcctgtctaaactttctcctgaaaaaaaggccatgcacggtggctcacgcctgtaatcccagcactttgggaggctgaggcgggtggatcatttgaggccaggagttctagaccagcctggctaactggtgaaaccccgtctctactaaaaatacaaaaattagctgggcgtgatggcgcatgcctataatcccagctactcgggaggctgaggcatgagaatagttagaacccgggagacagaggttgcagtgagcagagattgcaccacttcactccagcctgggcgacagagtgagaccctgtctcacaaccaagcaacaacaacagaaaacaaaaaaaaaatctactgaagaaaccttcccctgcaccctggagcacacagaagagatgtcttaacttggcattcagggccctcgagaaacagttcagcagtgcctttcaatactccccatgtgaattcacttcagaatggtcgtttattgttttccaaaggtaccagtgaagttgcggtttcattacttttattctgtctgtcttctggaaagctgccttctctgtgctcacctcaatcccattcttgctttagtttcctcttctggtttgtctttagtgattgttccaggctgagtctctctcttttcatagtttttgtcgactagctcttttggtgtgtcatacatacatttttcccttaaaaaaacggagtataaactcatgacacatttctctgaacactttatatcatgctgggttcaatgagacactattaataacttttttgaataaattaaaaaactaaactcatgactattgattgtttttggccttctcattttattctttatttgttgtagagatgagtgtcttgctgtgttgcccaggttggtctcaaattcctggcttctaacgatcctcccacctcagtcttccaaagtgctggaattacggctgtgagccactgcaccctcattttattctttagctaaatcatctgatttttaataaaggtattgggacagtactttaaacaattttatattgtacataggatgttttggtaagtgacaaagtgaaggtgtcatggtataacattttaaccaaaattttcaatatgcacttgaaaatataaagacaagacatcaaatatatttggttttatttttcctgcctggaaatgttatacaaaataagaatcttgtcacccagtcagcagttctgtttccctgtaacatattgactgttagttttttctgagtctgtaaaaagttaactaaaattagaaactaatacagtaagggctttacaaaaactttacataaatttatgcagatcttgggtacacttctgaggtaggcagttaattttttgtgacctccacatctactcttcccctgttttcataaatgctcctatcattattagccagggttctctagagaaacagaaccagtatttgtttatttaaaggaattggcttacatgattatgggagctggtaagtctgaaaattgtaaggccaacaggcaggctggaaactcaggcaagaattgatgttgcatcttgagtctgaaatttgcagagcaagtcagtaagctggaaactcaaaacaggaggatttctgtattacagttttgaggcagaattgctttctctggcttgggtttgctggcagtctttggcattcctgggcttctaggtccatcacttcagtctcatgcttctgcagtcacatggctgtcttttcctgtctgtcttcagttgatgttttcttcctcttataaagacaccagccatattggattaaggggtccactctactctggtgtgacctcatcttaactaattacatctgcaaagaccctgcttgtaaaagaggtcacattgtgatatactgagggttaggacttcaacatcaacttcttgcctgagtttcctctttgagtatggaccacagtggtctcattcatctctctcattagtcagatgaactaattgtctcaggtgacagatacagagggagacatgcatgtacacaataaaaataaatatatgcaaagattccacagtaaagcagctggagctaatgaacgacttcagcaaagttgcagggtacaagatcgtcacacaaaaatcagttatttctatacacctacgataaacaactgaaaaaaattaaaccagtttcaggctaggtgtggtggcttgtgcctataattcccagcaatttgggaggctatgatgggaggatcacttgaggccaggaatttgagaccagcctgggcaacatagactgtttctttaaaaataaattttatataaaaacaatttcacttacagtagcatctaaagaaataaacacctaggaataaatttaaccaaggaagtaaaagacttgtacactgaaactataaaatattgttgaaagaaaagacttcaataaataaaaagactttgtcttcataaatttgatattgacttgataattgttaagatgtgatagttgataagacttgatattgttaaggtgacagtactacttaaattgatatgcagacacaacgtaatccttatcaaaatcccaatggcgttttttgcaaaaataattcatatggaatttcaagggaccccaaatagccaaaataatcttgagaaagaacagagttggaggagacacttcccgatttcaaaacttaactttgcagttacagtaatcaaaacaggtaaaggcatagtaaggcatagtaaggacatacctatagaccagacctacagaccagtgaatagaatagagagcccagtaaaccctcacattcaatagatttttgatgacagtgacaagaactttctcctgagagaagggataatcttttcaaatgacactagggaaatgatattcgcaggtcttttcaaagagagtttagtgtttttttcttaaaacatcagtgcctactttcagagtttctcaacctcaacattattgatgtttggggccagataattccctgttacagggttgtactgtgaattgtgggatgttcagcagtatccctagtttgtacccaccaaataccagtagtacacaccttaacctttctctcccagaagagacaaccagaatgtctctacatactgccagatgtttatgagggctaaaatcactcttggagaacctctttaaattctgtaaaatgtcagcaactactatataagttacacattttaaaaaatatgttcaacatattttaaactcttaaatgctttaagtgagatgaggtggcattcatgccgtttcctacttttattacaaaatgcacatatctgtttggttgcttagactttaatagactagcctagtaccccaaccacaatttataagcagtttcaagaaagaaaatcagtttgtatcctaaaaatcataagctcatttataaattggaactgactaaagaaaaaaaatcagcttttgaattttaacgtaagtgaaatggaaaaaataaaacacttttaaagaagttgaggtacttcattgttaatttattgcaaatacttaaaataaacttatttttaaagattagcttttgagttccaaagacctgatattaaatgtccttactgatccagaggcctcatagctgaatatccaaaacatgcatgccacagggtataagtccttcgccacagaccagagcatctctgaggctaacctttgggtaatgtttgttcacacctggtgcaaattaagtggtctaaccaattatatatgataactttgataaataatattaatagatattatttgttgaatatttaaagataggccaggcaacttcacatggatcatttcatttaatggattcgaataagccatgagattcatgtcgtcattgctgttttacagtgtaggaaaccaaggcttaggatacttaagtgacttggctggagtcatacagtagataaatgacagctgaaattcagatctaagtcctgcgtaactccaaagtccttgctcttaatactttctatagcctcttattttacctttcaatgctgtttctcaaatttcatttttcatccttaagatcacatccaatgctgtctcaagtctcatgttggagtttgtgttggaagcagtaggaaataatggcagttgggctggggtgttaaagactttgagtgacagttggctgggtgcggtggctcacacctgtaatcccagcacttcgggaggcagaggcaggtggatcacgaggtcaggagatcaagaccatcctcgctaacatggtgaaaccccgtctctaataaaaatacaaaaaaaaaaaaaattagccaggtgtggtggcaggtgcctgtagttccagctattcaggaggctgaggcaggagaatggtgtgaacctgggaggtggagcttacagtgagccgagattgcgccactgcacttcagcctgggcactgggcgacagagcaagactccatctcaaaaaaaaaaaaaagactttgagtgacagtttaaggaacagaactaacatgccacatacttcctgtacattatgtcttccagtccgtaagccaccatacagggaacatgtcttcattaatgtcaagcctgcatggttagtaagtagtggcacctagacctgaacccagctttgtctcatttccaagcctatatgcaccttaccctaagtgttttattcaaaataatttgaacttttccactggattaatgacttccagtttgtgagccctggggggcgtctgcgccattcctttaaagaatagttgaacccctaggtatagcaagatttgtctgtaatccaaagatgccagcctttacatgcattatatttcaactatatgtagatgcttttctgataatgtatagattcatttaaaagcttgcaaatataatgtgcttttaaatcacattttttcagtcaacatatacagtattaaaagtagagcaattattcatgaagttaaaaggtcttttcatctttggaaatgttgagaaccactttttttttttttttttgagacggagtctcgctgtgtcacccaggttggagtgccatggcgtgatcttggctctctgcagcctccgcctcctaggttcaagagattctcctgcctcagtctcctgagtagctgagattacaggcgcctgccactatgcccaactaatttttgtattttcagtagagatgggatttctccacttggccaggctggtcttgaattcctgacctcaggtgatctgcccgctttggcctcccaaagtgctgggattacaggtgtgagcccctgcacccagctgagaaccactgttctacatagatgttttctctatttaatctgtttcttaggcggagattggcagccatttaacattctcaaaataaaggaggaaacctctaaacaatgaaagtatttaaagctaccgcaagaataactgcaatcttgttttttgttctctaggtgaagtagaattttgtgaaaaaacaaaaatgttttgtgaattgttactagttacctacaaaggcaatccataaaaatagtacaaacaaattgtgagtaggagaaaaacttaaactgttaagacattatagtcttttcttataaattataatttttagaaaataaactgaagggatcaaatgatgtctttaaaattaggaaacaaaatctgtgggtatgctattacctaggattaaaaaaacaaaacaaaacaaaacaactaactcttgctagatgatgctttcaaaagaaatgtagtccaaaaatgagcactggcactttttgctggtacatggagaaactttgagagtgaaggcatattaatactttcaagttgtaaataggctggaatttgggcttgtgattttatagttttagaatttatatcattagacttttaatattggatattagtttatgccttttttttttttttttttgagagatggtgtcttgctctgtcactcaggctggagtgtagtggtgcgatctcagctcaccgcaacctccgccttccaagttcaagtgattctcttgcctcagcttcccaagtagctgggactacaggcgtgtgccaccacgtccagccaatttttttttttttttatagtagagacagtttcactatatgttggtcaggctggtctcaaactcctgacctcaggtgatccatgcgcctcccaaagtgctgggattacaggcatgagccaaagtccctggcctttgtacagatttgttttgcatacttctcagccttggtggggttaattgtggcttggcaaatcaagaaaaggagttctgtgctgttttcagactgcagaatcttgttgctatgcaacaaaaattgtcagtcagtatagggtatagtaaattggtattctctgtcccttttcaccacatgctcattttgtaatctgagagaagtggtttggggctagtttgcaaggttttattttaaaacaagcatttaaaaaattttgttgctatttgtaattggttatatttaaggtcggtgaagtctttctgtacttactagaagatacaataaaatgctagtgttcaaagggtttatagatctgtttccaagttgtttcaggttagagcagtgtatttttgttttgttgctgtaacaggggtaatattgccaacttccaaagagtaaattttagcttgagaattcaagttgtataatttgaacatcagaagtttattgtaagcacatcatattatttttaaatttatttatgaaaaacatgaacccaaaaaacccttttattgataaagttttttaaataggaaccctaaacttgtatgaagtctcatgtatgataatttattttctgccaggagaaattaaaatgcctttatagcaaatgggtgatggctaatagccttctaaaaattgtgataaaatatatataacacaaaatttacaattttaaccatttcgagtgtttcacatagttgtgcaaatatcaactgttcatctcctggataacaaccttttgcatcccatttagtaacttagtccagactgtcttctaaatcctttaattcgtttaatcttcgtaagaaccctatatgtacgagaagtacttttgttccaaatgagaagagtgaggcacaaaaaggaacacaaaagtagtaattagtggagccggaattcaaacaccaacagtccaactcttctgtgctctcaactattatgctatgttaccctcttttggaattactttcttttttgtttagtggttaagagcattgatttaaaaaaaaaattactttctgtagcttttccaagtaaagttaatacagtttaacagcattttggactgttaacaaatttagtttggctataaatccctgcaatcttctagacattttttttctaaatatttcaaaaggatgcagtttatgttattttatattgtgttatttgtatatgaaattatacatattatggttaattatatagaaaggacttactttcctttttcagtttgtttctggaccatttttcatgccattccttccaatagagaatgcaaatcattttctggtcatttaatgtaaataggaaggtacacttgctgttagagaattttaatatgatgccatccaaagactaaagccagttggcattggatcatccacttagtattctctaaatttatgatcttctttttcacgaataatctggagttaattgtagtattggcagtttagaataaagagcaatagggaggagtaaaaagggagaaaaacattgcaaggagtcattaacttccaattgatgaatagggatgagtttttgcagactctgctttttttctgccatgtaatatctctactaccattcttaagcatccttaaggagcttactttcctttgattttttttccccaccttctacttttttttttttttctgggacagtgtctcactctgttgcccaggctggagtgcagtggcatgatctcggctcactgcaacctccgcttcccagattcaagcaattctcctacctcagcctcccgagtagctgggattacaggtgcactccactaccacctggctgatttttgcatttttagtagaggtggggtttcaccatgttggccaggctggtcacgaattcctgacctcaaatgatccacctgccttggcctcccaaagtgctgggattataggcgtgagccacagcgcccagcctttccctgccttcttttctttcttccgagatggagtcttgctctgtcacccaggctgaagtgcagtggcgtgatctcggctcactgcaacctctgcctcccggattcaagcgattctcctgacccagcttcccaagtagctggtgttacaggcactgtccaccacgcccatctaatttttgtattcttagtagagatggggttttaccatgttggccaggctggtcccgaactcttgacctcgttatctgcccgcctcggcctcccaaagtcctgggattacagttgtaagccactgcgcttggcccatatttctgtcttgctcaaccagacttactctctagtcagtttgcttttcatatctgttcacagttgcaccatcttttttttttttttttgagacggagtttcgctcttgttgcccaggttggagtgcaatgacgcgatctccactcaccacaacctccgcctcccaggttcaagcagttctctgcttcagcctcccgagtagctgggattacaggcatgcaccaccacgcccggctatttttgtatttttagtagagatggggtttttccatgttgaggctggtctcgaactcctgacctcaggtgatctgcccaccttggcctcccaaagtgctgggattccaggcgtgagccactgtgcccggcctagttgcaccatcttttaaaaaaatgttcttcttttatttttgtgcatttatatatgtgtgattatacttgatacattttttgccttgttcatttgatatgttttgcattttctatgttttttaaaaacttagaattttattagttgcatatttcactgtaatttacttacttcctttaaaatggctatttatgtggtttacagggattttgtgtaatgaataatgctttcatgaacccaaaggtttttttcccctcctaattgcagactaattccttaagatggatttccagaaatagtattagatccctgaaggaatagaaacgattttaaaagctcttgaatcttattgccaaaatgctttccaaaagtgttgtaccagttttcatgccagccagcaaatatatggagtgtccatttcacctcagccagcaataggagggaatgttttgatgctgacctttaaatctaagaagaattgatttacagctctgctgagcttctatcctgaattacacccagaattataatcgtggttgagattggattagaaagaaggaaagcctggtttaccagtttctgccccttcagctgcttatattctgttttgcccagttaaggtgaattcttttggaaacatgaagtaactgcccttttctgcttttcagcccccttaattattttgataagttggtgggggacaaaacagtgtatgtttataagttggtaggggacaaaacagtgtatgtttcacatgacatttcccttgagagctggggtaggtttggctctcttctccactccaccactgggcttggtgtgtctggaggcgtctgaaagttacattcagtagccaccttgtccaggggtgctaattagatgtagcctgagtcactgctacttctttagctaggaaatcattaacaactctggaggtaaagtagcttttccctaagaacttgttagataatttagtattaagtatggaaaattttctccctgaatagaaggagggtcaggggacaccattcctactgaaagttgataacagggaggtcttatctggtctcctctggcctcataacagcactcagcacagttgaccattctggcctcgagccactttgcagtgattttaagctcccttggttctctccttatctcattggctgtatcttgttcctttcctcccttttcattttcttctccccatcagtcttcccctcctccacaatgttactccctgggctttacaacctgtgtgctgcttattcctagatttattttttacctggctcttgctcctgagccctagataaataagctggcatcttaattctctttgtataactaataggcactttaaataccacgtgtccaaatcagggtgttgtgatattttcatacaagtttatacttaggtgtttcagtaacatttttcccaaagtttcagacataaaaataacgcagggggctaaattataaataatatcaatttaagacacattgtattaaaactgtctttctcattttgtaaactgtagagcccataatttttcttttgataggccagaagaaagtttacctatttccttcccaatgactgagaacaaaaattctcactagaggattttatttgtgtgtttttctcatatgatatgtacttgtgtcgtgaaataccattcctctttctcagtttagtgtctcatatgtcagctgacaatgatttgaactgtattgcatggtgatacaacttgtccactcagctcattttcactagtatcagtgcctttgtagtgtatttatttgaacgctattgtggttttgcctttataaaaataactagagaatagaagaaaggaaatgttaatgctaacacagttgagataaagatggaagtcacttggttttccaaaagtggtaattctttggtgttgtagtctgttcttgctgctataacacaacatcttagactgggtaatttataaacacaaatttatttctcacagttttggagcctgggaagcccaatattaagttgccaagagattcagtgtttggttgaatgctgctctctgcttcatagatggcgccttgttgctgcattctcacatggtagaaggcacaaaggcaggagggcctagctcttttttaagggcataaatgccattcacgaggttggaggccttgtgacctattcacctcccaaaggccccaccttgcaatatcatcaccttggtgattagtttcaacatagggattttggagagacacatacattcaaactgtagcatttaacctcagtagaacgatacccagtttgtacttaagctgactgtttatcagacaagatttttttgttggcactgatagaaactcaagttagttctcctggtagaggcaaagtgagagttgctggagctagggcagcttgaggacctcaaagatgagaacagagctgaccattttggttaaataggactctttcatatttgcttagctttattttttttccctgcagtctttcttcatggtttttctagattcccattattccagctttcataaatggagagtcaaaggatgtttcctgtaatcttcagggaggaaaatcctgaaaaagactggtaaagtccaacttgcatctttgtcccttcttctttaatgggggatgaggtactgtggtgggcaccaatgggtagaaggaacagagttctaaaatggaagaaggaatgctggcaatggatatctactatgataattcaactaaagaggacaatagcaaaattaagttatatttaaaaaatacaggaggccaggtgtggtggctcatgcctgtaatcccagcactttgggaggccgaggtgggtggatcacctggggtcaggagtttgagaccagtctgaccaacatggtgaaaccctgtctctctaaaaatacaaacaattagccgggcacgttggcacatgcctgtaatcctagctagttgggaggctgagaatcgcttgaacccaggaggtggaggttggggtgagctgagatcatgtcattacactgcagcctgggcaacaagagcgaaattccatctcaaaaaataaacaaaaatacaggaaacgtgttgactgttttagtaatctgttatattgacaggaccatagagtttgtggaggaatgtagcttgcacgacttctttttttaaaaagaagaaaaggcaggagttcaactatgtcttaagatatttcttaaagaaaattggtaagacaacatctcatttcttgcaaagtctctgagcagttttttaaaaattatttttgtctgctaaatattgctttaggtgtgccaagaagactagaatttgagctaagaatttaagaaaattaactttatctgcatttcatatttactttatcttgttttaaatgattgcttataccctagcttttaaaactaaacattcatagcctaaggatttttcatatcttttgactcttggaatgaaaacccattttgaaattaagtctatcgctcagctcttctgctttcacatgcttttcaggaacaggttatgtgtgagaatagggacactggaattccgaacatctgacatccccattgttgaccacagttctccaccatgagctctatctgtcacattaaggggtcagctgtttcacatcccaccaggttaggtgagcacatagtccttagctttcccacttatttggtgatgcagtgatgtagaaaccatgtaagattgtgacctgggaagaatcaaccctgtgacagataacaaaagcagaatcctggggcattttccttttaggggaccttaatctgggcttcttcatccccggtggatagagtccagtgttgagatcacagcatcctttcattgtctaggacaggttgtagctaagattacagacctgcaccaccacacctggggaatttttatttatttttaaaatatttatttatttatttatttatttgttgattgatttagtggcagggtcttactctgtcgcccaggttggaatgcagtggtgcaatctcagctcactgcaacttctgcctcccaggttcaagcgattctccttcctcagcctcccaagtagctggtattacaggcgcctaccaccccacccagctaattcttatagttttagtatagacgcggtttcaccatgttggccaggctggtctcaaacttctgacctcaagtgatctgtctgcctcagcctcccaaaatgctgggattacaggtgtgaggcaccatgcctggccatatttatttttaaaatatttctttgtccttttcttcctctaccagctaatcttaaattttttttttctaaagacagggtcttgctgtgttgcccaggctggtcttgaactcctggccttaagcaattctcctgccttggcctcccaaagtgctggaattatagacatcagccactgtacccaacctatgaagcttttagtatttaaagtttttatgtttttcaagagatttgttgcagccataaaaaagaacaaaatcatgttctttgcagctggaggccgttagcctaagcaaattaatatagaaacaaaaaaccaaataaccgcatgttctcacttataagtaggagctaaacattggttacacacagacacaaagatgggaacaataaacactggggattccaaaagcaggggaggaagtcaagagtgaaaaactacttatcgggtactgactgggcccggtggcttacgcctgtaatcccagcactttgggaggccgatgtaggtggatcacaaggtcaggagagcgagaccatcctggctaacacagtgaaaccacatctctactaaaaatacaagaaaaaaattagccgggcgtggtggcaggcgcctgtaatcccagctactcaggaggctgaggcaggagaatggtgtgaacccaggaggcggagcttgcagtgagccgagattgcaccactgcactccagcctgggcgacagagcaagactccgtctcaaaaaaaaaaaaaaaacccaacaaaaaaacactacttgtcgggtactatgttcacaacttggggggcaggaagcccaaacctcagcatcatgcagtgtacctgtgtaacaaacctgcatacccctgaatctaaaaaaaagaaaaatttgttaatggaagtattatcatatttttgaatatacaagtgaaattatgagtctttgctgataaagacttaatttctttttttcttttctcagtcaccaggttagtactggtgagctcaacaacataaatgagatagcctgtaatctaacagccttagaggaagcatttttaccaatattaagccaaacagaaaaattgggaaatataatttagaaaaacaagggaatgaatttactttgctaattatagacaaaattaaaaccacctttgttttatttttctctaagcctgttttttcagagatctcttaaatccgtagtaagaactctagtgtcttgaaaaattctatctgcctttcttttgcattttagcataatccagaaccttttctgtaataaaaagttcccctacttttaaagccttaacttgcaagtttttctgtttcaagttgagaaggttctgtaaactgggccatggtgggggtgctggagtggaggatttctctttatgtcttatccctgtgcccctcactgcttctagttttttccttttgaaatccatccttcgagttacttcctggtgcaaattactctctgtgatcccctatcccctagctcttataagctgcccttacatgcttaaggcttgtggttatgtcattctgccatagtgctatggtctgaatatgtgtatgctcccaagattcttaggttgaaacctacccccaaggtgatggtattaagagggtaggggctttgagaggtggttaggtcaggggagcttgctccttttgcccttctgccatatgaggacaaatagaaggtgccatccatgaacagcatgccctcaccaaacaccatatctgttggcaatttgatcttggacttccccagcctccagagctgtgagcagtacactcatgtttataaattactcagtctaaggtattttgttgtagcagcaggaacaactaagacacatagcttatcaaatatttaatacaatatataacattttaacagctttaaaaaaatagagatggggtcttgccatattgcccagtctggtctctaactcctgcgctcaaaggatcctcctgcctcagcctcccaaagtgctggattataagcttgagtcacagtgcctggccaacacctttattgaggacatacaataaatgtcacatatttaaggtgtacaatcaagatagcaaacatatccatcactcctaatatataaacatatgaacacaaatttgaagggacatcaccccataagcctaacactcaatatgtataataaccttcagtgttctttttcaatgaacataaccatggacacttttccatgttgttacatggtcttaataatagtatgactttttaaagagttgagcaatggcatgttaaaaacatgttctttacacatctaagatgatagtacatagattgtttcatgttagaagtagaaacattttcagcttcttttgaagtgagagatacgaagagggaggctatgagagaatcaaagagagcacagggagttctcagtggtctcccctcttccaaggcaaatacttctgtctccaaggactgagtagagctttgagaaggaggataggtatgtcacagagagtaactaatttctgattaggtgaaactgaagctgtgtgctgaggtaaatggtaaatttaggagtgactgcttgggatttattcagttagaggtccatgtagcaggtgggaaatgtttgtatttgatgtgtgcggttaacaaaagccaatgaagaatttgggagattgagtgactgggccattatggtgtatatgtaaaataatcttagtggttgattaagagatagatttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactgcgtctcaaaaaaaaaaaaaagagagatagatttaaagaagtaattcccatggccatactgagtcagaagggtgataagtataatgagaatggttggtgtgaaaggtcacaccaaggttctggaatttggtaataggatgatagcattgtcactcttaaaaagatgattaggcaagtggacatgggtgaagattttcccaaggagatttgttttaattcgggacacattttatcaaatgatagtatatcaccataaggaaggaggctttcaaagactacaaaggactatctccacacttttttttctttttttttgatggagtctagctctgttacccaggctggagtgcagtggtgagatggcggctgactgcagtctctgcctcccaggttcaaacgattctcttgcctcagcctcctgagtagctgggaatacaggcgcccgccaccatgcccagctaatttttgtatttttagtagatacggggtttcaccatgttggctaggctggtcttgaactcctgaccttgggtgatccgcccaccttggcctcccaaagtgctgggattacaggtgtgagccactgcacccggccctatctccacatttaaggagcttatgatctgattgaagtgaacataccttcagaaaataagatagatctgatagaaagtagcaggctgagattgaggctccagatttggtaattgtgtgaaaacaagaatgaatcaagtatcccaagttgcatggaaaagtagtgggtttgtattagaggcctgggacatttttgagacagttttgctcttattacccaggctggagtgcagtggccgatcttggctcactgcaacctccgccccctgggtacaagcgatttttcttttctgcctcagcttcccaagtagctgggactacaggcatgtggcaccacgcccagctaatttttgtatttttggtagatacggggtttcaccatgttggccaggctggtctcaatctcctgaccttgtgatctacctgccgcggcctcccaaagtgctgggattacaggtgtgaaccaccgcgcgaggcctggtacttttctagtgacgaagtgttgaaaccgctggtggtcacattgaaaagcattcagagatactagatcacattacatcttaattgcagatagttccagctttcaaatcagatttttggtaggagcttagcacatatctttctgtgggaactgtgttataatgagggctagtacgttctcaagtagtacacacaaggccatttaatgcatcgtatccttgaagtatgtgttacactattaggctaaactgtaagaaattactgtttttggaagtcacagatcaccagatgttggcagtttcacatggttcaatccggtacatttaattatcaccagacatttttttttagcttagtgaatttttaaaatttattatcatttatgtactttttatttcaatacttttagggtacaagtagtttttggtatcaccagacatttgatgtctataatttatttgggaagacactgagactgcagaattgacctgatagctgtgttttaaaagcatttctctgagaccattcagggttttaaattgggatgtctgagactgaaggcccttctgccccagggattctccttaatcccaagtttctgatgggttttctctctatagtcatcctccttcccctgatccccaaaataagactagggaggtgggagtattttagggtggtgtttctcttttctgtttttgagatggggtcttactctgttgcccaggcaggagtgcagtggcaggatctcagctcactgcaacctctgcctctcaggttcaagtgattctcctgcctcagcctcccgagtagctgggactacaggtgcttgccaccatgcccagctaattttagtattttttagtagaaacagggttttaccatgttggccaggctggtctcaaactcctgacctcaagtgatctgcccgccttggcctcccaaagtgctgggattacaggcgtgacccaccgtgattggcaagggtggtgttttgctaactgtaggttagtttttctaactgtaggtttttaacaggatttatcacaaatgaaagacaatagaaaatattcaggaaacattgcacatggtaatggcaagtgtttcatgaaacatttagtgtctgtgcatttgtgtgtgtgtgtgtgtgtactgggttgtatatgcagtgtatttatttatcacaggccttaaacatttgagtaatgctgatttgggagatgaattgatgtaggcttggcatcttggggatagaaggtaagccattgtaggggtcctcggacttctttaaccttttgccctcctattgtgggccagaaagtaggccttctctctctccactggtgccatcaaactcctctgaactctggctcatgtctttcctttacctgcatgtaacgcaatgtaatttagtatagagtagaatcctttggaatttttttaaaggtgattcctggtagttgctggtataaaggtggttaaaaacagaaaacctaaagcacagagatagtgttctcatttaagtgttttaagtagaacatgaaactttctaagttgagtttttgtagagtgatcactgagaattcatctatatttcagaggaaaacaagaaagactggtaggtaggcacttgatagatttgtggaatgggtggagacagttctgagcacctgtctaggatcagtgaactacgtattagtgaatatgaagcagaagttgatagtaggaacagagaggtgattatcttcccctttttttctgtgctgtactatcttggagaggtgaggagaaaaaggttccaaattggccactagatgattgaaagaagtccctgtggccaattttgtatctggatgaccattcttttttaagtgagatgcgtgaacctttcatataaagagctgctggcaggatattgttttattaggttttagggatattggcccatggttcactttttctttctccccagtttttggaaaagttgattgctagtaaggctgattgctttcagggaattgtcattttcctccgggggatgtttggatgagaatggagaccagtttggcaagggcaacagctgttgaacaatctgtttgggattaggtgcaagttggtatgtagtggaaatctgcctcctggttcctgaaattatgttcctttgcctcaaggataaatgttttcctgctcattccagttacattcacttagttctggctggtaatgcttctgactgataactttcctcttttaagagagcttccttgaaagaataattgatagctacgatgaacaattaaaaatgttatgccttcccttaagattttgctcaggatttaatcataggttggtggtaacagaacctttcagttcaaaattagctgtatattatctaaccattttggtaaggggagagacttaaggtgctttctgatggtttagatggcagtatcacatgagatttattcatattgtgtgttggaatgtaaattctaatgacctttggaagcattagtagtaaaatttacttagctggctattcctaagcttactagtgagttggagttgcatgcgtgaatcatacctctgaccagttgtgatgatacaaattaagttgagtttaaggaagagactaaattaattgccatcctgtcaccacactgtccacttagcactgtacagctaagatcctttcagttttttaaaaaatacttttttaataccacagatataagaacctgcaatgggtgcttttaatttgggtttatgctgacctttatgtatcagataatgtgtctaaatcctgagccaggatcctagtaaccccaatttctatctaagcatagtctaaaagctgtcactcagtactagaacgtcttttgtggtatgaaaggataatgtatagggcctggaagtacacttacatatttgcttatttggttaggttgttattttgtgaatagaatttaaattcacttttagaagtaatgtcatagttgtcagtggacatgtatatttcaactaactataaggaagacagatggaaatgtccttttctttttcgtgtctgataatgcatttgcatttgttgatctgaggtcagcacttaagttggacatcttcaaatctttttttttttttaattgagatggagccttgctgtgttgccccggctggagtgcagtggcatgatcttggctcactgcaacctctgcctcccaggttcaagcgattctcctgcctcaacctcccgagtagctgggattacaggtgcctgccaccacctctggctagtttttgtatttttagtagagacaggatttctccacttggccaggctggtcttgaactcctgacctcaggtgatctgcccgcctcagcctcgcaaagtgttgggattacaggcctgagccaccatgcctggtttcaaatcttaatttaatgggtggagttagttttccaatcactagtagaaactcagtaaccataaattttgaatgcttgtattttattggagtctggaattaccacctccagagatatttagattgactttgtagttctgattggtggtatcacttttgatttttgagcatctcaattagcttatcttttcctagaagaatattttatcttcaatttttatatatagatgcaatatataattataaatactatatataacatgtacttgtgaatccgcatttcaaccatacatcaacatagagtagttgtagttaggttcctttttaaatgtattttaatttgaaatttacttgtatgaataaactcattcattaaatttttttctcaacattatttaatattgacatattgtcaccagtgagtctgaaataattctcatgccttaaatgtgactatttcaaagtattactctttttttttttttttaagtatttattgatcattcttgggtgtttctcggaggggggatttggcagggtcataggacaatagtggagggaaggtcagcagataaacatgtgaacagggtctctggttttcctaggcagaggaccctgcggccttccgcagtgtttgtgtccctgggtacttgagattagggagtggtgatgactcttaaccagcatgctgccttcaagcatctgtttaacaaagcacatcttgctccgcccttaatccatttaaccctgagtggacacagcacatgttttagagagctcggggttgggggtaaggttatagattaacagcatcccaaggcagaagaatttttcttagtacagaacaaaatggagtctcctatgtctgcttctttctacacagacacagtaacaatctgatttctctttcttttccgcacatttccccctttttctattcgacaaaaccgccatcgtcatcatggcccgttctcaatgagctgttgggtacacctcccagacggggtggcggccgggcagaggggctcctcacttctcagacggggcggccgggcagagacgctcctcacctcccagacggggtggcggtcgggcagagacactcctcagttcccagacggggtcgcggctgggcagaggcgctcctcacatcccagacggggtggcggggcagaggcgctccccacatctcagacgccgggcggccgggcagagacgctcctcacttcccagacgggctggcagccgggaagaggcgctcctcacttcccagactgggcggccgggaagaggggctcctcacatcccagacaatgggcggccaggcagagacgctcctcacttcccagatggggtggcggccaggcagaggctgcaatctcggcactttgggaggccaaggcaggcggctgggaggtggaggttgtagcgagccgagatcacgccactgcactccagcctgggcaccattgagcactgagtgagggagactccgtctgcaatcccggcacctcgggaggccgaggcaggcagatcactcgcggtcaggagctggagaccagtcgggccaacacggcgaaaccccgtctccaccgaaaaaatacaaaaaccagtcaggcgtggcggcgcgcgcctgcaatcccaggcactccgcaggctgaggcaggagaatcaggcagggaggttgcagtgagccgagatggcggcagcacagtccagcctccgctcggcatcagagggagaccgtggagagagagggagagggagagggagagggagaccggggagagggcatcagagggagaccgtggagggagagggagaccggggagagggagagggagaaaagtattactcttaaggatttgtgtatggagaagggtattgaggttgtggaatagaggtaggattggtgttggaggaagggttacttaccttatggaatcggaaatttgagacaggtttctgagtgaaaataggtaaatgtggtattgtaatataataagaaatacatatttggtctctgttcctggttcctggcacacagctcttaaaacccttggactgaccaaagtactgtaataaatgtctttttgtatgctaatgagatgactggtggctggggctcctggatagcttcagggtgggggagctggttgctaggagaagcaaccaacctatctcctgggaggggaaggggaagagcctgaaggatgagttgataaccagtggccagtgatttaatcagtcatgtctacataatgaagcctctatacaaacccaaaggatagagtctggagagcttccagatggatgagcaagaacacatccaagtgcagcgattgggggtacatcccaggtacaggagatcagaaactcttgctcttaggacccttccagaccttccccatgtgtctcttcgtctggctattcatttgtatcctttaaaatattagtattggctgggcacagtggctcacacctgtaatcccagcactttgggaggccgaggtgggtggatcacctgaggtcaggagttcgagaccatccttgccaacatggggaaaccccgtctctactaaaaatacaaaaattagctgtgcatggtggtgggcgcctgtaatcccagctacttaggaggctgaggcaggagaatcacttgaacccagtaggtggaggttgcagtgagccgagattgtgccattgcactccagcctgggcgacagaatgagactccatctcaaaaaaaaaaaaaaatctttctaataaatgggtaaacataagtaaagtgttttcctgagttctgtgagctgctctagcaaattaaactctggggagagcttatgggaaccctgatttagagctattgggccagaagcacaggtcacaacctggggcatgagattggcattagaagttggggtggtcttctgggactgatcccttaacctatgggatgtgatgttatttccacatagtgtcagaattgagttaaatcataactcacttagtgtctgccagagaatctggtgtcaggagtgtgttgtgtgagagtagaaaaaacactgtttttttccccatctttaataataaaatatgctataaggtgtagtagagcattatcccttattaggaagagtttataattagttatttttgttgttatggctgaaccagacctttgctttgttctcagaaaatatctagcaaagttacacattttctttggttcaataagtgttgtttgttgatctagttgtatatttaaaaatagtgttaaaaataaaatatgtgcttattacacataaaattgacaaactgaaaaagtagaaggaacaagttaatcaacaaatatttattatcttcacaaatatttattattaccaccaggcactgttctctgccctggggaaatggtgttaaacaagtcatgtacccagggggcttacattctggtagctgaatggaggagaaggatgtaccaataagtctgttattctcagtaagtgtgaaaaagataaaatgtgtagtgagaaaagatgggtggtgaaggcaaggcctaacttggttggggtggtcacggaaggcttcttagggagggacgtttgagttgctctgaaagatgaggaggcagtcattggagagcagggaaaagagtactctaagcagaagaggtccaaaggccttgcaatgaaaatgagcttgctttgttcaagggacagaaagtaggaagaaaatagtgtccgtagcaaaaccataggacacatactgagtctttgtagatgtatactttggcttgtatttttagaatttgtattctgctgttttaatatttgcttcataatataaacattcttcatttcataccttagtaaacatttttagtgttgacacaattaattttgtaaatgtatcgtggttgacttacccattccccaatagtttggcatttagatccctcctcccccccttttttttgcattattgtaagtattacagtgagcactttggatataaaacttttttgcttcttacggttggtcctcagaaggcaaaatataaactggggcaaagatatgaattatttagtatttattgccagaatatttggcaaaagctttagtttatgttccaattaccaaagtgtagagagtgtttactgtatcctggccagcattaagtattatttttgttttgaaaattttttttgctgtgggaaaatgcagataacataaaatttaccatggtaaccatttaaaagtgtacaattctgtggcattaaataaatccacagtgttgtgcaaccattgccactatctacttccagaactttttcatcaccctaagtggaaaaccttgtacccaccaagcaatcatttcccaatccctgttccccatcaacccctggcagccatgaatctgctttctgtctccatggatttgcctattctggacattccatgtaaatggaattatatagtacatggctttttgtgtctggcttctgtgactaagcataaagttttcagggttcatccgtgtcatagcagtgtcagtacgtcttccctttttatggctaatattccatcgtttggatataccacattttgattatttattcatctcttgatggacattgggtcatttccaccatttagctcttgtgaatagagctgctatgaagatttatgtataagtatttgaatacctgttttcagttttttcggacatatatctaggagtggaattggccgggttacatgataggtaattttccatttagctcattgaggactggccaaactggtttccccgttggctgtgtgatttcacattctcaccagcagtggatgagggttttaatttctccatatcctcacgaatacattatttttaaattttttgtgttttgttttttatgatagccatcctagtgagtgtgatttttgatttcattgtggttttttattttcatttccctaatgactaaaaatgttcagcatctcttcatgtgcttgttggccgttgagtattatctttttctcactctgtcacctgtgctggagtgcagtggtgtgaacacagctcactgcagccttgacctcctgggctcagctgatcctcccacctcagcctcctgagtagccaggaccaaagatgtgggccaccacacctggctaattaaaaaattttttttttgtctgggcaaggtagctcatgcctgtaatcccagcactttgggaggctcgaggcaggtggatcacccgaggtcagtagttcaagaccagcctggccaacatagtgaaacctcatctctacaaaatatataaaaattagctgggcgtggtgatgcacgcttgtagtcccagctactcaggaggctgagggaggagaatcacttgaatctgggaggcagaggttgcagtgaccagagatcgcgccactgcaccccagcctgggcaacagagcaagactctgtctcaataaataaataaatacgtaaataaataaataaatttttttttttggtagagacaaggttgcccaggctggtctagaactcccaggctcatacagtccttccacctttggctcccaaagtgctgggattacagggactattatcttttttcaacttgaaatttttattgaaatataagatgtacagaaaagggcacatagcaccaactcagtacacatgtgtaaccatcactttatgccctcttctagtcacagtctttcaccaaagagtaaccccacctgacccagaacagcgtcaattagttttgcctgcttttgtactcatgtgaatagaatcacatagaacatattctgtatctgcctttttcggcctaacgttagatctgtgccgttcatctgtatcattcattttattctattgtgtgaaatactagtttattcattctaaggttgatggacatttggattggttgcagtttttggatcttataatgtcgtgaatattctgctatttgttttttcttgagcgtgtatgtgggccaaatacagcttttggagtggttgatcgtactagcgttaaaatgtcgccattggtgtaaataattcctctactttgttggctgtttcttttttttcttttaattttagttctgtttaggcatggagaagttgtaagtggttttcttttgttcatttatttggttagttttaagtttggattgtgaccccttcatccagagttttaaaattggaagtcagctctcttgagtcacataatcttggtatgaagtttaagatgaatgaaatgcaagcatacttgggaaaaaaaagaattttttttactggggacctatcgttcttttcttaccaaatgttaagagtatcccccaatatttttatagtaattataaaatcacaaatttattataaccccacagtaggtcctagagactaactggaacagaaagcaatattgttttaattgtttgatctttgagctctagtaaacttctctatcttttcttattttcttttaaaattacaaaataatgcgtacatattataaaacatttgaaagttacataagaaaatcaaaataatgtcactacttgagagaaaatcacgttagtacatacacttcctgtttgtttttaggcaatgctagttttttttttttattgaacataatgttctataatgtgatttcccctaaatatactgtgaatactttcctctgtaattaaatattattctaaagcatggttttaaaaaattagagcatgatttaaaaatttaatttttatcatgtggtatacatgtacatattaataatttatatagtcatgtagttttacaaggctaataaaaaaagtaggccgggcgcggtggctcatgcctgtaatcccagcactttgggaggctgaggcaggcggatcacttgaggccaggagttcagaccagcctggccaacatagcaaaacgctgtctctactaaaaatataaaaaattagctggggatggtggcgcatgcctgtgctcccagatactcaggaggctgggcatgagaaccacttgaacctgagaggtggatgttgcagtgagccaagatcgtgccactgcattccagcctgggcgacagagagactccatctcaaaaaaaaaaaaaaaaaaaaaaaaaaaatccatttttccctttcctgctagaatccagctctcaagaggaaccactatcaactgacatatttctttggtagtttttaatttccagataacgtgtttaaactaaccttttttgactgtttcaattttagatttatcttttgacttgccatgatggaagatagtggtttagctgttttacattctcctccccacgatgcatactttccatcttctctatatggttatataaccaattttggttaatcaaagtttatataactattcacattggagccatgctgtgtactattttaatatggttactttttttttttgaaacagctttttgttttagctggatttaatgaatctttgtgtttatttgttttccatgcattcatcacttactcagctcagactatactactaaagtttaactctccttttaatataataaacacatcaggtaatctttcagtttcttttttttttattttggatacctctaactttgtgttccagttgaactgattgccttcttggcttgcttcctggagtgggatttttaccattttcatgggaattctttcagccttattctgttgcttttcattgtagctcccttagaaataaagcatgggaagcaaattctttgagacttagaatatttaagaatatctattagagcctactcttgatagataacttggctgtatttacaagtcaaggttggaaattatttttcttcaaaattttgaaggcattactcaagtgacttgtttctagagttgctctgaaaagtctgatgtcattttgattccaagacccccctccttttttttttttttttttttttttttgagacagagtctcgctctgtcgcccaggatggagtgcaatggtgtgatctctgctcactgcaacctccgcctcccgggttcaagcgattttcctgcctcagcctcctgagtggttgggattacaggtgcctgccatcacacctggccaatttttgtattgttagtagagacggggtttcgccatgttgatgaggctggtctcgagctcctgacctcaggtaatctgcccgcctctgccttccaaagtgctcagattacaggcgtgagccacggtgcctggcctccaagacccttataagaaagctgtttttttctttctggaaacctttaggatcttctcttattcctggtgttctgaaattttataatgatatttcttaatgtgagtctttgtttaaaaaaaaaaaaaagtctgttgtgctgtgcccttgatggatctttttattttagaaacatgcccttcaatgcttagaaagttgtttctttggtaatggactctgaaaagggagaactccttgttagggggtttttgggtcttctgaattcttttatctactctttgctgtctgattttgtcttttttttttttttttttctgttttttatattccaactcctttattggatttaaagtttctgctgtctttaatttgaaaagcttttcttttgttttatgaatgtttcttttaatcattcttatttcacggatgcgtatctttttttcgaccctttgaggatattatgattctgttccttgcgttgtttctttttttcccttgctctgttttgattcctatctttcaaattaaaggttttcttaaatgtttgatgttccttgcctatctgttcagacttaagcctgaggcttttaaaaaagtttttatttttaaagcaagttgggaagtctttccatggtatgggcctgtgacatggtcttcctctctgagggatgaactggtgaatctggctttccgtggggaccctcagctgtcagtgtctccaggtctctcttttttaggctgttttgttttcctgtctaagcttgactgccagaattctgtggtgaattggggaaaaggagggtggtgggtgggtggtaagttatcattcagtatttaggcttgcatttaatccccatcatacctccctcagaatgcctttgtttacagtctctcctgtgtaaacttcccagagtaatgggctgagtgtctgatggcattgtttgggttatgatatctgggatttcgatgaatggctccgtatctagaatttcaaccaggtgttttttttttttttttttgccccccaccctgctctggattcctgaacttttctaggctttattcttggtacattccctcagtaattctgctagacagtttctgttttcttcagcctactaagtcagttacctctaatccatctgcttttcggctttcaaaattgtgcttatatctagagcaagcttgtccaacccatggcctgtgggccacatgtggcccaggatggctttgaatgtggctcaacacaaattcgtaaactttcttaaaacatgagatttttgttttgcgatttgttttttttaagctcatcagctgtcgttgttgttagtgtattttacgtgtggcccaagtcacttcttccagtgtggcccagggaagccaaaagattgcacactcctgatctagagtctgctgtagtgtcctcttctgtttgtttgtagtctctgcatttataaattatttattatttagtgttggacttgtaagaaacactctgctccactctgccgaggaaaaggtgagctattgtggtgaggccttcacaggtctgtgtgcctggcactctcagctgcattattcaggaccttgggctgtacgtagttattttattggatttgtgtgagaagggctagttttgtgattggttaagtttattgaaaataatttttttttttttttttttttttttttgagacagagtcttgcactgtcgtccaggatggagtgtagtggtgttatgttggctcactgcaatccctgcctcctgggttcaagggattctcctacctcagcctctcaagtagctgggactacaggtgcactccaccacgtccagctagtttctgcatttttagtagagatgaggttttgccatgttgactaaggctggtctcctggcctcaactgatctgcctgccttggcctcccaaagtgttagaattataggcgtgaaccgctgcatctggccaaaagttgacttattttgaatggactacattatagcttaactagattgtacgagtgcttatcaactaatatgttaaaatatggtaattcctttttttttttttttgagatggagtcttgctctgtgttgcccaggctggagtgcagtggtgcgttctcagctcactgcaacctctgcctcctgggttcaagcaattctgcctcagcctcccgagtagctgggattacaggtgcctgccaccacgcatggctaatttttatatttttagtagaaatggggttttgctgtgttggccaggctggtctcgaactcctgaactcagatgatccacctgcctcggccttccaaagtgctgggattacaggcatgagccactgcacctggccaaaatatggtaattctaataggtcacattcaggtgtattttttttaatggtctaatataacattaaaagtatttgtgaaaaattccattttggtattttaagcataatctatccaaaaggaacattaaaaaataataataaaaggggaatgtgaggtttaggtttttaagatgttcagtatttttaggtaagagtgttgtagtagtttgctagggctgccatgacaaaataccacagacccagtggcttaaacagtactttcctcacaattctgaaggctagaaggtcaaggtgttggcagggttggttccttctgaagcctctttcttggcttgcagatggctctccttctctgtccacagtgatcttccctctgtgtgtgtctgtcctaatcttcttataagggcaccattcatattggattagggcccacctgtatactcagtttacctcagttacctctttaaggccctgtcttcaaatacagtcacattctgaggtaatgggggtaaggattttcacatgtgaatttggtgggtgttggaggggcacagctcagcacataacaaatatttttattatctcatgcatttaaaggagtatcatttctgatacacttcagaaaggaatgtattagtgtgatgaagtggaaataactcggacattgtagtcagataggtaggcctggtttgaactctagccttgcctcttaatagttccctaaatttttgtaacttctctgagacttgcttccaaatctatgaactgggagtaactgtacatcacagaatgatggtaagaaattaaggacgatgtatgttaaaagtgcctgacatcgagttgacttctaaatattatgttcttactggtcttttctctcccccactccccaaagtagtgttttgtatccttcccccttatttaatatcagaaggtgtcaatttcgagtgtagatatgtatcattttaaaattgcttagtctttctattcacaagtggttgaatatcagcagtttcttaagattcaatctacaattgtatttacccagtcgcttgtcagaatttccaatcatcatgtagttcagtttaacattttacatgctttaagtgaaacctacagaagtgtaatctgctgagtcagtggatattcacgtttcaaaggttcttgatgcataaggacaagagcctttgcttttttatcagcaaggtatgaggatgcccttttcccactctaacattactgttttctcctaagtatcaaagtctaaaaggatatcttgttttatttaacttgcatttctttactagctagctttaatgtttttcatatctttatcagccctctctaaatcttttatcaattgtcctttttttgtttgtttttgtttgagacagggtcttgctgtgttgcccaggctggagtgcaatggcgcaatctcggcttactgcaacccctgcctcatgggcttaagcgattctcctgcctcagcctcccaagtagctgggactacaggcacccaccaccatgcctggctaattttttttttttttttttttttggtagagacggggttttaccatgttggccaggctggtctcgaactcctgacctcaagtgatctgcccgcctcggcctcctaaagtgctgagattacaggcgtgagccactgcgcctggccacatttgtacaattttaaaatattgtttttttctagtggataaggcacacaatagtagtctccctttgtttaatagctgtctggggcatattttcccacctatttatttacccccatttatattaagccctcattttcctcctttagctctgcctgcctgttctccctcagcaagtcattgacattttccaaagttaagagaaacagtaataacttcactgaataaaaatagtgagagagcctggactttgattatgtccagaatacctcctaagagtgttattttcaaagtcaaagtgataaggaattttggtttttatgtctgccactgaaagtagcttgtttaaatttgagtttaattagtagaatgacagtgttattactcatagtgtgtagtgttattaaagattctttggcatacatgcaagtttttgcttattagaagtttctagttgaaattatagcactcacaaaaagttttgaataaataagatttagaatgagtgacccctgaaaacctggtatgcaaaaggctactgggtaataatttcattaattttataccacatgtgtgatttcaccatactttttttgttccttgtggttgattctaagtgatcagcaatttttattttgaccatttaaacccatagccattagctacttaaatttgtgaaattctttgtagtgatttcagttttacaagtttgtatcttggctgatggtctaattttgaaaactttacatttggtagataccaatgtttttcttaatgtactttttcacagtccttctgattgatttcaaagtgttgtctttgaaaataaacatgactcatagcacttgggtagccagagcatgcctgtaatgaatgcctctgtacattttgaggctgtggtagaataaacatagcagttcctttcctttttgaaatggaagtttgatactagtactgaatttaaagatgaacagagcttagttttggagaaagagaaaagcacggttatatttgcaggtacacttttttctaactttcattgactatttttgagtgttaatgtgtaattattaaattaataaaagtaattttatagaagctgcaaattaccatatttcaatttatttcaggggttattcttttaataatttaggagctttaaagtatgtatctcaagcgctatataataaagagccatcggtgtagttaaacttttgagcttttaagaagttatacatataattctaaatatttgcttaattatttatttttacttagggagaatgactgcttaaaggttgagtcttcacattttggatagccaagaaccattaacaaatttctattgtttttgccattgatttgtgggtaccttttaatcctttattatcatttagttctttgtgtcccagagtaagttctcatttagttctatttgggtatttgtttttgtgctcatatctcttactgttggctatacttcatagtatgttttaatatctggtcaagcaagtttatttttttttttgaggttgatttagctgttggttagcctttattttagcatgaacattgtaggctgtttattgaattctttaaagaatcaaactggcaatttgagattgcattacatttatagattaattttggtggagaaatgttattctatttgtggattgttttggttcttctagatagatgatgatgtcatcagcagcagtgacagttttctctctttcttttcaaatgttacactcttattttttacagtgttggccagtctggcactgtgctagacagcatggtcatatttgttgacatagggaaaggcttttgaagtctctattttatatttgttatacgtttttgatatatatatataacctttgctaaattaaggaaactcccttctattccaggtttgcatagattaaaaaaattattaagtaggttcttcttttgtccagttgttttcctgcttctatcaagataaccacctgagttttttcttttagcctttaataattaacaacaaaaaaacactgttggatttgattagtcagtattttatttaggctgtaactttatagcattgttatctggttttagattcaatactagcctgataaaaatgaccgtagcttttgttctttttaactttctgaaacaacttgtataagataagaatagaatgtttcttaaaagcttagtagaatccacctattaaaaaaaggtctcatcacggagttcgttttgttttactttgttgggagaagagcattgccatttcagttgctttaatcttttgatctgtttttcaacctgttttctttcaatctattcaaatcctctttatttcttctgataattttgtcatttctcttcttttggatcttctttgtctttttcttgatgaatcttactagaattttatctaggctattaatatttaccaagaaacagcttttggttttgttatcttcttaattgttcatttggactagattttcattgatttctgtcctttattatttctttcctttttatttatttggcttttctttgttaggcttttcttttttttcaccttcttatttctggtaaatgtttaaagccatatattttcctcaagttcttccttggctctaacatatattttctaaatgtttcctgatttttattgatttcctttttaacgtaagggttattaagttatattttttttagtttccaaatttgaatatttataaaaattattgattcctgagttcattgtattatatcagaacataatctgtatgcccttgtgcctaccacatggtttagtaatataaatgtttagggtatgtgagaaaaaaaatgtatccccgtccattgggatgtatttctttgacctaaggaagtgtaggtcattgcttttaggactttcttttttaatataagtattttgtaattggaaccttctcttttttttttttttggcggggagatggagtctcactctgtcacccaggctggcgtgcagtggcgccatcttggctcactgcaagccccgcctcccaggttcacgccattctcttgcctcagcctcccaagtagctgggactacatgcgtccgccaccacacccggctaattttttgtatttttagtagacacggggtttcactgttagccaggatggtctcaatctcctgacatcgtgatccgcccacctcggcctcccaaactgctgggattacaggcgtgagccaccgtgcctggccgtaattggaaccttctgtttgtactgttgagaacttgaatttttttgcttatattttgtctgcttgatctatcagtagtctgaacagagttgattaagagtaattgttgatttttctctgacagttctgttaattgttgaatatattttaagacctgtttgaagtgggtagatatattttgctgtcattttcatcactatatagcctcttcttcatgtatttttaaatcccttttaatttgctttttttggggaaaaatttcagacctttaagaatgttgtaagaatgttacaaagaaaattattttgctcatcatatagctttaccaattaatattctttctttttcttttttttagtcttttttatttcctggtaaatgtttaaagctatatattttcctcttaaatctcccaggctgcagtgcagtgttgtgatcacagcttactgcagttttgagcccaaatgatcctcccacctcatttcccccagtagctgggactccgggcgcacaccacatgcctggctaattttttaatttttttgtagaaatagagtctcaccttgttgcccaggctggtcttgaacccttgggctcaagcaatcctcccacctcagcttctcaaagtgctcagatcacaggcatgagctactattctcagccttctctaacttaagaaggaagctcacttaggtcgttgcttttaggcctttgtattaggttggtggaaaagtaattgcgttttttgccattaaatgtggcaaaaccacaattacttctgcaccaacctaacataaggatttaaaactataaatttcccattaaacattactttagctgcatctattttttttcttatttattattattttttagacagagtctgactgttgcccaggctggagtgcaatggcaccaacatggctcactgcaaccttgacctcctgggctcaagtgatcctcccggcctccgtctcccgaatagcggtcttactcattttctacgtgtgtgttgagtgcaccatttgagagtaagtcacagtgttagtccattttgtgttgctctaaagaaatagctgagactaggtaatttataaagagaagaggtttaattggctcatggttctgcaggctttataggaagtgtggtgccagtatctggttggtttcttgtgaggcctcagggagcttttactcatggcagaaagtgaagtgggagtaggcatgtcacatggggagagagaagaggaggacccaggctccgttaaataaccagcattcctagctctcaagtgagctgacagaccaagaacttactttattactacagggagggcgccaagccattcctagggatcctcctcccccatgatccagacaccttccttcaggccccacctccaataaagggggtcactttttttttttttttttttttttttaagacggagtctcggccctgtcgcccaggctggagtgcagtggtgcaatcttggctcacggcaacctctgcctccggggttcaagtgattctcctgcctcagtcttccgagtagctgggattacaggcgcctggctaatttttttgaatttttagtagagacggggtttcaccatgttggtcaggctggtcttgaactcctgacctcaggtgatctccccaccgcagcctcccaaagtgcaaggattacaggtgtgagccaccgcacccagccagcaatcacattttaacttgagatttggaggggacaaacatccaaaccatttaagtcacagcactttactccgcagtgtgaataacacaggcattctcctacataatcacagtacagttatcatactctggaaattgaatatcatctaatatactttccatacccagattttcttagatttcccaatgatatttcttactgtcctccctttagccttcctctttctccattcaggattctaccattacatttcattttcatgtctcttcagtctctctttagctttgtttttctttcttgatgttgccacttttaggaggccaggccagttgttttgtgaaagatctgttctctttgatatgtttcattttggatttgtttcattgtttttgcatgaatggattcaggctaaacatttttgggcaggactgtttattgtattacctagtgatgtgttcttttcagtccatcatctggaggcacctgatggcagttttcccaatattgcgaaattaagtttgattattttgttaaggtagtgtccaccagatctctccattttaaagacatccttttctctaattactcagtggactgtagagtgatgctttgaaactgaataactaacactccctaactcagtgatttagcacccgttgattttttttttttgcctgaatcaaatattattatagtagttttaaatggtgattttccatttctattcttttgttagctgccattcttctataattttgtctttatattttactgggtgttaagattgctattccagctttcctttgtcttttacaccttttcccattcttttatttttttccatccctttttgtcctgttttccaatagatggatagaattttctttctctggtttaaaggttatacatttgtgtgtgtgtgtgtattcttagccatttgcccttaaaacatagagatggttattcctgttgattaaaaaaaactcagtaatgttactatcttctctttaataagataggtactttatttcattctgtgttcttgggtgaggtctcccctcacccagtcaagttgatgttaatctagaatttttagttttttaaattatcgatatactttctgtcttttcctttttttttcactctctctgtatttgtgctttccccctttactctctttcccttcattccttctttctcactttcttcttctatttttcactcttgggtagattatcttttagaaaacagcaagatattatataatttactttatattctctttccaaatgattaaagtaataattaaaaatttttgatatgtgtgtatgcaaggataggaatcctcttgtaagtggaagaactctaccacatgcatgagtcattagtgtgttaaacactgggaagtggctttaggtccagctgggtgctctgaagaaggtaggtttcttcagttctttatgttaactgtctccttaccttaaaaaaggagtgaagaatactgactgcagaggttttgtgaggattccggtaacacagaagcatagaactggaaaagaatattaatatttgccaaaaaaaaaaaaagttaagtggagagaaactcttaaaatgtcattgattagaaagtaaggatttaaataaaaagttaaacaggttgatttcagatctagctctcagtagaatatgatgttagaatggaccttcggtaggccttatgcatcatctattaatattttgttccgtttcagtgtagcaaaagaagaaaaatactcttttttgtttttctggcccaggattcaattcacatggcacattgggtttcattgtcacatctctttagcgtctttttttttttttttttttttgagatgctcttgcactgtcgcccaggctggagggcagtggcgcagtcatggctaactgcagcctgtacctccgaggggtcaagtgatcctcctgtctcgggctcctgggtagctgggactacaggtgtgtaccaccatgcccagctaatttttaaatttgtagaaacagagtctttctatgttactcaagctggtcttgaactcctgggcccaagagatcctcctgcctcggcctctcaaggtgttgagattataggtgtgagccaccatgcctggccttctttgtgtcttttaatatagaacaattcctcagtcttaacatagacatttttgatgaataacgactattttgtctaacatctcccactttaggttatattttatttcagtattgaccttgttccaaggcactaccattatgaaacatggagactcatgatttaatatggtattaatgtttaaattcttatattttcctatgggtagaatacttggttcacggcggaatggaaacataaataataggctattttgggtatacgtcctacatgtaggattgatgttcagtatttgacttgaagacttttattgtctttttaaaaagtatgggcaaaagaaggggagaggtgggaaggggatttagaagtcttctatcctagatctcatcagaatgacagaaacagtacacctaacagctgtgaccacttgttcaatttagttgccatttttatcccactggtcagatgttttaattttcatttgaacatttaaagaaaggttgaagtcttaagatgtcagctgtgtgtaagtagtagactgtccaactgcagataaacagtagtttttaacccttcactgcccaagttgtacctgtgttgcctgattatgatgtttttattttgtggctatctgtaaaatcaagttttcaaagtgtatttctagaataaataaaacttcatagaaacattacaatggatttagagcaatgtatatatgctaaatcactcttttcaggcttaataattggagaagaatatttctagtcttttattattgtttcataatttaaatgctatttgaggagtatagttaaacttgaacagagtactttggaagccagtttttttcccttcctccttcttaatcagaagctgtttagttttactatggctatatgtggtcctcctagttttgtaataaggctggtgtaatttcaggaacctttttgtttaagagatcaggacattgaaaaccagagagggctaaactcaacttgagtcctgactctttgctgattaagtgctagttctgactcgtagaaggatcagtcatgtgggtttgcctggcaggcttaccctaagtaaaatataaattcctggttatcactaaggggggaaaatatctgaaaattcggtttttcaatgaagagtactttgtgttagacatagctgtctgtctcactagcaatgggatttccagggtagagtattaaagatatcatgagtcttttgcagctaagcagcttatgaggtcagtcaaggaataaaaaaataagccagcttcagaagagtctttctttgttattagaaaaattgtgagaggctatagaattatgtcaagatgctgagaaaactatagtttctaaatttttaaccaaaagggtatcctctttagtagtaaggaaataataatgagaaaaaatgcttaagttcagttgcagacattgcatatcttgaggaaaaaagaggacacttctaaaattaaaatatagcccataacatttttattttttatgaattggattactcattttgaatgttgccttctgctaagttactcctttagcatgaattaactgtattctttttcagtcatattcctaaatgttagatgaaattcatttaatgttttgaactttatatttttagctatactataaagattacacagctgttgcttggagatgtatgtgaattacttggagcagtaggatcatgatttgggtcctatgccagctgatagtcagctgctacaaatgaagagatcctaacacatgggaataaaaattcttaaagggtatgaatatcatattttaaaatgttctgggtagtgcctgcccttgttttaggcacctaactatttgtcatgacataccacatttcatgattaggagactggctttaggttttctgttggagagctgagagtattctcccctcattttgatagcaattagagtaactgggaccagctactcctgtcaagataaattgcattaccaacttcagcttttgtatttcatttgataattttttttttttttgagacagagtctcgctctgttgcccaggctagagtgcaatggcgtaatctcagctcactgcaacctccgcctcccgtgttcaagcgattctcctgcctcagcctcctgagtagctgggatcacaggtgcgtgccaccatgcctggctaatttttgtatttttagtagagccggggtttcaccatgttggtcaggctggtctcgaactcctgaccttgtgatccacctgccttggcctcccaaagtgctgggattgcaggcttgagccaccgcgcctgggctgattaaaatttacctaaatacttagattcttcatgccatggttgatttagtagtgttaagattgagttgctcccaagctacaattaaatagctctgatactgtctgtgttttctgtatacctattttttcttgattgtattaattctgtgtttattgagagcatatgtagtttctaaccttcattgattatgctcttagcaaagctgtctataaagtattttgtacttatagcaaagatgtcataaagagaaacttcaaatgcagaattgcgtattattttcattgaaagtgatctctactaaagaaagtttaaaaagattaaaatagtggttatccatggttcctgctgggcattatgttccatttactaatttgacattcagcagatgcttgaatatgcttcagatattaatattgtagatagaggtgatgcagttctctacactggtaagtgtatagtctaatcaacaaatcatcgtaatagagtgaggatcatgccgtggtaggagtatccctgcagttctgtggcgcttggagacctccctcctagagggatgtttttggaagaaggcagtctgagtagactacttggatgtgaactgggagatacaattgagcagtaacaattaagaaggtgatggaggaaaggaaggattttcttatttgacaatcaggaatagcatgattaaatgagtgaagagaagagagactgttgccccagtgggaatgataggatttaatagattgttgtaatgatgtaatttcattgaaatttccccaaaactgagactttgcgcagtgtttgaagatgtccttactcaaattagaagtaaaatatattgcatgtgcctgtcactttcacatccatttaagaacagtttgtccttaaactttgaatctagcagtgttccagagaagcaatgtgaatggttctcaagataacaagatcatctctgaatttctagcctcatgccaacatttatggcaggcacactcgtttcaccttcttcctaaggcagattgaaaagggaatttttatagctgaaaatcatgtaagaataccaagtgtaatctcaaggcccatcaatttggttacttcttcagtaggttccagtagtctttgcaagcaactgttgattgttaataactacactttattgatattatcagaaaagcacaacattaaggccttctagtcaagcagctttaaaaaattgtaataattactattctaccttgttttaaccttttgtagaagcacaggacaataagttccagaatcttttgaatgtcatgcggttcgtaattagctgaagacgaatgataaaagtgggctgctgtttttcagattacggccagtaattctctttggttatggctgtgctaaaattactttctgaacacattgccaaagtgtgtgaacaaaacatcatatgctagtgattcccaaatcactcttagctttcatcatatttgttctgttggtagtgtcaactgcgtgacactgcattctatacttacttttccacccctctcaaagcataaagttttggtatttaccttaacattcagtcttcctcttgtcacaaagactctttggtacttctgggttctcatactagggcaccccccacccccccccccccccccacacacacacaggggcaggctgcagtgtgcaagcatatggagcacactgtagatgacaaaagtggcatatctacctggaagataattctactgaaagatttatggagagaacattatattaagataggcagtgtagtggggtgaattataaaatactcattcaattttaatgtgaactatgaaactcctgagaaatctgtttgctcttcagggtggctagacgtctttagtctgtgtgtggggggaaggtctactatgtgccatctcttatcaatcttttctggcatttttgttatatgatagttatagctatatggtagttatagctagtctagtccttggaactaaactattttgaacttcgtttgatatagcaaatttgtgccaggggtcatctggcatgtcatgtttaggggccgtattcctcatctgtgtggaggaactagatgtggagagagaaagagaaataaatatgtttccccagctgtagtggacaggctgtttttcaggacagaattttacaacttttataaagtagttgtgagcagaagttggcagctggcaaatgtatgtatttgccaaactataaatatctggtctgcagccacaaatgtccaagaaaggctcttggaaaattaagggtttccttaggataatagtaaaaccaggctttcctcaagttgttatatttaagcataagaagcagcagttcataattggtttagttatattcatttatgttttatttcaagttgacttttaatccaaatactaaaatataacaaaagacaatttctgaggacttgaaaagtacataaaccttaagtcacatatagtagcagttaacttaaattgaaacaagaagttagaattgtatttcagttcatagagatgtactaaacatcgcggattctcagattgacagataaccactttggcctagaatacccaccacataaaatgagtatccagggaagagtaaaaatgaagagagcctcattgggatgcacttcataggaagttcaccaggctcacttgctggatagggaattggtcacgttcactccccacatatcagactggcagaatgggaagtttagattcttgtattggtcagaggatggctcgaggcatgtgggtctttgggattgtttgttaacacatcaaatgttaaaggtgtactgtttggtagtgttgagctcacttgtggttctagcagatagctagatttatttatttgcaatctccatttaccaaaatactgttgctgctcacagtaatagtaatgagtaacatcgctgagtacctaacatgtgccagatacttgaatgcttcatgtacatggttttattctcacaacagatccatgaggtattactgttattattatactctagaaatcagggaacagaggcttaatgaggctaaataaaaacttgtttaaggtgacgcaactaggaaatgacagagccagaattgtaattcacttaggtttaacttcagattgcctcctcttaatccccatgctctggtgcttctaaagagaccaacactctgccctgaataatttagtactgatgttaaacatttcagaaagacttttgaagcccttttttttttttttttttttttttttgagacggagtctgtctctgtcgcccaggctggagtgcagtgacgcgatctcggctcactgcagcctccgcctcccgggttcaggcagttctcctgcctcagcctcccaagtagctgggactacaggcgcctgccatcatgcctggctaatttttgtatttttagtagagacagggtttcaccatgttggccaggatggtcttgatctcctgacctcgtgatccgcccaccttggactcccaaagttctgggattccgggcatgagccaccacacccgactgttttttttttttttttaaacgtagtttcgctcttgtcgcccaggctggagtgcaatggcgcagtctcggctcactgcaacctccacctccggggttcaagcgattctcctgcctcagcctcctgagtagctgggattacaggcatcaccaccacgcccttctaatttttgtatttttagtaaagacagggtttcaccatgttagccagactggtctcgaactcctgacctcagatgatccccctgccttggcctcccaaagggctgggattacaggcatgagccaccgcgcctggcctgaagctttgttgaggtatagaatgtgtgagaaaaaaatgtatagtccatgtgccaatgattctgataacacaaaatatgcttagcaacaattctataataaaatcatcattgtcatctggtcttaacttaaaaagtgttatagcattaataagctgtctttaatagttcacctgaaaataagaccaatgaagccaatggaaaagtaaatgtattttataaaagattctaattgaactattcctaactagattctcctttgcagaaattgtaggatattatattttctaggtaatatttagatgcttattcttgctcaggaagtagattatggggcttctaggtggagaggctggcggtagaaaggctgttttggaggctgttgtaatctaggaaagaaagaatgcattaatgtagtggcacagtggaacagagtggaggaggtgttagtagagatgtttgggtggtagaattgacagggctggagactgacatagggatgttggcagaggagtcatctagggcactccagtttctagctcgggccagacagtatggttttggtatccttcatctgggaaagggaatgggggggagaaaaataggttgtattttgaggtatgtatgatatctaagtagaaacacataataggcagctgtttatgtgagtttgttgctcaggagagaagtatggactgtaaatacctatttgccttttttcttttttcttttttctttttttttgagacaggctagagtgcagtggtgcgatctcagctcactggaacctccacctcccgggctcaagtgatttttgagcctcagcctcctgagtaggtgtgcgccatcatgcccgggtaatttttgtattttttagttgagacagcgtctcaccatgttggctgagcaggtgtcgaactcctggcctcaagtgattcggtctcccaaagtgctgggattataggcgtgagccaccacgcctggcccctgtttggcactttttaacaggtattagttgaaatggtgaatttggaatctgtgtttaaaccttggtgctgtgtgtgtgtgtgtgtgtgtgtgtgtgtgtgtgtgtgtgtgtgtgtgttgagtgatgaggggaggcaattagtcaccacagcatctaccaaattttattatcatttatatgttgtttctcaacccatttgatttaaaattcttagaatacttacttgaatgaatatggagaaataaaacatgacattcttttcccctctaatgaagtctgtgcataattagttcttttattagaaaaagctgcacggggagtgcacacatgcttaattttcccttcaacattttattatgaaaaatttcaagaatacagaatggttgaatttttctgttaacatatgtatacccacaatctagagcctactattaatattaacattttactatatttgctttatcacacatctgtctctccatccttctctgtatacagttggccccctatgggtttcatatccacagataaaaaatattaaaaaacaatgcaacaataatacgcataaaaatacaatgcagtataacaactatttacattgtattaggtattataagtaatccagagatttaaagtataccagaggatgtgtataggttatatgtaaatactataccattttatgtaagggacttgagtattagcagattttaatatctgtgggagtcctgcagccagttcctccgaggatactgagggctgactataatttatttatttatttagatgcatttctaaataaaaagtaagttgtagtcagcacactattgcctaagtatgtcagtatttatatcgttacctagggttcaataatgcttatatatattttttccttttgtgatatatatatagcggaatgcacagattattgggaaagttttaacagatgcaaacgtgtaactcaaactcctttcaagattacagaatgttctgggggtgatggcaaaattccctgaagctccttcccatgtcactcctcgctttgcctcccctgctgcccatactgttttgtttctactatagattagcttttttttcctgttccagaattcatctaggaaccgtaaaatatatactcttgtgtaaggctttcttcacagcataatgtttttgcaatttatcatgtcatgtatatcagttgtttgcttttcttgttttctgatgaatctttgggtgaatacaccacaatttattcatcgtcttgtcgatggatacctgggctgtttccagttttgagcaatacctaacattgaaattgacttgtcagagggtaggtgtttgtttaattctgtaagaaactgccaagttttttccttttttttttttttttttttttttgacacagacttgctctattgccaggctggagtgcagtggcacgacctcggctcactgcaacctccgcctcccatgttcaggcgattctgcctcagcctcctgagtagctgggactacaggcatgcgccaccaagcccagctaatttttgtatttttagtcgagacggcgtttcaccgtgttggccaggctggtctcaatctcctgacttcgtgatccgtccaccttggcctcccaaagtgttgggattacaggcgtgagccactatgcccggccccaacttttctttcaaagtttgttgaaccattttatactctcaccattgctgtgtgggagttagggttaaaccatgttttagccatcctgctggttatgtagtggcatcttattgtgattttaactggcgtttccctgatgattaatgatttaacacaaatttactgagcatttatatatcatgttttgtgacatctgttcaacttatttgcccaatgttttattggttgttggagtttcagaaatgttggattcatgtcagatttatgtttcgtagatttttttcttcatctgtgccttgcctatgtatgcattctctcccttttcccctcctccctctctttcttcctgtaacagctttattgagaaaaaatttatatactctatgcattttcttaaaagtgtctttttatgggagaaaattttaatttgccttttttccctgtaattattgagaagagcttttgccttcctgtgatgatttttctcctaggtttccttctccaagtttatgggtctagcttttaggtttaaatcgatatatcttgaataatttttttgtatggtgtgaggtatgcattgagattttttttctgcatgcatatccagttgttccagcaccacttattgaaaagattatcttttctccactgacgtctttttaaaaaattagttgtctttatatgtgttgatttctggactctgtcctgtttcattgatatatttgtctatttttgaggccactaccataccctcttaattgctgtagctttgtaatcttgaaatcagatactattagtcttctatcattattctttttttgttgttgttttggatattctgtgctctttgaatttccatatgaatattataattagtttgtcaatttctacaaaaatggcttgatgggattttcattgtgattgcatttaacttgtagattaatttaggagagacttgacatcttaacaatattgaggcttccaatccatgaacattgtatatgtttaagttttttaaaatttctcttaccagtgttttttagttttcagcataaagattttacgcatgatattatgaagattttcttttttgggtgctattgcaaatgcagtttttaaaactttatttttctggtttgttgttgctactatataaaaaatgcaactgattttttaaattaaacttgaatcctgtgaccttgctaaattcacttactaatttgctgctttgtagattccttaggattttccataagcagcaattcgtcatctgcaagtagaggctattttccctttctgtcctttcttttttttccttttctttctttgccttagtgcaaaggctaggaccaccaatacaatgttgaatagaagtggttaatccttgccttctacctgaccttagggggaaggagttcagtatttcaaaattaagtatgatgttctagatattttaatatatgatctttatcacattaggggaaatcacttctcttcctacttttctgagagtttttgtcaagacagatgttgcattttatccctgctttttctgtcccccagccaaccccacccccacctcttttttttttgagatggtcagcctcctgagtagctgggtctacaggcacgtgccaccacgcctggctactttttgtatttttagtagagacagggtttcaccatgttggccaggctggtctcgaactcctgccctcaagtggttcgcctgccttggcttctcacagtgctgggataacgggtgagccaccatgctcggcctttttctgcctcttttgcattacgttgttcttctcctttattctgttacggtgaattaccttgattttcagatgttaaaccaatcttgcattcctggaataaaccctactttgtcatgatgtgttagtattttaatattgccaactttgatactattttgttaagaaattttgtgtattatttaaggataatatgattttctttatttgtaatatctttgtgtggctttcatgttgggatcacgctggtctcatgaatcaagctggaaatgttttcttctttatttttttgagagtttatataatatcagggctgttttttcctgagctatttgacacaattcactagtgaaaccatgtgcctggagttttgtttgtgaggagcttcatatatcaatttctttcttccttttccctctacttttcccttttccttccccctcctctcccctcttttcttccccctccttctcctctttttcttcctttttttttttttttttgagcttgtctcccaggctggagtgcagtggtgcaacctcggctcactgcagcctccgccttccgggttcaaacgattcttatgcctcagccttgagttccttggctcagctgatcctccagcctcatcttcccaagtagctgggactacgggtgcacgcagccatgcctggccaatttttaaaattttttatagagttaagagtctgaccttgttgcccaggctggtctcaagctcctgggctcaaacagttcttccaccttggcctcccaaaatgctgagattacaggcgtgagccgccatgcccattcttttctaacttaagaacgaagctcaagtctttgcttttaggcctttcttttctcatatatgcattcacaactataaatttcccattcgtcactgctttagctgcatctcatgatttttttcttatttatttattattattttttacacagggtctcactctgtctcctaggctggagtgcagtggtacagacatgcttcactgcagcctcagcctcctgggctcaagcaattctcccacctcagctttctgggtagctgggactacaggtgcacaccaccacgcccggctaattttgtatttttttagtagagacaggatttctccatgttggtcaggttggtctcgaactcccgacctcaggtgatccacctgcctcggcctcccaaagtgctgggattataggcatgagccactgcacctgggcaatttattcaatttttttttatggcccagcatatcatctatcttggtgattatagatgtacttgaaaagaatgtgtattctgcagttattatgtatagtgtctttaaaatatcaaatgagtcaaagtggttaataaccttcatttattctatgtgcttgcaaatttttttgtgtacttctgttgtctagttttatcagtttaagggggtgttaaaatttacaactaatactgtgaaaatgtctttttctctttctctgttttttttttttttttttttttttttttttttgagacagggtatcactccgtcgcccagatgggagtgcagtggcatgagctcagcttgctgcaacctctgcctctcaggctcaagcgattctcctgcttcagcctcctgagtagctgggattataggcacacgccactactgcctggctaatttttgtatttttagtagagatatggtttcaccatgttggccaggatggtcttgaactcctgacctcaaatgatccacctgcctcagcctctcaaagtgctgagatttttccctttaattctgtcagtttttgctttatgtatttagagatggtgattaggtggctgtacattcaggattgttacttgtttctgatgaattgaccattttataattttgaaaaattcctctgcttaaaagtctactttatctgatactaatgtgtcaattctgatattactatatgggtactgttttcatgacatataatattttatttactttgttcctttttttatgttactttgaagatcttgttgcttaccaatgtttatttactttgaacctacctgctttctgtatatttaaagtgcatctctgtgggcagcatgtaattgattctttattatctaatgtctgccttttaatgagagtgtttagtcattaacatttcatgtaattatggagaggttggacttcagtctaccattttaatatttgtattctgtttgtcccttctgttttcagtcctttgttattccttttctgcctttttgggggataaattgaatacctttagaattctattttaatttttctactgacttttttgctatacctctttgcattttctctctcctgttagttattgctttcacttttaccatttacttagagttaatgttgtagcactttgcataaaatgtagaaaccttgcaactctctaggtttgttccccccagtttgttttgctgtatttgtctgatatatcctatctgcataatttgaaacttcttaagataacgttacaagttttaccttaaaagaacacagtccaatttatatttatcctgtatttaccttttttgtttttgaaacagagtcttgctctgtcgcccaggcttgtgtgcagtggcacaatcttggctcactgcaacctccatctcccgggttcaagcagtgcttgtgtcttagcctcccaaatagctgggattacaggtgtgcaccaccacacctggctaatttttgtatttttagtggagatggcgtttcaccatgtttgccaggctggtcttgaacccctggcctcaagtgatctgcctgccttggcctcccaaagtgctgggattacaggtgcgagccactgtgcccggcctacatttaccatttttgatgctcttcatttcttttctttctttcttttctttttttttttttgagatggaggtttgctcttgttgcccaggctggagtgcagtggtgcaatctgggctcactgcaacctccacctcccaggtacaagtgattctcctgacttagcctcccaggtagctcagattacaggcatgcgccaccatgcctggctaactttttttgtatttagtagagacagggtttcaccatgttaggctggtcatgaactcctgacctcaggtgatccacccgcctctgcttcccaaaatgctgggattacaggcatgtgccactgcgcccagcctaatgctcttcatttcttacagactatttgagtgtctggtaccattttctttcaacttgaataattctctctctcttttttttttttttttttttgatacagggtcttcctctgtcgcccagtctggagtgcaatggcgcgatcttggctcactgcaactccacctcctggttcaagcaattctcccacctcagcctcctgagtagctgggattacaggcacccgccatcatgcctggctagtttttgtatttttgtagagatgaggtttcaccatgttggccaggctagtcttgaacttctgacctcaggtgatctgctcgcctcagcctcccaaagtgctgagattacaggtgtgagccacctcgcctggcctcttttttcttaaaatatctttatttgccttcatttttaaagaatattttccctggatatggaattctagattggcagctttgtatttgagctctttaaagatgttgttttattgtctctgttctcttttgtttctgcagtacaatatgaagatgtctgtggtcatccaatttattgttcttctttatgtaaagtttcatttttctctagccatttcaagtatcttcgtcttcaactgtgatatacctacttgtggttgtttttagattgaatatgctttgctcttttttgcggagagtggggagttgtcccagactcttacacatattaatatgttagccccaatgatactgtcccacagatctgtataacttggttggactcaaaacagcaaattctgtcttttaggcagtgggtcatattttggttcagctcttttagttacttggaaactgccctacacatgagtagatcagggatcatccagagatttaggcagagtttatatacagaatttggggttccttcctgcccactggctcattttcctcccaggaatttcctctcattttgcagcagctatggattgccctgaactctatccttttatctttaagctagaaagtctgtgggggtttctgttggagttttagctctcccatgtagcacagaccaggaccagttgtcaggctaaaagctgtaaacatcagagaactctccccgtattattcctttcttaaaagagttgactcccttcttctcattctccagtgccttcctgcattagtccgttcttttcactgctataaataaatacctgagcttgggtaatgtataaagaacagaagtttaattggcttacggttccataggctttacaagaatcatgatgctggcttccggggaggcctcaggaaacttacagtcatggcggaaggcaaagggggagctggcacttcctgtggctggagcaggagcaagagagagagagggggggaagacaaccagatctcatgagaacttactatcaaaggaatagcaccaaggggatgttgctaaaccattcagaaaggacgaccctcattatcctgtcaccttgcaccaggccccacccccaacattggggattacagtgacatgacatttgggcagggacacagatccaaaccatacatttcatatagttgttctataaattttatccagagatgaggattgcttgagctcaggagttagagaccagccttggcaagatagggagatcccatctctaccaaaaattaaaaaaaaaaaaaaaaattagctgggtgtggtggtgcgtgcctgtggtttgtcccagctacttgggaggctgaggtaggaggattgcttgggcctgggaggtagaggatgcagtgagcaccactgcactccagcctgggtgacggagtgaaaccctgtctcagaaaaaaattctttttaattttaatccagagtttatagttttatctatgggagggtcatttggaaagttggccattacttggccagaagcagaaccctccctgcttacattttgagaaaaatagattgagattctatagtattctgctttagtttttctttcttgatctcatatggtacttgtcttttgctgacactattcattcattgaaattaataaccttgcaaaataaaaatataagaagtcagtgtggctcaccctccaccctccactcccactccatctttcatcccgtttttatttccacgtctgtctaacttggctctgcctggtgcctttatagctaaaattagccacacttgatatttttaactctacggtgcttggaaagtattttgagaggctttgccatataacttcatgaaaataatgtgaggaaaagaagaactacaggaaacaggtgaaataatctattcagttactgagaaaagtttcttattaatgggagaatttattaagatagggaagtatgtgttgccaagtgaagtgttttcccacatttttcttttttttctgtgaccatttctagatgtctgtactttttgtgaactctcatgctgtgaatgacggtttaggtttgctggtgcactgggaattgatctttgaaaattacaagtccagttaaaaaaagatgggtggccagacgaagaatctgagccctgtgtgcctatatgtgtgctaaaagtcacggagcttatgaaatctgaggtaatcttggctttttttttttttttttttggtttttttcttgagacagagtctcgccctgttgcccaggctggagtacagtgatgcgatctcggctcactgcaacttccaccctcccaggcttcagcctcccaagtagctgggattacggcacgagacaccatggctggctaatttttgtatttttaatagagacagggtttcaccatgttggccaggctgttctcgaagtcctgatctcaaatgatccacccaccttggcctcccaaagtgctgggattacaggcgtgaattgcacccggcccaatcttaagtagtttaaggtcttggggtcaggcacgagggagtgaaggggtagtgtgttacttatagccacacaataaattacacaaagttttagtggcttaaaacgtcacgtatttattacacagtttctgagggtcaggattctgggtttggcttaggtggttcctctagctcagggtctttcataaatgcagtcaaaatgttggccagggctgcagtctcaactgaagtcatcacggggggaggaggatctgcttctaagctcattcacattaatggattggatttagttgcatgccagctgttagactgagggcctcattttattcctgataattgtctcgtgtgggcctctccataaggtggtggcaagctagatggaagccagagtcacttcgtaaattaaccttggaagtgacattccatatatatatatatgtattttttttcccatattctgttcagtagaggtaagtctctgggcatgaatactaggaggtgtggagattattaatagctatttttttgttgttgatgagttgagggtgtggggaagaagaagaaggtataataaatttttatttcttacagtgtatacttagagtaggaaccagaatcacacagtagggtgagaaattttaaaagcaaagtttaccactaggaagctatgtgatgtcttacataggaagaacagcaaagcatctcaaataaaggaacataacaaaactttaaacattgaaaggttctttttctgtagttttaggttgaagttttatcttaattttctagtcaatatttttctacactgacttggatgaaaatatttataactgaaaatatattatttctttttacctattctttttgaaagatgtaaagacatattcttctaattggctaatagatttcaaagttcatgtgcgtcctgtaatgtgctaaactcatacattgtgtagtaacaaagttggagtagtttaaataaaataatggaacgatagctgctattctattcttcatgtttctgtgtgcatgtctgtgtgaatctctatctgtatctatagtttgatgtctaaaatgtttcccacagattttgtctttcatgtaattctttgaagaaagttgagattctatttgaaggaaactttccctggagtattaattttatgaataagtttcttcctactgccttaaaaaaatctgatattctagacatgtttttgttataggttaacattgtatcttcagtaatgaaacctttaaaataaaccttggttatttctaaaaagaacataaatttcagcaaataaattctttcctcttagcttcaaattaaatataacatgaagtataatgtggaaataatagaaaatatgtgaagaggtaattttgtggaactaatatagtttatagtcagaatctttctttttttagtagagtggttgcaagtccagacctggaagcagactggctgctttaagtcccatttctgcctctccctacagtatgtctttagtcaagttaattcacttcttgtgtctccatttcctatctgtaaaatggggatattaacggtacctaccacataaggttgttgaagaaataagcgaattaataaaggcaaagcacatagaaccatatatggcacttagtaagtactatatacatatccttattttttactattattagtagtattattagtatcaacactggctcagtaactgcttatgtcacttaattgtctctgggatttaggtctttcataacataaaccaagagatttggattctttataactgactaactggggagctgttagtctctattagatagtaattcactgataagatttttcctcattgataggattttttgtgcctacagttaaacaatactctgaaatatttatagacagttgtagagtgcattcttctgaaactgttggttttaatttttccaagtaacgtttgctttatctttgttaattagtctttcatattacaagaaagagcattgcttgaattttttctgtgctgcttagcagcaggctgtctttgtcattatgtggccagctagagttgcacacacagagcaggttcccaccctagataatctcagtcttactagtttgttaatatttctttcttttcttccttttttaagagagagtgtctcgctctgtcgcccaagctggaatgcagtggctcagtaatagctcactgtaaccttgcactcctgggctgaagtggtccttctacctcagcctcccaagtaggtgggactacaggtgcacaccattgtgcctggctaatttattttatttttcatatcttgtggagacagagtctcactttgttttgtccaggctgatctctaactcctgggctcaagtgatcttcctgccttggcttctcagagtgctgggattgcaggttagagccactgtatccagcctgttaatgtttctttttatttttttcggtctccagagcttttgtaagttttacaagtttctctgtctctcttatggttctaagaatatggaaattgtgcattctaattgtctttattattctctgtctccaggtatgttgcagatagggacaggttctttttaccgcctgagtcacatttattgaattttgcagattctatacttaagtaagaggaattcatgattgaagtcaaatagtaccataagaattattgagaaaagattactccctaaaaagattactccctattgaaaaaaagattactcctaagcacacatgactacatgtggtaggtacattctctaaagtactttttctacatactattgtatttaacctttaacgttttcccctattttaagagattttttcatcctgcagaatgacccaatagatttgctgaaatgttttcttttaaatcatgccatcttgcttttgatggtcatttagactgaccattttctttggtgaatctggatcagttatactagactgcatttgtactttgcacatgaatataggtgttgtaggacaaagagtttaatagtgccatattgatgtttttaccttttatttattattctatttctcagaaagatgaatgaaacataagtgtggtctttagaggaagttttgcctttctgcatatttggtgctgctgcattccagatggttttcttgccttgcagaaaataactttgtaggctgccgttatttgcatctgctgtttgtcagtggcattcacagtgtttttgttgtattcctcaatctctcagccattgtggcagaaccgaattgtaactagcaagcaaattttttctcctgattcttagcaagattttttctttctttttttaatggaatggcaaaggagataagtttctaatttggtctactggtgatagtggttagttagttgaaatcaagtttggtatccttaaaaatgacatataactttaaatatttatttttcatttatttttggaagcttaaacagatttttaagttttttaaaaagttttttgagatggggtcttaactctgtcacccaggttggagtgcagtggcacaatcttggcccaaggctccagtaatcctcccacctcagcctcctgaatagctgggactacacgtgcctgccaccctgcccagctaagttttgcactttttgtagaggtggggttttgttatgttgcccaggctggtcttgaactcctgggctccagcaatccacctgcctcagcctcccaaagtgctgggattacaggtgtgagccactgtgcctggcccagaaatttactttctcacagctctgaaaagtctgagcttgatgtgctggcagggctggtgctggtttcctctgaggcctgtctccttggcttgcagatggccgccctcttgctgcctcttcatatggatgttcctctgtgtgcttgctcctatggtgcctctcactctttaaatactctagtctctgttatatgtgttaattctctagtcttttgctgtaaagctttttctttagtgttagtctggtgatgagaactctatattgtttttcttcctaaagcatgccccagcagataatgacgtttcagctttggtttctttgaagtggagagagaacttagacatatgcaaagcattctgaatacagaattctgttagacttgtatgatctttttagtgacctaccttgataaagacttttcaaaacatttaacttaatttttatagtatttctgtatactcacatatcaatttatataatatttagattgcagacttacaagtacaattataatgaatacatttggtcacagacagctgattctttttgttttttgggtttttttttttttttttgagacagagtctcactctgtcatgcaggctggagtgcagtgacatgatcatgactcactgtggcctcgaactcctggctcaagtgatcctcccacctcagcctcccaagtacttaagactacaggcatgtgccattgtgcccagctgatttttaagttttttcatttctgtagaggtgggggtcttgctatgttgcccaggctgcacagctgattctcaacctctgggagcagaacagtgcagagtgatgagttgaggagctctgagcatttagagtgctagtggtatggtttgtggatgggaaggggaggagtggagagattgtccatttgggcattggaggtcagaaaaggaagctttcactgtcgtatttcagggctcttactccaagtttacagatgtttactttttatacttagtatctctcaccacttttcaggccacttctctcacaaatctttaattgggagagagacagtgccagtccttcctgggtttaacatctgatattggtagagatgatatgcacaatatattgtgagagcacaggaaataagttcttgttttgggggagtgtaaagctttcaagaagaggtgagtttctgaattctcaaggacagatcagaattagaaggtatctgggaagatgaaaatggggcagataggtcaggaagaggggaaggcgtgttattgctgtagttttagactattttgaacaccagtgtgctcccagcactaggatggtagaataatgtctggcacacattacatgcttaataagtattttaaagaaaaaataaatgttgaggaagacagaggcccaattatagtggaccctgtacgtgatgctgtgaagccagagtttatcctgaaatgagtctttgaggtatcttaaccagaagagtggcatgatcagattttatttataaaaatatccctctggaagcattgagagggaagaataagattgcagtgagagatacaggtaaggagatttttgaaataagccagttgaggaactagggagggcccaaattaaagcttttgagcattgagcattgtgaacaaagggtactgatgcattgtaggagtcttttggaaatagaattgacagggcttggtgactgtgtgtgtggagcagtgagggtcacggaggattctggagtgaaccctacatttgtaggatgttgtgatttcagagtggtggtgttggtgctatggactaggaaaaagctcgtctagtgcttaacacagtatatagcacatgctatttattgttcactttcctatttgagaaaatatgtttattattcgtatctgaatgcacaatctttttttttttttatatatatatattttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcactgtgttacccaggatggtctcgatctcctgacctcgtgatccgcccgcctcggcctcccaaagtgctgggattacaggcgtgagccaccgcgcccggccttttttttatatattttggagacagagtctcactttgtcacccaggctggagtgcagtggcgtactgttggctcacggcaacctctgcctcccaggttcaagcgaatctcatgtctcagcctcccaagtagctgggactacaggcacgaggcaccatgcctggctaatttttggtatttttagtagagatgggattttgccatgttggccaggctggtctcgaactcctgacctcaggtgatccactcacctcagcctctcaatgtgctgggattacaggtgtgagccaccgcgcctggcccacaatcttatataactgagctggtctcgcccacttttactatatgccaggacctgtgttataaatgtgaacaatatttgtggaatcgagttgaaacctaacacaattgtgtttactctgagcctctttaatctttgaaatgtcataatattgtagacatagcccaataaattgatatcagagaataagatggaaatcctgaatttaaaattccaaagtttttagtgttatttcttagtattttatcttctgaataaatgacatcttagttcatagaatgactcagtatcataacagacgtgatgctaattctctttctttaggatatattctcttaagaggctgatagtatagtagaggttattgtgcacatgttgataactcactacagactaggctctgtgctgcacataggggattcaagaagggatgacatattttccattttcaaagatgatgaagacatgtttctgaataagtgagttgggccatgactttcagtggtggtacattttaatactttacagcatatcacatactaactgggagtatcattaaaatgctaggtgcatccataatttttttcctccttttgattgcctcctcttttgcatcctgtctatctacagatcctttcttctgtacttgcaacatacatccccagtgctttcctctccctcctttttttctcgtctggtatttgtgcttctgttcttgattttgctgccactttcttgaattttttctctacatagtagctacagttatctttaaaatgtaggccgtgttctgcttaaagcccttcagtggcttcccagtatacacttggagtaaaactcaagtctttcccatggcttaaatattgcctcctcagagagtcttgtttgttgagagattaatgaatactctgagaactcggaggaaggagcaattagttctggctttgggaaccacagagagaattaataagaggaatagtatttgatccaggtcttgatgagtaggattttgttagattacagtaagtgctgaaaaagcatttaaagagtgcctactgtgtgctacatattgtcatattcatgctttctttgacaagtaatgattaataagtgatatctttgaaaagaaattgatatttgttaacaacttggttttactgcaatctcaataaatagtatatacaagactagcctagcaatccttagtctgcttaaataccaggaagcgcttcattcactggtacctgtgagaatagaacttggcaagcgttctcatcacatatacctgctcagtcaatttgacaatattcagaaatgaactacctgacaaaactacaaaattgtaatttggtgtcttggtttttagaccttttttcccttcttttaaaccagctatctctagccttttaatgccatattttattttaaaataccaaaattaacatcagaagatgaagtataattaactatatataccaattgcactgggtcataaaaatgaagtttttgtttataactaatttagtgcctgatcttcacaaaagtacagcttggtaatttactaatttaatcttttgcgtagtcgcttcactgactcagaatcttgaagactttgactgggcattcattttgaggcttgtcatgatgcagataggatggtagtaaaatgatgcattgctctagtatttgttcaccagtgtccatgcagcaatactgtctcttgtggctgaggccagccatattttaaagcaggcccttggctaagcatttcactggaccagggagaaacggggagaaaacaaaatctgcagataatagagggaattgtctagaaagctcaagttattgcatttaatgatttgtctttgttttgaaatattcctatttttagattccagaaatatcattttaaataagttatgtttgtccccaccaccgccccatcgcatacctgtcaagtagggcaaaatattggcagccagttctgtattgatttatctagtctgcttttgatgttcatggctccatgaagtctaaaactgcttaccaccaatttattttgtgcatcacacctgtaatcggagttagtatgtgagtagcttttttccttacttcaacagtctcttctcgagatttcaccagctgggtgtccaataattcagttcactctgacactgtgcagagttaacgtagaccccataggttaagggctcagttccataaggctgctcctacttcagataccagctgcaaatggagtgcccaggctacccacatctgcttagccaactgcaaatactgaggttcctgaaaccacccaacccacatttgataatttgctagaatgattcccaaaactcaggaaagcgcttcactattacccatttattataaaggatataatttaggaatagccaaatggaagagaggcatagggtaaggtgtgagggtgcgggggttgagtcttttcctgccctttccaagtgcgactctcccagcaccttcatatgttgatcaacctggaagccctctgaccctgtcattcagggtttttatggaagtttcattacataagcatgatcgatgaaatcattggccattgtgattgaactcgatctctagtccgtctcccttccccagttgttggcggggggcagtaatgaggtgggaagtgtgggcctgagttccagccttccagtcatgccatgatatttccggccacttggccccatctgaagccatctagaagccccttcagccaagaatcatctcattagtataccaaagacactttgaggagccctgtacccaggaccccaggccaaatacagttgacccttgaacagtagagttataaaaggtgagtagaggggtggaggaggttagggactctggcccccaagtgcaacttttcttttgtttttctttcttttttttctttttttttgagacagagtctcactctgtcgcccaggctggagtgtagtggcatgatctcggctcactgcaacctccatctcctgggttcaagcgattcttgtgcttcagccactcgagtagctgggaccacaggtgcacgtcaccatgcctggctaatttttgtatctttagtagagatgcagtttcactatgttggccaggctggtctcctgacctcaaatgatctgcctgccttggcctcccaaagtgctgagtttacaggcacgagccactgtgcctggcccaagtgcaacttttgaatcccccataacttaactaataatagtttactgttgagtagaagctttatagatatccataaacagttgatcaacacgttttgttatgttatgtgtattttataccatattctttttgagacggagtttcgctcttcttgcctaggctggagtgtcatggcgcgatctcagctcaccataacctctgcctcccaggttcaagcgattctcctacctcagcctcccgagtagctgggattacaggtgctcgccaccagacctggctaatttttttttgcatttttagtagagacagggtttctccatgttggtcaggctggtctcccaactcctcaccttaggtgatctgcccgcctcggcctcccaaagtgctaggattacaggtgtgagccaccacgcctggcccatattcttaatctagagaaaagaaaatgttatttaaaaaaacattaaaaaatcacaagaaggagaaaatatatttactattcatgaaatggacatggatcattatagagatcttcatccttgtcttcatgttgagcaggctgaggaggggcaggaaagaggagggcttggccttgctgtcttaggaagggtaaggtgggagaggagaaggaggtggaaggggaggcaggcacagtttttccagtgtaacactggaaaaaatactgaaaaacactggaaaaaaaaaatccatgtataagtggacctgcgcagttcccatgttgttcaatggtcagcgtacatggcaggatgtctctagtgagaagaggtcctcagatgctgtggaaaggaataagaggactgagttgcatttgtcgctaaaccctagcaggcagtgccatcctttcctggctgggccttgatgggggcttctctgagtgcctaatgtatttttttttttttttttgagatggagcattgctctgtcacccaggctggagtccatggtgtgagtatgattctcctgcttcagcttcccaagtagctggggttacaggtgcctgccaccacacccagctaatttttgtatttttagtagagatagggtttccccatgttggccaggctggtctcgaattcctaaactcaggtgatccacctgccttggcctcccaaagtgctgggattacaggtgtgagccactgcgccccaccagtgcctgatatcttctagggctacacagttatttgggtttagctaatcccttcacagtgtgccacatacccacatggcaattactacctctccaataacacctcagctcttacccatagcttattttttcttctctttattctcagctttgtttagaattggaaatgtttaacatttcattttgaagatttcttttcatcttcagaaaaccagttaattttttgcatttttgacttttcttggctacttggatatgttcatttggagaaaaaaagtagaggaaaactttggggccattaaagctaactttccttgttttagatttcttatacttaaaagaaaaaaatttttttgaggcatgaagtgacctgtttacaaaatgaggtgttgctttagcttatatgatcttactgacacttcttaaagggacatgattttattttatttatttattatttaagttctagggtacatgtgcacaacgtgcaggtttgttacataggtatacgtgtgccatgttggtttgctgcacccatcaactcgtcatttacattaggttatttctcctaacgctgtccctcccccagctccccacaccccaagacattatctcttgaatcttgggaatcttagaaacaatgtagctgcaaaaatattatttgaaaactggaaactactatcctgtattattctagatttgtttattgaattatttacatttagcagtaaatttgttgcttgaattgtaagctgtaagaggcactttgccttggcttgtttcatgtaatctttccatagggttatgtaaatgtcatcacatgcaaaatatttctgttgtgaatgatggagagatttttcaactgctactgacacatgccctttaatctatcttttaaaactaattcaagttttagtcattggcttgttttcattcccagaagtattttaccaaaaatgtcagtgcagcataaaaatgtagacattaccattgggtttgctgcacaaatattgttacaagttagtttttgtaaacatttttctaatggaaaattacaaataattataaccctgttgttctgaagcaattttattactcagtgctgtgacctttttaggccttcagtgatcctctgtcatcaaggacaagaataaaacacatgccatctcctgcaaagttgcatttcattatccctcttggatgggttaagaggtggggcagatgcacgagcaagaggggagagtgtgagggtgactttctgtttgagaatttttaggaaagaaccgacatgatttattgtttaaaatttttgagataaaattgatagaataagcagtgcttttgtgaaggatgtggttgcacgagctacttcagaggatttccattaatgactgttaagtctcaggagtatcagaaggcttgtctattgaggttgagttattttaattgggttaatagcatagagttgatgtgcctattctaatatcctagaatatttgaaagatgaacccattgcttaagatgaaattgagattatctttatattttattttaaatatagagacggggtcttgatatattgcccaggctggtcttgaactcctggcctcaggttattctcccaccttggcttcccaaagtgctggggttacaggcattgagccatcgtgcctggcgtctctattttatttatttgtgtatctcagtctcacttggtaacaaataattgagttagatgaagctaatgtttaaagattctatgacagaattggccttttcccctttaatatttatctttggaggctagaatttaaaatctagtggggtctttagaaattacctcattttacattttcatttttaaatgaagaaatttgaagcacaagatgttatcttgcccaaggcgaatgaggaatttagttacactgccatccattggttgttagcggccactccatgtctcaaggggcagatggttgattatcagacttagttacagactttagggcaagcctgaggataaaagtaattttctcagtaaagaaggtgttatcacagacaggtcatcagtatactaaacatgtatgcaattaagcaaataatgattaatttacacttgtattaggttggtgcaaaagtaattgcagtttttgccattaaaatagcaaaaagtgcaattacttttgaaccaacataatagttgtattcagtttagtgaatgaattagatactcaaatttagaagaaaccatttcttgtgttgcttatctaagtgttcttcgtggatcctgctctccttttggtcttttaattatactttattttttttggtttgtcttcaccattagactgtacacataaagacaggaagcctctgtcttgtccattattgtttccagcacccaataacagcactgatcgttgactgactcctaggtttgtgtggctatgtggaacacttagcatattttaaatattgcaagtttgaatattttattttattttttacagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtaaggctttactacaattgttgttaaaaatgatttagtattacaaaaggacttggcatattccgtaaaataaagtagttttaaaactgtaatcaaaatagtctctctctgggaaaaactgaatataaaattgtctctccaccctttctaccttttatgaagcctgaacttaaacgaagatttagaacaagttgtacaaaaatagaaatacaagttcttttatgatgaattttcattagattttctggccttcaattagtttttgaaatctaaagcaaattaaggacaaacaaacaaaactctacttaagtggcagattgtatgtttatggaattaatttcctgccaatgtttgggatatggggttagaggagggagttgaaagtatagatagtttcagaaaatactgttaaattcacatgtgatagaaaaatagtaggtattgaggttgctggaatagtttggcttttgcagttcatgtctggggcgacagctaagcttttactaattcctcgctctggatttcttagaaagtagctggattatctgattacttgatttcttgggccttaacagatcaacagcagtagatagaggaaaaggcagataagctcttactagcattaactatatactaatagtaagaacttttataaagagtagatttacaaaatactttgggaaaaaatatttaccaaagatgttggaatcaactgactttaaaaatcatcctgctacacatgcggaaagaatgtaacaaattttcttcttcattgcccagctgagctcttatgaagaaaggtaagttcctaggtttcccctacattgtgtggtagtgtggtgtaaacagatgctgcattagccctgggttttaggatggtgattatggattggtaagatttgtcatgtatgcatataggggctgtgggcctacgagaggttgggctgtgaaactggtattttggcaaaacaaacaaacaaacaaaaaaacacacaaaaaaactagcaatcttagaggggctacaccccgtagaaagaagacaagagaaatccttctatcagcacagggaagcaaaggagtgtgttgctttcttagctggcttagaagctcccccgagaaatgagaaactccttcacttaagcaacttaagccaagaaattaggaaacactggttgtagagcactgaaactgttggggcacgtggtaaaaacaaatgtggtgcctgcgtggagatgaactttcacagctctgagtcaatctgtggaaagagcaattctctgaatttaccagatttatccatttatacagacggtttcggcctgcctctctttctgccctctctggctcccttctgtctgtctctcccctgtgccccgccctcttcttttccctccttagtcttcctgcgttttcctctaggctccagtttccttgttgtgttgcacagcctttttctggtctcccaggctttttaccaagagccccctttgtcccatttgtagtccaggttctggggagcactgtctcatctttgtctttgttccagcagcgacttagtccagagataaatcaaatacaccccaagatgttattatggggaaaaaaaaagaaaactggacaattaaaattttgtagaaattgttgaaccttcttaatacaacattccaaactaatagctgtaaagaaactacgtttttggtaaatttagtgaattggttatttgaaagtactgatgaacaatcctacatttagagaaacaaaaaagaatatttgaagataatcagaaagaaattcttttttttttttattatttgagacagagttttgctcttgtcgcccagggtggagtgcaatggcgtgattgtggctcactgcaacctctccttcccgggttcaagcgattctcctgcctcagcctccagagtagctgggattacaggcatgtgccaccatgcctggctaattttgtatttttagtagagatggggtttctctatgttggtcaggctggttttgaactcctggcctcaggtgatccacctgcctcagcctcccaaagtgcaaggattataggcgtgagccaccgcgccaggctcggaaagaaatttaagctaggaaatttgcatatgaaataccaaaatttttatttctaggagaagtaaactatcctatgacttagattttggaaaatagaatgtttcttaaaacatttaaaaatttaaaactgtgcttctaaattgtgacattaagaggaaattattatgtatattaaaaaatatttagaaaataagaaaacactgagacctgagtgatattacatatagaaacctgtaggacatctaagctgtccttagatggacaagtcttaattgtatgtagtaggaaaaaaagggaaactaaaaaataatgagcttaacccaaagaaaacagaagaaaatattaaaaagatattaattaaatgaaaataaatagtatttgttaatacaaaagctgcttcattgaaaagataaactagctggcgtggtggctcacacctgtaatcccagctttttgggacgccaaggcaggaagattgcttgcccaagagttcaagaccagcctggtcaacataatgagactctgtctctacaaaactattttttaaaacccaaacaggccaggcgtggtggtgcttgtctgtaatcccagcactttgggaggccaaggtgggtggatcacctgaggtctggagttcgcaaccagcctgactaacatggtgaaaccccgtctctactaaaaaaaaaaaaaaaaaaaatagtcgggcatggtggtgcatgcctgtaattcgagctacttgggaggctgaggcaggagaatcgcttgtacctgggagcggaggttgcggtgagccgagattgcgccattgcactccagcctgggcaacaagagcgaaacaccatctcaaaaaaaaacaaaaaaccccaaacaactagccaggtgtgatgtgtgtgcctgtagtcccagctactcgagaggctgaggtggaagaatcacttaaacctggaaggtggagactgtagtaagtgtgattgtgccactgcactccaacctgggagacagaacaagaccatgtctcaaaaaaacaaacaaaaaaaacttgcagaatcaaacaaaaaaaaggaacagtacaaataaccaattttaggaatgaaaaaaagaataccactatagttactgaaggaaataaaatattataaaaaactttatgccagtaagtgggccattttgtagaaaaacgtaactttctaaaactgaagagtaggaaaacgtgatagacctacaatcatgaaataaataaatagtaaataatctgccccccaaattttaaaaagctgcaggagagtacagagcatttacaaatgaaatctaaaatgtcatgatattttctgttttatgcaaccattgtagagaatgatattttataaggcttgtataattttgatatccaaaacacagaacacgtttgggagaggagccagtcttcagttatgaatatatacctagatataatagtcctcaataagatattagcagaccaaatgtagtaatgagtaaaaaacaaaacaaaagcacttcttgatcaaatagggcttatcattgtttgccttagtaatataaggatggttaacattagataacttactaatgttatttcccaggagaaaacctacaaaagcaagaggttctggaaaaagcatttgataaaatttgaatcaatacataacagttctcatcacattaggcataaaattaatcttgttaagctgatatgggtagataatagaagcatacagcaggtatcttacaggattgtacagtgtcaagagcattcccgttaaacttgtgaataaattgagcatttcagctctaatcactttcatttagtgatacagaggaggtactagataacctagccatacaaagtttaagaaatagaagcagtaagaattgataagaaagaaacagctggttactcaccaatgatgtaattgtctgcataaaaatctcccaggagtatctgcggataaactattagaactaacaagattttcagtgaggttgctggttacgtgatcagtatataaaagccactcgcatttttgtataagcaataaacgattagaaaatataattttattaatataatgatacttaaggaaacaccatccctaagaataaatctaataaataattggttttctgtctttcattcttgcatttcgggttttttttttttgacacagagttttgctctgttgcccaggctggaatgcagtggtgtgaccatagctcactgcagccttgacctcctgggctcaagtgatccttctgcctcagtctcctgagtagctgagattataggcatgagccactgtggctggccatcattcttacatatcttaatggttatcagtctgttctaagtgggcacatgttgttataatttactaaatatctaaactttctatagtaagagctgttaaaaccacccaccatttacttacaaaattgaatatgtacaattatataaatatgttatataaaaaaatacttcattttccagcctaacatttattaagtgcttatgggtactatgcttgggtgtgtttttttttttttttttttttttttttttttgagacgcagtctcgctctgtcgcccaggctggagtgcagtggctcgatctcagctcactgcaagctctgccttccgggttcatgccattctcctgcctcagcctcccgagcagctgggactataggcgcctgtcaccacgcccggttaattttttgtatttttagtagagatggggtttcaccatgttagccaggatggtctcgatctcctgacctcgtgatctgcccgcctcagcctcccaaagtgctgggattacaggcgtgagccactgcgcccggcctgtgcttgggttttatatagaatatcgttcctgaccttgaatcaaagatgcagtaaagaatgggaatgttggctgggtgcagtggctcacgcctttaatctcagtactttgggaggccgaggtgagtggatcacaagctcaggagtttgagaagagcctgactaccatggtgaaacccagtctctactaaaaatacaaaaattagccagacgtagtggcgcgcgcctgtaatcccagctactcaggaggctgaggcaggatggagatgttaagcacataagcaaagaaccacagttaaatgtttcagttgtgataagtgtaaaatagagcacagtgagggcataaaagcatcatcagtttgttgagaagataggagaaagggtcatgtatgacctcatagacaggataagatagtgagcgaggtcacaaggaactgtgggtgtttactgcactgtttactctgttatggtcaggctaaaaatgtataggcatgtgtgagatggaacgtcaccaccagtctagactcaagctcactggttctgaagcacagaatttaggattatgatgtagtccaaacctgacagcatgctcagtggacatccaataagtagttattaagtgaacatactaattttattttattttattttattttattttattttattttaagacggaatctcactctgtcgccaggctggagtgcagtggcgccatctcaactcactgcaaccttcaactccctggttcaagtgattctcctgcctcagcctcccaagcagctgggattacaggcatgtgccaccacacctggctaatttttatatttttagtagagacagggtttcaccatgttggccaggttggtttcgatctcctgacctcatgatctgcttgcctccgcctcccaaagtgctgggattacaggcgtaagccactgcacccagcctgaaaatatttaattttaatacttttaaagattatttgcagtactgtctatcctcaatggttagatgagtgaaagaattaattcagattaaaaaaaatttgtttttgtttttgagacggagtctcactgtcaccaggctggcgtgcagtggtgcgatctctgctcgctgcagcctgacttccctggttcaagcttttctcctgcctcagcctcccgagtagcagggattacaggcacgcaccaccaagcccagctaatttttgtattttcagtagagacagggtttcaccatgttggccaggatggtctcaatctcctgacatcgtgatctgcccgccttggcctcccaaagtgctgggattacaggcatgagccactgtgcccaaccccagatttcaaatttttatattggaaaaaggaaacagtagtttatgtaattttgatcctagtaatattttccacaactttttctagcattctgttatgaacaattgaaaaagtaaatgtaacacatcttttctcttgtttgccattttaagctgtttgccaagcagggatattgatttgccttaaaatgggtcttctaattttctgataatgttaaaatttagtagctttgggtttctagtgtcttctaaggaattgtgacacccccaccccaatatttataaaaaccacatcaggagggtgggcacagtggcttgtgcctatagtcccagctatttgggaggctgaggcaggataactgcctagggccaggagttcaagactgtcgtgtcccatgattgtgcctgtgaatagccactgcactccagccttatggtaaaatgtgcataacatttaatctttttttttttttgtctcactctgtcacccaggctgcagtgcactggcatgatctcggctcactgcaaccttagcctcccgggttcaagtgattctcctgcctcagtctcccaagtagctggattacaggcatgtgccaccatgcctggctaatttttgtatttttagtagagacagggttttgccatgttggccaggctggtctcgaactcctgacctcaagtgatctacctgcctcagcctcccaaagtgctggaattaccatgagctacctccagccttggggggcacaggaagcccttgtctcaggaaaaaaaaaaaaaagttcagatttgcctaggttctagtaaacagagtgctacccatcccaaattgaggaagtcccaatggggatgtcctggtagtgtgggaaggctggctatggtgctgctgaacagccactttgactcggtgtctcctttggccaagttacagagcagactttctgggctagtcctgcttccccactttggctgttctcagggatatttctcccttctggcactcccaatgcttcccatggtttgagatgacagatgagtcttttgccgtgaacccaggatggtggagaagtttgttgtttaccttgatctcactttttccagtgtagaaggcgtgagttgggggagattttctgcgtgcttggtgccaacaggctgtggggagggccattgtggatatggaggtctgattctcttactgtctgctgagagcttttttatttctctgtgtctccaggaactgtctcctactcctatttgagttgtgggatattgctggtgctgtatacttgattttgttttgttggggtgcagggagagtagggaactattaggttggtgcaaaagtaatggtggtttttgccatagcttgcttctgcgctgccattttggaaccagatatttcacagttcctcttgttctggttacaaatttatgagtcacagcaggagactttaacttacttctgttagtaactgatggaacaggcagtcagaaaaaaaggtctgtaagaatgtatagaaggtttgaacaatacaattacctccctagcctaattgacatatataccacatacctttgaaatgtacgtcacaatttcaaaattgtatatatgcttggccctaaagaaagtgtcaacaaatttcaaaggattaaaatcatacaaagtgtatggtcacagcagaattaatctagaaataagataatagagaatcccataggtgtaggtgttaagaaatacctttctgaatagtccatgagtccgagaagaaatcacgatgaaataagaaaaattggttgagctgaataatgatgaacatgccacatattaacactaatagaatgcaactaaacttgtgattaaaatgaaatttagaggctaaaatgtttatcttgaaaaagaagtattgttgacttttcagccagaactcaggatgcatctcaagaaattaaataataggccattaaagccatatagaatattaatagaaagagggtaacaataaagataagagcagaaacaggccaggcgcagtggcttacgcctgtaatcccagcactttgggaggccgaggtgggcagatcacgaggtcaggagatcaagaccttcctggctaacatggtgaaactctgtctctactaaaaatacaaaaaattagccgggtgtgttggcgggcgcctgtagtcccagctactcgggaggctgaggcaggagaatggcgtgaacctgggaggcggagtttgcagtgagccgagatcgcgccactgcactccagcctgggcgacagagcgagactccatctcaaaaaaaaaaaaaaaaaaaaaaaaggcagaaattaatgcagtagaaagcaaacacactaaggaggagaggtttgtctctaaagtccttgtgagggacagctcttgaaaaaaaaaatggtttaaccattatgaagaaagaagggacatcactgtgaatcttacagacatttaagtgattaaggagatattttgagctactttattttagtaattttgaaaatgtagatgtagaaattcctacgaaaacactttaaagaaattaagactatcattaaaagaagtaaaaggaagaaaactttgtttagctggctctactggtggtgttcttttcaaccaatcctttaaagaacaccagtattacgtacttttttccagagaatacaaaaagaggatgcctatctttttgtcaactctacagtgccaattcattttaagtccagcattactttggtatcaaaacctggtatgaatacaatagagaggaaattacaggttaatctcactcataaaagtacatgtaaaaatttcaaacagagcaatatcaaacaaaaatctagagatttataaaaattgatatatgaggaccaagattgtttatcctaggaatgtaaggttggtttaatactagaaaatcatcagtgtaacttactgcataaaaacagaaaaaccagtcacctcaagagatgttggggaggacttgataaaatgcagtattcaatcatgatggaaacccttagctgtcaagtagtagggtttttccccagataaaagatatcaataaaattattacatgaaaagtcatttatttatttatatatttatttattttttgagacagagtgtcactctgttgcccaggctggagtgcagtggcagagtctcagctcactgcaacctctgcttcctgggttcaagtgattcttctgcctcagcctcccaagtagctgggattacaggcacatgccaccacgcctggctaagttttgtatttttagtagagacggggtttcaccatgttggccaggctggtcttgaactcctgacgtcaagtgatccacctgccttggcctcccaaagtgctggaattacaggcatgatccacctgcctggtgtgaaagatcatacttttaacggtttaattgagaaagctttccttctaaaatcagaaaataaagatacttgttatgaacactttttttcagcattgtattgttatttctagccagtgtatggagataaatacattgtgaatggattggaaaggaagaaataaagctgtccattgccgatcacatgattgtgtatttagaggaaaaaaccttaatgtaaattattaggaatattagaagattctaatacttagaactcgattaataatagaaaataataaatctaatgaaagatcctcaagacccctataaagatacttaagagcctcctcagattgatatgttagctttcatgcaacctcaaagtccccaaaatttctttggtagaaactgataatcagaatgtaaaactagctgcacacaaaggactgagaagagccaaagcaattttgaagaatgaaacaggaagacacactctaatggtcatctagatttcgtataaagctacaacagttaagacattgtagagttggcaaaaaggcatattgatctgtaggtgaaaatagagccttatagacacttgatttatgtgctgcaggcaaacctgcagcacagtgatagtgctggatcatttggacagccatattgaaacaaatagcaaacttgatccctacctcacaccataggcacagatcaattccagttggattggggatagaaatatgaaaggtaaaataataaagcttctacaagataatatgggacaatattttcatgaccttgtgattgagaaacatttgttaaacagggcactaaagcagtaactataaaggaaaagattgctaatttgaacagaatcaaagtgaagaacttacatccatcaagacaccgttaagagtgaaaaggcgattcatagaatggcataagatatatgcatcacagataaccaacaatgatatcatatctagaatatataaagggcttagaaatcaaagaagaaaaaagttgacaactcaggagaaaaatggacaagagacttaattcaagcagatattcacaaaaagagacatctagatacctaataaaaatcagggaaatgcaaactaaaactgcagtgataaagcattcatacccaccagaattgctaaaataaagactgacagtaccagttgtaatgttgcatagtatgtagaagtagcacaagctcttgtatactcttgtggaaatgtaaattactagaaccaatttggaaagctacttggaattttctactagagctgaacatacacatgtcctgtgatatttccactcctgggtatatgcccaacaaaaatgaatgcttgtttgtaccaaaagacatgcagtagaaagttcataacatcgcaatttttaatagcccaaactgcaaataatccaattgttcattaatgggagaatggttaaataaatatgatttatacaaacgactaccatagagcagtgaaaatgaacaaaccacagctgcatgcaacaagtggatggctcttacaattttgaggataagagagcagatacgtttaatacatgttgtataactccatttatataaaatccaaaaacctacaaaactcgattaataataggaaataaatctaatgaaagatacttaagacccctatatagatactcaagaccctcctcagaatgatatgttagtttttggatttcatataaatgtagtaatttatgatgttagaagtgtggctagtaccttttgggaggtgggaggagttaagaagaggggcttctggtgttgctgtttgatttcttaatcagggtactgacttcatgtgaacattcagagagatacactcttaggttgtgtatacttttttgtatttgtaaaacttcagcaaacaagttaaaatatatttaatgaggaaaatttttttttgttttgctgatttactttttttttttttgagacagagtctcgctctatcgcccaggctggagtgcagtggtgtgatcttggctccctgctaactctgcctcctggattcacgccattttcttgcctcagcctcccgagtagctgggactacaggcacccgccactgcgcctggctaattttttgtatttttagtagagatggggtttcaccgtgttagccaggatggtctcaatctcctgacctcatgatctgcctgcctcgagccctcccaaagtgctgggattacaggcgtgagccaccgtgcccggctgatttactgttttatggcagacctttgtaatcagcgaaaagcttaacttctatcagactgatatttgtgtagattttacccagataattgtttaagcaatttttgccaaggtctgttaggaacacatttgaatgaatatatacaatcagcatttgttgacatccttgattttgccaattattggtttgactttataaagaattattattttttaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacaggtaaggtgcccatggtttatttgtattttctttctttttccagagacaaagcaaaactgaagatttacttgtattcttgaactgaagtgccatgtgtatgttaaaacaaatgtttgttaacttttagatcttgtatatatttgaagtagtttttgaatttttattttctatagaaatgtgaactttttattgatgataaatgtataatctagaaagataatcctgtgagtttagttctttttaattctgtaacccttttatttgaagtatttagatgggtttcatcctgctttagaaacacttccgttgcaagtacatgaagcccagagaatatgcagtggataggaattatgcttatttatcatctttgtgtaaagaaacacatgttttctgaaagacatttttcaaagcatggacttgaagtaggactgggtctccttcccagtaggtaaaaatgtgattctcggtttttttaaagattttaggagtgccctcaggtggtatcagtcatgaattgcatctcctctgatagtgcatattggttagaaatatatatagaaatcactttttaaaaaaatctcaatttttaaaaactgtacatatgtcaaggataagctcagttttgtcttggtttaaaaaatagaaaaatgtaccagtgtgtggttatttctttgaagagagagattttataatcaggaaataattgttatacatgaaaacacaaatatgattactcttgcctatattgtatatttagtaatgattttaatgatataaatgtactgtaaacaatatatattttaagaggaaagagttgcagtcagatgaaaatttgatactttgttgaaagtgtagaatatcaaaatctgttcaaaatctgttataaatacattaaacaatgtatatgttgccttatactaaaaagggttgaagcatctagctggtgtgttagtctgtcaaatactaatttcagagcaagaagacattttgggatcttgcagaaacttaaagttgttatgcctttagatgttttgtatcagatcttcttttgaggaaattaatatcaatacataacttatacataggttgcatattttgtctagtttgagaaaataaaccactagaacttggcctggtgtgtctctaagtccagaaaatagcataggaaagtctgtatagtcttgtatgtaggtcatttctctaagtctctgtacttctctcctaggtgtcagtattttattggcatgctatcataggtatagaattgcttttcatttactgtagttttaccatagggaagaagctagaattgtgattctttttttttttttcttaatatcttgttggataggtcagttatgtgataaataattaaggtaccaaagtttggagagtagacatttgactatcccgtgttttagaacaaactagcattatttttatttctaaactttcaaaagtgtatccgttgatattagaaactaaatgttactgatattaggaacttatattggaaactaaatgttccttttttaaaagtagttaaaattttattattcctcttgtcattgacttttgatttttagtttttagccaaatggaaaggattgtttctctcaatgagtagtcatatggtttgatttcaaaatgcaaatttatttatttattttttgagacggagcctagctctgttgcccaggctggagtgcagtgacgcgatcttggctcactgcaacctctgcctcccgggttcgagtgattctccctccttagcctcccaggtagctgggattaccggtgctcaccaccacacccagctaatttttgtatttttaatagagatggcgtttcaccatattggccaggctggtctcaaacttctgacctcaagtgatctgcccacctcggcctcccaaagtgctgggattacaggcatgagccaccgtgcacagcctttttttaaatcttgatcttttcaaattaatgaatcttaatgtggagagactcaattacattctctattgtaaggtaataagcattaagaaacaatgttccacattatagaaagtttggcaaataggaaaatcggccatcattttacaagctacacaagcattttagtgtgggaaaaaggcttcttgttagatgattttgatactttattctcagtcacaatctcaaccactcatactaggggctgaggaaagagagataatggtggaagaaatgagtccatcacagctgcctcctggtattgtggatcagtcactggcaaggaagcttttagttctgtagtttttcatcatggaaaaaaaaccatatagaatggctaagttctaaatagtctgatttacttagaaaatgactgttttcataaattactgtagttaaatactatttcttatttttgatggccttaattagtgtggaagtagaagcatgggagagagtaagatgttaagaatcagggccgggcacggtggctcacgcctgtaatcccagcactttgggaggctgaggcgggtggatcacgaggtcaggagattgagaccatcctggctaacatggtgaaaccctgtctctactaaaaaatacaaaaaaattagccgggcgtggtggcgggcgcctgtagtcccagctactcgggaggctgaggcaggagaatggtgtgaacccgggaggcggagcttgcagtgagctgagatcgtgccactgctctccagcctgggcgactgagcaagactctgtctcaaaaaaaaaaaaaaaaaaaagaatcaggagtgttcttgggaatagatataatttcttacgcagattctccagtgtagaaaaggtatgtaccctaccccaacattatatgggccacctcccctttatctaaacaaacatacccaataatgtcacctctcagtttgatcataccctgccaaaaatctttgctttggattcacagccaattggctgctgaaatcatctactgtctttcttccaaaaccaagttgaaaaagcttaacttacatctcccttccctttacaaactgtagcctgataaaactgatgagaagcagaacaaacttattgataaagcaactacaaatattagtcttgcctgtttcttaatgttttaccacttgttaaaacatttttccatattaaacatttctgtttgtatttttatttattaggtgctaatatcaatattatccactgttgtcatcggctaatccttctcagtgattttcagactttaaaaagttatggacatttttgtgcaaatgagatctttggtagttcagtgtataaatggacagaaaatatggagcttctctgattgatatagggttccggatccgcaaccactgagatgcctccatggttctctagaactgaatttgaaaattactagctcacgttttgtgctaaaaccaataatcacataattttcctttcctcttcttccgtgtcccctacgtcctcaaattttttaaatttataaaaaacagctttctggggggctagtcataccaacctttacaaggtgctctgtgtgtttgtgtgatatttcctttttttaatgaaaatggtgggtggcagaaatgttttcctttattttgtttttaacttggtatgcaattatctaatatactggaaagtacagaaggtgctaaatacagtgagttatatttggaagttaaaaaaacacaaatcacatgttctaacatttttgaaaaagagctgaattagtgctcttccttttataccaaatgctacagtgtattttttcctttctccatggaaatggattcaattttaaatgggtgtattacctaaagtgatatttttgatttctctattatttatccagtacatttatagatttttataggtaatagttatggattatataaactacaaagttaatttttgtgataattggtggaggcaaatttgcccaacttttattttcttaaaaggtttaaatcatttgaaaataggaaataatttttaaatccaaaaaaaagaaaattatatgcataaccagtaagattatcccactgcttttgttctcagccaagatgaagcatgccttttcaaaaagaacaccccaaaataagtattttaccattatctaaaagactacttttgctgggttttattttttaatctattgaacatgagaacatggtcaaaagtcataccttccttatggttgaaattttctagaggttttataatattgagatttcattttttaatgataatttggcctgacataccttccagtatgtacatttgtatgagttttatcacagcatttaaaaatctctttatgtttggaattaataggattaaaaaaatctcagtagtttctagaaatactttatagtgacagttttgttttttagtcttccagattgttgatattaatgcaaacaatattaagcttatatcacaaaaatattttcagtaaagcgtattttttataaactgtgttaggcactgggaataatacaaaaatgataaataaagcctgtcccttgcctgatgtcacagtcgggctacagctgccagaaacaaggccagcaaaattaggatacagcttgcgaatgtagtgtgaagaaaggccttcggaataccaaagaaaattctagggtcagggaaagctttgaagagaaggtgatgtttcagctatgtttgaagaatggggagggctcatcagtgatagaacattctagataggtttggaagcatgagagcatggagcaattgggaaataacaaatatgccatgatgtggcttggacatgagaatttatgtggtgggggtcaggagcagggcatcccaagagataaggttgggaagggcctagtgctgacgagtgtgcatgttatcatggaggtggtgaagagtcattgaaggatgctaaataaaggattgatatgatcaagtttgtgctttaggacaagtgtggtgagcatgcaagtttacaagcatgaagatcaattcaggacactgttgtaataataccggtgagaaagatgaggcctgaactgacaaagtagagagaggagaggagcagaatgaagaggaggtgaccagctttcatttagtgctggctatacctgccacggcagtgttctagctttctacctttgtcctcacatagaaattaaagccattctgaggcaggaataatgatctatttattggtcaccttctgtgtgcttggtcttaatctggcgtatacataaccaatcatctttataacaaccctacaaggttggtggtattatccttgttttagaaatgagattggcacttacagaaggtcactactgtagtgatgcgaggacccacagctagacagtggcattagtggcttttgtaccgaggtcttagaactcaacctcttttctctttgtcagtaagatgtaatgggcaggccgggaaggagagaacagtgttttaaaatgatgaccaggtgtgtcagtttgggcccccggtaaagatggtcctgttaaccagagacagagtgaaagaggatggaagaggaaatactgtgctgcagataacacatttggttctggatatactccatttgcggttctttattaatgctttcatgaaatcttaaaaatttggacctgaaaagaatcccaaagataaccctggacaaagttttttagtttagctttccgaaacaactaatcttattggagaattaacattttgaaccctataaaacctatctgtttggccaggtgcggtggcatacacctgtaatcccagcacttagggaggccgaggcgggtgcatcacttgagaccaggagttcgagaccagcctggctgatatggtgaaacctcatctctactaaaaacgcaaaaattagctgggcgtggtggcgggcacctgtagtcccaattactcgggaggccgatgcaggagaattgcttgaacccgggaggcggaggttgcagtgagctgagatcgtgccactgcactccagcctgggtgacaagagtaaaaactctgcctcaaaaaaaaaaaaaaaaaatctgttcactaagtattaagtgagtaacaggtttggggattgggtaggtggggacagtcttttcgtaggtctgcctgctctactttcttctcatacttacctctcacagtcctcccttttgtgaatcacagtaatgtgaggttaatatgtctgttgtcactcccaatttccaattagaaaggttgacatggagagctgggatttccccaggctgtccatacctagaaagggaggcacaaaggggattgggttttcgagccttcaggccatttatttttactgcgtttgtctggccttcagttcaagatcttcaaagcatttttaaaaacgcctttgagggaagtcagtttagagtgagaaattaggaaagcaaaaatttgaatttacttttagttttgtgtttttaagtaaactgttaaggtctttattgtgatttagtagaaagaacttgagtttagagtcaaaagactctagttctgtctctccctctggtgctttctctaaagctatttcctaatttataaaatgtgagtcatgagaatatttatgtcaggatatcatgggaattaaacaaggcaaaggcatagtattaaactagaaaatgttattttgaatgctaatgtccaaaaaaaaaaaagaaaatgaaaattctatatggattaacttagaggaaaaaaaaaaagtaggctttcaaattttctccaacatctgctttgtcttaactgcccggtaaagacatatcttttgggtgttttctttttttctatagacaaattaattcatccatcatttgagtgcatctgtatgccagcgcaaattagacacaagtcttgtcctcacagatcttctttctcctcttacaggggaggtaaggcacaaccataacacacaagagaaaccctgtctgaggacagataacatactgtattgggtgtgtgaaggggacgagccgccttctcactggagcagccgggaacatattagtgacaagctgactttcaggtctggattttgaaagttggacatactgtaggcatgggaagatgagggggaaagacatatcaggcctgaggaatagcatacctgtacaaaaagtgggaagaatgagctgtgtttgtagagcagggaattgtttggcctggtgggaataaattcagaaaggtaggtgatcaagaagggcgtttgagacctttgggtgatagagattcagtgtaagttttcaagcaagagtgataatgtgagtaaagctgtactccagaaagctagctgtggtttgaaaagggagctactggaggctgtaagtcaagcattcagttcctgagtggaggcagaaatagagaagaaaattcaaacagtggtagaatgaggtgaatttaaacaggaaaccaatgtggttctgattgtacttcacttaggtaactttttcattaagaaagaattctggctacctattctcatatgttaataatagaggtcttggccgggtgcagtggctaacatctgtaatcccagcactttgggaggctgaggtgggtggatcacgaggtcaggagttcgagaccagcctgaccaacatggtgaaaccccatctctactaaaaatacgaaaataagctgggcatggtggtgcgcacctgtaatcccagctactcaagaggctgaggcaggagaatcacttgaatccaggaggcggaggttgcaatgagccgagattgcaccactgcactccagcctgggcgacagagtgagactccgtctcaaaaaaaaaaacaaaacaaaaacaacaacaacaacaaataatagatgtctccgggaaagtatcatatatgtttgaatataatgtgtgtgacacctaaaattatttctactgtatgaagaaaatcagtactttgggagaaacaggtaaaaatgaaaatgtaattcagcatcagtttgagtttcactgtgagcctcagtccaggttttagaaagaaaggtacgtagacacaattctggctttaaatagttcacaatgtggcaaaagaaacttcattaatttcttaagattaatgataaatacagtttctttgggcagattgactctaaatattgagttcaagggggttaattacagtataaaagggtttctagctgttgaaaaggttgggagctactgaattaggcctccagatcctgtggcctacctgttatacctcaaagcctcaattttcagccgcttccttagcctttctcaaccagggctgtgagacagttaagctctaaggaaaattgtttgagtaactaatatcagttctcccaaggactgtatttaggtattctttacctaccatggatgtgttagggccagactctcttggaaggatgcttctcttctgttctcttcccttgccctctccctctctttatgcttctgttttgtgatcccccatttacacacaggaacaacctcaaagttctgggttggaattgggaccagaaaatgactatagctttatcttctaatatttgtgttgattaatgcttgaaattatatctaataattcatagtcactaaaaagaaaatttgagtgaatatttgatagtagcttatcctcttaaagtttacagacctcaggccaggctgattctcattagggccaggcatgctggctcaggcctgtaatctcagtgctttgggaagatctcttgaggtcaggagtttcagaccagcctgggcaacatagtgagagcctgtctttaaaaatacatatattaaaaattaggtgggcatgatggcgtacatctatagccctagcttcttgggaggctgaggcaggaggatcacttgagcctgggagtttgagtttacagtgagctatgatcacgccactgcaccactccagcctgggctacagtgaggccctgtgtctttaaaaaaaaaaaaaaaaaaaaaaaaaaagtttacagatgtcctaatcattagagctaataaggcctaaattactatgtacttgctggttctccatgttttaattttcctttgggctaaatcaggtgtaaaattgggaatcttgaatttaaacctctaactcagggattcaaaaagtgtggtccatggcaactcttgagggtccccttctggaccgtttcaaggatcttcttcattatacttcagccagaacagcatgccacagcacactgaatacaaaagcaattgaaataatctagctgtctggattattatttaatatttagtgttaaatgctaaagagatttgtaaaaccatggcattctaatcacttaatatttttgttctgagaaatagttatttttcattaaaatgttattttaaatataactgctttttagttgttttaaaagtgaattcctaaaagttaaaacatgtaatttagttatttagtacagtaaataatgatagatgtaacccacataagcaaaagctctttagggtctttaataattgttaggaatataagtggatcctaggaacaagatctttgaaaactactgccataacttaggagggacagctgttcactaagaatgggatttctatagtctttttatcttttccaaacagcctagcaaagcaaaaaaatcttaaaggccgtgtgtcagatgggcttgattattccatattttctgtctcttcaatgtagatggacatgcctagctttgcctgtaacagagaactctttcttcctgtctttttcctttctgtatttcatcttctctcctcccccatgaggacattatggagggctggccagaagtgggactttgcaagtcacagaagtggcaaaaattattcctaattgctgttatcatctgtcaatgaaagggaaaatgtaggtctgatggcctttttgatgcttaatatataaaaattgcccagcaattagctttgtaaccaccatctatttaatagcagtaactgttgttactagctgtttctagctctgtctcagtcagtacatttgtgatttttctttttgtgattttttttgtgattttttcataattatatctgaattacatattcatatatgtggatttataaattgttcatactaaattacaataaatacattttaatatattaacttctatgacttttaagttcttgttcactaactgtctgggaaagctgctttagcttatgaagcctcatttttcatgagcgcagcttttagtcttacgttgtgggacttaagacatcttgtcctgccccaaggtgggaatgattaaatggctaaaaagaggcagatactatttttgtgataaatatgggtttcatgtctcatagcaagttattttagcctggagtttgttgtcatacagacactatattctgtctgcctttcattcccttttctctacttccttgtttctctggcagttaggcaccttataatctattgtctgatgcatgtccagctagtgacttcagttcttccaggcttattttacaataggcttgatctttattcagtggtgctacaatgacctgaggatgtcatctgtgattatttgcatgctttcttacatgaggatagtaatttgcatgtaattactttatctttattcatgaatttttatcctttattgctcataaattgaagaagcattttgctggatgttaaatagtcaaaaattgtgatacctctgtgtggaacattttcctcttaaaacaagaataaagagaggctttaatagtctgtcttgttttccactgatgataagagatgaattgcaggaaccacttccactctgatgagaccattcacaacacacagcagcagccaaacctgttccacgatttttacagcttaatctcggctgtgctttcgtgcatttggaagcgtgatggtgccctgtcaggtcgcccatgtgcatattttggggcattgcctctgagttaacattgggcattcctgttttcataatctaggtaaggtagaaaaattctaaggagtcttttgaagatggtgttgaatagcagtatctttgaagttagttggtatttcatatatgaaaaatattgtgacattatttcattaatacataaaaaattcctaaggggtagatgctgttctaatctaagagaagaaatgctgtagttaactggaattatttgtattcctgttaaggtactatgttacatgagatgagagaaacaaataattcaaaatttttggtcttaaggaggctgttaattgtgtagatagtataagtcatggtcaaaaatatccacaaggcagtgtaagtaacatgaatggtgcagaatggtagttaggaaacaaatatagaatgctactcatgtaaaggtaccaaaaataattcttacaaggtagacctgctatttatgtgagcttttgtaatttctgaaatgattcacatgagaaaacaaatgacttctgtgttctggaaaatttcaagagtatttggctattacattgtcattcatgtaggaagaaatacattttttatgaaggagtttattttgcaaatattatcctgctctttgctgtggtaatattgtaacaaagagaattccttttcctattcagaaatactcactggtttcccattgatttaaagttttcctcaagccttgaaatcagtcccactttgaagactggatgaatgatatgggtgcctaggaaatgtgtctccagtctcttctgcagataactaatggaattagccttatattgctaggaagatggtagagtgggtttttgcataactattgtagtatgcagcaataaccctgcaatggcttcctatcaatcttagaataaagtacagaacttttttttttttttttaagagagagtcttgctctgttgcccaatctggagtgcagtggtgcgatcataactcactgtaacctcgaattcctgcactcaaaggatcctcctgcctcagcctcctgagtagctgggactacaggtgcatgccaccacacccagctcatttttaatttttttgtagagatgaggccttgctactacattgctcaggctgctcttgaactcctggcctcaatgtcctgcctcagtctcccaaagtgttgggattacaggcatgagccactgctcctggccatctttaattctatttagtaaatcccatgtgagacaaacccagtttatttaatttttatgtattcaaccaaactattttaatagaattttacatatttttgaatttcaaaaagtaaatgtggacaattttgtcatttaaatattagctgtcttgtgttgttttagatagaggttgcttcttggtaagcagcttcttgaaataccaggaattgtcacgcagagagatagagaaggcaagggcaataggattcccatggaaaagggagacagctgtctttgtttaactaggacagtcctggtttttgatgaaccatcctgaatggatatgtactgagagagtcatgacctaaaaaatgcctttgggtttgattcctcctggaaagtagtgtgatggcagaacagccactgtatgccttctctcaaccagctctggtgtttggaaaagggtattcaggtcctggctttgcagtctttccaaacatttggggtcatgttggcgttattcatagagtcacttcattctttatgtccagttctcttgttagaaactagagctaggctaggcgcagtggctcatgcctgtaatcccagcagttcaggaggccaaggtgaaaggatcacttgaggtcaagattttaagaccagcttgggcaacatagtgaggccttgtctcttccaaaaaattaaaaagttagctggttgtggtggtatgcacctgtagtcccagatactcaagagactgaggtgggagggtcacttgagcctgggagtttgaggttccacttcactggaactcaccattgcacttcagtctgggcaatcaaagtaagaccctgcctcaaaacaaaacaaaaaacaaactagagccagttagagctctgtccatctagaaccactcttgttaacagaactgtaatttccacagcattttgtttttcaagtgagaataagttcttctgatgataaagtcgtgtgctatttataaaaatttaagcagtataggaagcatgaagaagaaaataaaaataccgaaaattccaccaatcacctctaatacttttcaaaatggaaaaagcagtaggcattgggatatttttaaactttgtgttataaacaattgtgagatgaagaacagatgcacagcatggcacttgttattttccgtaacagctttatcgagctttacttcacataccatacggtttacccatttaaagggtacaattcagtggttttagtatattcacagggttgtgcaacctttgccacaattttagaacattttgggttttttttttgtttttgagactgagtctcactctgtcgcccgggctggagtacagtggcgcgatcttggctcactgcaacctccgcctcccgggttcaagcaattctcctgcctcagcctcctgagtagctgggattacaggcacatgccaccaacgcctggctaattttttgtatttttagtagagacggagtttcaccgtgttagccaggatggtcttgatctcctgaccacgtgatccgcacgccttggcctcccaaagtgctgggattacaggcatgagccaccgtgcccggccaattttagaacatttttaaccacaccagaaagaaaccctctacccttaagtcattgtccctttaccccaattcctccatacctcccagcatctggcaactactaacataatttctatcactgaagatttgccagttcttgacgttttatataaatggaatcataaaatatgtggggttttttttgtgactggctttcaattagtgtactgttttcagggctcatacatcttgtagcatttatcatgcatggcattttgaaaagcaaatcttagttaaaaaacatgtatttatgtatctaggcatgctttcttagttttagttactggctcttattttaattgtgtgagtgtggtgtatagtgaaaagtaatggctaaatcttaagaatttttaaagcaaagattaaaatcaaagcaagaagccttcctcagattctttagttttttttttttttttaaataaacgttttaaaacttggtaaattatgtaaaggagaactgtgtagcattttcaatgccagattgaatgtaaacagggatgaattcttgaccaaattgtggaaatgtctgaggtttattctcttggtccaggctcagttttcttgcccagaattgccctatcttcactgccttcattttttccccacccctaagtatgttactgtagttatcagaaacctcatgcctttgtatttctcttaattctttttttctcctataaaagtgggagaaaacagacatggtctttgaaagtctttttaaattacttataaagagtaaaaacacctatcttggttaaaggagattcagttttttacatgtggataagagagtgaaattgtgtttccttaaaatgatgtgaggtatcctcttatcttgaacgctatggaattgggtgcctttatcattttcccctgaaacttccagcttttaggctattccaggtttattttctctctgttgcccactcgcatccagagtgaaagaaacgaaaacaaaccctctttcttttgtacccaaatataagtttgaacctttttgcttaattttaatatcattctaaaacttttctcccgagagtctttagacagatttctcatatttcctaggaaatctgatattatctaattttatatttatacttctctcctttcaaatctcttgaagtggctaatcagaaaaaagcatatacaataaaacctgaagtaggaagtgagattccaagtgaaagaagaactaattattttagttttctgagggctaatagtaactctgagtgttgactgccagaaagttctagttggtacaaaaagaggcacgccagttgagcaagagaataatattagaagtagaaggcacatgcatgtttcagaaaggctctgcagaggaaaggtgatacagcatatttgagaaattgagagaccggtgtacctagagcctagagagcaatagagtaggaattggatgagatacgtggcaatcacatcatggggggcaagcactggattttggtatttatcttaagagcagtgggcagcaattgaagagcttttactaagagcgatgatttgggttaattattaaagtatcactggctactgtggggaaggggacagataccacgattggaatgggcaacttaattagatgatgctaatgtaattgtctaggttggtggtctctcagtttttgagcttatcccctcatacatgtgtgtttatcatttatatatatgtactttgttgttgacaagttgagtacattataagacgttaaaaaacagtaaaatggatgagaaaaattaatgaatggaagtgctactatttttttccctgccccaactgatgtatgttaagcttctgggatacttgttgccccaccctgaacatgactaagcaagggatcatggaacaagaacagtagcaatggagagagtttggagagagaaattaggaggttgcattaacaggacttgaaaattggttaaataggagtaaaagaaaaggtagtggatttctggtttgtgtaactgaacagataagagctctgattaaagagtcaaccaacactctgatagatgctaattgtgttaaagtagcattctgccagaatgtggtggtttctctgagcatatactcaataatgcccttagtaacaaatggtaggagggcatttgatgggcaagtcttgatctgtgttcaggaagaggaagcagagcaatgaacctgaggacacaggttactcttgcctttggaggcattagggtatgacagcattggtaaatgataggcccctcaacttccagttgcctcttcaagtgtctttagctagaggcagggccattcatttcacgactaaaaataaacggcttacaaaacatggtggactgaggaacatattaagactattgccagtgcagacaaataatttttcagcaagttatcaactgatagaagtgattttcatattggcttagaagggaataaaatgcattcgggtcataagttgggagaggattgcaagaaataaaggatgggaaaaaaacccaatcatatatacagttttgccttaaggttgagtgaaaaaaaaaaggcgggggggaagatgtttatgatggtacattttcatgtgtagctatatatgcacgatgctccatttcctgagatatagaaaagtttttttatcacattttaaaacaaaatttgaaataatatttttgaaaatgtttcaaaatgccactttaaaaatgcattgctttgaataaaatttactgtttgtaatccttatgcctcctagcacagtgccctgcaatgtggtaacttttttttttaatgcagcaactgtaccactgcagtatctgcctcccttctattctagatacctttgagcaaacgtaaactcatttgctttcattctgtctcaaaaatgtattgcgtagaactttgcaatcatgagagaaatacctggggacattactgatggtccgaagtgtgaacaccactaatttagatgctgatgttgtgatcactcacccagtcaactgaccagccttccagagaatgcaaatcagattcaagccagtctttaagcaaacatctcatttaatcgtaagaaacaatgctgagatgggtcatatccacattatcaattgccttgggactaattgctaataggagaaactgctggttgtgaaaatcatgaatgcagagtctactgtagtaattatatacagtaataaaatacagtcatgccaatcaaatctaaacagcctgtcgttttccactactgctaacttacccagcgtttctacatttccctgcttgtacaaaacgcctaatggtaaagtatgttaaaggcaggggtaagcctgaaggatggctgtttgacaactgcattagcgataaagggacagccgtgaaaaaaaaaaaaaagtcaataggcctaacttaaagagaaatgtcctttcataggtaaaacgtaaggtttatgtaacatcagtgctagtgttaaaaagtatgctgaaaacatcgtattactgaatttactcaacctggacaataagtgttctttcccttattctgctctgttgccctgactgaatgaagaaagagttaatggtatcagtattaagcaggaagttctgttaggcttatgcatatgatggcatgaataatttagcatcttcaggaaatgcaaactgcagtagaatttaagcaacctatcagaatttagatcaatattttacatgatagtatgaaattaaagtcagtggaaagaagatgcttaaagataccaagtgaagaatgttaatagtttaaactgtgagaaagactgggaattttttattggaaatgttttgtcttacgcagcaataatggtttacctgcattctgacacttgtcagatgactttttgccaacatgattggtaatgggatgtggcagtatctttgctgtcaaagaagagataatttctcaggtttttcttgtaagttttaaaaattgtccttatgggtttttttttctctttaaatatggaataaaggaactgaagggtaaaacctgaagactagtcatgtttctttaataaaggttttatagaagtagccatttgcaaacgtcggtaagacagatttttaaaaaaacagtttaaacttataattattgaaaatattctaaattgtttatctcctgtggaatgatctcattagcttggtagacattttatgtgtacgcctgtggtctttctatatcttatgtcattactgtaaataaatattgtgcatgcaactttaatagattgggtggttggaagtacttagcaaaggtgacatttatcaatcttattttgtgtttgcaaaaaaaatacagtgtatgtaatattttcaaagcaagacaattggattatgttaaataatttctaaaaatgatgaaaaattctcttttatttaagacattaccatttttagatgtgtgttatttaattataaattggtttggttctgatttttctaaaacttttagttagcatgagttgtatgttttaaataataacagtcttaggggagatctaaaacactgtcttgtttgcctttatgtgggctttcctaagccccagtgcattttaaccactaattgtttcttggttaataccaacggaaaaagaaaatctttcccatgctgaaaataatttcttcaggattttacagaaaattattgatgtaaagttttggatgtcactaaagtaatagtaaaaaaaaaaatttacttttgtttgtctcatctcaattttgagtgtcactttgatttcatataaacccttccccttttcatagatcatcaccttctcattgagttttttctcctaaagagaatttacttcattgacacttaagctaaaatttaatgtaaatagcctaaataaatggctgtttgatctggccacacatttttaataagacattttgtcaagtatgtatatatatattgagaaaaaaaatagtaacatgtggcttggtaaaaaatgaatagctgacttttagcaaaccaaagatattcttattttgtatcagtgaatataaaactctttattgcagtgtgccgtttataatggctttggtctctttccaactagtaggaatgagttaatcttaagcacttccaagcttaaatttttttcagattcaattctcctaaatgagaatatagatcttgtgaaattaacactaatagccacagatcttggcttcctctaccttatcttcattgactttaaaaatatataaccctaaaatgctggttgcactctttgaccgtataacttaggaaataactaagttataagtgcatcatttgatctatggctgcttacagggtttttccaccaaaaaacgattgcataaatttttttaagagcctatgttaaagaggatgcgtttttattaaattacagagcttccaggatgaggatctagataggacgtatgtataaatacattttgaacatttcaaagcaccttttagtttatgtgaagttcttcagatggccccgttgtccttcgaagcttctaacaccaaggtgtctgttgcagcccagagcaaggttactgctacccaggacagcactaatttgcgatgtattttctgtggtaagcaacattatgtttacattactttttcaagctgtggtacatgctacttgcgcatttccataacttttgttttcttaggccatagtctggtttgtgatatttgggatatatagcaagctattgtttttatgttgtgatatttgttgtggttcatgtaggtgatttggtcagctttgagttggcttgttagcgagcattagaattagttagaattaggatcttaaaacacttcttgtccacctcttccaacacaaatgagaggggtttttgtttgtttgtacttttttgtttttaattattttgtttgggagcaaatttttgatttagaatttaaggaaaaaatttatgtccatcttaatatgatttgaggaacgtaaatgtgccttgtgcaaaggaaacttttgcttaacttgaattaattttaggtgtgcatgttgtgaggcagatgtaagctattacttgctttaataggttgatttctgattgacagcctcctttattcagtaggttagaaatctgtgacttaagagtgaatttaggcttattgagtgttttctttcactctcactctcatatacacatgtgtgcacatatatgtattgtttgcatggacaaaccaggtatgtcacttagccaccccaaattagagagaataagatatatatctaaggatacgtatctatctataaacacagatagatacatatccttgtctaaattctttttatttccatttgtttctgaaactttgttttaaaaacccaagttccaaagagttacttttaattacttgagctttgaaaagaaacctcatatatgcctttttgattcatgtgtaccttgctagccagattattttatgagagagataaagttattaaatgatatacagtattgctccaattttacataaagtgttcagctctgtgtatgtactttatgtgactcagaatttttaatgtgactcctcaatactaatgatactgtttttttttacctatgaagagaattattttaaaatgtatgtactttctggtttaggcaaagaagtacgtgttgcaaatttctttaaaataaaaaaaagaaaaaaggaaagaaaagaaaaggctaatgtatttgttagtcacttaaagttatattttaggattgttccagaggacacagttacagcagtgagcctattgtgtggctgttcataaatccctcctctccctcccagatcccacaatgaaacactgcagattaagtgtgtaatcagtaactttttctcctcatttttctgcctcctcctgggggtttttccgggctatcttttgaactagtcatgagtgattattgatatttgtgttattaggactctctttagctcattttgaaaacccatccaatgttgtatgcctttctatttaatatgttgaggtccatacgcagaataatggatactttacccaattgcagagaaaatattgatttgacctaagtgaaggtgaatctttaaagttgtaaaataatgtgttaaaaagtagatttccccccattattacctttaatttaactgtgtgcaaacaatataattaacacgttgctaagtttaaacttgattgtattgtgtatataataacaccgatttgtcttttagtcctgtgtttttaaatagtctgtggctaattgtgaaaatagatttgtgaaaattaaaatgtgacagtaagtggaatgtgctttaaccaaaactcaatattgaaggcaagactgacatacagttcctattatagagtctcctgatctgattttaatcatttatagggtactgtatcagtgacattgccacatttctctgttacaaacagtaactcacagactttgctatataccttcttcttgtagccaggacaaattaagatcagccactatctttggctgtgagggagagaacaaactctcaaacagctgctattctttatgataacatagaaagagcaaagcaggttcactagtttcttaaccttggttgttcttccctctttttcccctccccaaagggctgttaaccaccacatgatgctcataaaatattgtcattttcccactgaaatggttatgaaagtacctattttgcattttatgagaacacactcatttaggaatgtgacctgtgtaaagtaatgtttatattcctgaacatacagcggcagctgacagactttgcctgatcctagttgctgcttcatgtcatgtggggtgcctttggtattacttaccaattttatagcccattagaatgtttgacaagaaggaaaaatgtaattgtgtaccttaaatttatatttacctggaacttttaatgtttatagtatgtttgtattaatttttaaatgcacataaatttcaatgtgctagttactgcaacctgacaatttgaagaagaaacaaacagaacaaccagattaaatgtagatgtgaaaaagtgccaaagggagtgattccatgcacggacacacacacacacccaatttaaaggatgtctggaaagacaaaaagcccaaaaatccattatcatcacaaagaaccatgtagaaaagaattgttaagagttgttctaggatcaaaattctccccattttaaaaggaacttccttgaagcttttcatctcagctgcaggaataaactgtagtaaattttttttataattatgataacagccacaaaatattacccacattttaaaaatctcctttctgaacagatttgcttagtaagcttttaaaaagctttaaaaaaatattccaaagcaggttctgtaaattgctaaaagattttcttttctcagcttttgtgagttacattaaacttgtgttagttttttaaaaacctgttaaataaaataaataggattgagttgaaattttgacgtcttttttgaatctatatatttgaattaaaactgagattttaattggcaaatttaatccattaatattacctttgatatataacacctgtcctaggtgtgtgactggtataattgcattcttctttgaggtagatgccaaacaggtctaacctactcacattcagctgtttcattatttaagcagcctgaggctttcaacttaaatactcaagtaaacattattttaaaaaatagttaaaacataatggtcttgtgagttgcccatgctaaatgctcacatttagtactttggatatataaagtacattccctaaataatttcatgctacctcagatttacccgcccctccccacacttgtgtgtccccagaagagaggtcttttctctgtaaagtattaaacatttgtgtatagcctaataggagagtctgtttttacatcattattttaatttcccaagaaaagaattctagtctgtttactagacagcaatcatgtattttcatttatacaaacatttacgtgtgtatttaatttcaaaagttttgtttttttttgttattgattacatgggattaatttttttttataatatttatttggttctcaaaatagcagactcttaggaaatctaatgaaatatatcactgcagttgtcatcaatttgtctttagaggacaaataaagtgattaatctaaaaacatttgtaaagaggtgagaaaaaaagttagtaggtaagttcagatcaaattaattctgtttttccacacttgggatacaccagtactgcattacatcctaataaatctttacttccggttgtgaaatctactccactagtataaaatactttgcacaattagcccatagattacaagaatttagtgcacagaagcatttatttcgtaacttattttcctaagttgtctacaaatctttcagaatatctgttaggagcatttgctggtacactagaattcacaaatatatgtagtgtgtcattactcatatattcttctccaagagtggaagataactactgtttctttactttcttgtttactggattagactttaagattgttctattttaaccctaggtattatatattaggtccagtatttatctcattttgtgacagatttgatttttatatccaatgacattaagatgtcccataattcagtggcattctatctaagatgcaaaaaacaggtctgcattgtacatgatatgtgggaatggatggtcattagtgtctcatgacagaaccatgttgtatgaatgcaagtttttttttcttcttaccctaaatgaaaacttaaaattacctgttacattaaaaattcagttcagtaggttaattactatatggaagtttagcaaatgtttgttttcaccagtgctggaaatgctaggctattagacaaaaatggcagcttaaattgggcaaatttgataaatgctttagcatactggagtctagtaataaggttctcatgctctctctctctcctgtttttcatttccagtgttctatttaggtgagtttttgaattctgatttttcatttaagttctccctctccacttcatgaataattaccccaaagagaatgtctcattgtcttagaaactgtcaagcttaggtgcctcttcagatgctcatcgaacacttgttttactcaagctcttcatatataaatgtttctttttccttattgttgatgttttccatttgtttcaagtaagccttctggagatgatgacagtattatgttgcagtctttcatttgctctgtgttatgtaaagcttatattttattttgctagacaaaaagaagacacgtttgtaaatatgtgatggttttatgttattctcatgattttatctcctctgtccagctagatatgaaaataatgttcatctgtaatgttttctccctctgtagggccaacattgcctagacaaaactcacaactacctgctcaagttcaaaatggcccatcccaagaagaattggaaattcaaagaaggtaaattttcaagttattgtttgtactttttctttatgcttcagaagacaaaactgaacatcctgtgtttaaagtagattatgtcttatcagctgtttaagagtcacaacttttattcttacattagtaagttttgtgactgtcattagtaagttaccagatacttgttatgctggacatgagatgttataaaatttcatatgtgtttttttttgtaaaaattatacttaaggtatgtttaaaatattgtaaatacgcttaacagaattcaaaatcttcttatggttcaagaagtcttacttttgtaattataaagtgatctgtgagtactatgattttcatgtgacaaatttaactaaaaagttgaaatattgttggctgtttctgtaacacattgatcttcagatattactatagggtttagtagtagaatacaaaatcattctctactgggcagcattcttccatgactaggagttctctgaaagtggtcagagtacgtaggctgacaggctaacctttggagtaccaggatggtgagcaggcaggcctcagaaccgcacaaacgctgagctactaaaagttccactggaagccccaactcatctgaggcagcttgttcagtttctttagagaacagtcttctgtggtaaatgccattccatccattgagctggggttggggaggacaggggaggagctggtacagctgttcttcagacagtgtatatacttattaatcagcttgattattgtggcactgctcattcccgttctctctacctgctgacctcaggttagatctttcccagattcctcttcccatgtctgctttgaccgtcttcagtatgtgttctgggttatggatgcctccactgctccatttatttatgtcacaggcattttttgttctaagtacttatattgggaagggtggggagagtggagggaacaaaaagcctgaaactcatcagacaataaacatgacatggtatagtagaagatggtaagtgctatggggaaaaatgcaacagagtaaggaggattatatgttgtgaaggggcagagggaagtgctggttgtaattttattttatttttccgtccattacttatcagtctcagtacttgtgagtttaaatagagtggtcagggtagatctcattgagatgaaaagaaggaattaaccaagcagatacctatgtaagtgcattctgtgcagaggccttaaggaaggatgatgcttgtgtgtacatgggaaaacaaggaggccgtggaggctggagcacaagagagtattaggagtagaggtcagatcatgcaggaccttgcaggctactgtgaagaatttaacctttactctgagagaaaggagaaccattgtacagttttgaacataggcatgatctgacttaaaattttagcagaatcagtcagtctgctctgttgagcctacactattgagagacgacttgaggcaggtgcagtgttgtgacagcagctcaacaagaaagccagttaagaggctgttgcagtgaactaggcaggagataatggtggcttcccccaggtgatagaagtggttgttgagaagtcagatccttatatgtcttggtggattgtatggtggggatgagggaaggagaggggttgaggtttttaggctaagctagtgggaaggatggagttgccatcaatagttgtgaaagactgcgtagagcaggtcttgttgggggatgtcaaaaatgaattttgaggatgtttggttgagatttttactggacatgtaagtagagatgttgaatattagtctctaggagactaaggaagaattctaaacatataactcctaccctttctgtcttccggaaatctcatgataaatttgccctactaatgaccaccaccttcagttttctacttggtcatgggtttatttatatgcattttaatgatgtttctggaattttagtagaattttggggaagattacaggactcctcaatctaccaacccgaataagagtccagacactcctgtcttgtcatctccctgctcagcattccttatggctgcctctcctcacatcagtttacttctttggcctggcatttaggaactcaccccatgtttgtgtttcaccccctcatgactgtctctgtgtacaccatactcatctttcgctctgtgtttgtgtgtagcattcacctcttctgacatgtccttctcatatcctttctacgttgtcattttctgtagactcttctccaggcacactgatgttcttgttttctgaattcctgtaacttaatcacacagtgttttgtattttcttcctacgtgtttattttacatttgagtattacctccacagtgaacattatgggctaatttgagagtagaaacctcaataaaatttctaataaaaagttaagaagtttctggtactgaattaatttatatgcaggttttggggtataagacagaaagtatatatttgacctttaatgtggtaattttcttcacttttgcctatgggtttagaggagaaattactgatgtttagctggtaaatggccttttagagacttcccaggtgctagggaagacattacctaggaaggttgttgagttgattaagataacacactcttttcttgctgcctaggattttctgtgttttttgggagttggtgggaggttcacggaggaggtgctctttgagctgtgcctaaagaggcaataaagtaggagtttccagtcatagaagggaaaagcattccaggaagaaagagtaggtgtgtaaaggcaaggcgatgcaaacacacgtgcaatgtgagtacgcttcctccttccccctccaggaccagtggtatggttagatgaggttgtgtccaccttgtaagggccttatatacaattataaaagagatatttgtcatttttctttgacatatatcccgtacaatctgtttttgcctgtggttaaaccatacttggaaaaagatactacaaaactctaaaatatctactaaatatttatatagacacttagtactggttttcactttctctcagctgacagtagtgcatggctggatctggttgtgtaggctagcaaacgggaaggatgtatagcacagtctagtgtgaagtttggttcccagtagaaattatatttccaaaatttatttcatgtggttatttatataaaaatcattttttaaaacttgatttaatcttcagaggcacaataaaataccctcaggccaactttttacttcataagttgagtgaaattgtcctgttaactttggctgtttaactggcctttttctatactattactggaacgtgtagtgaaaaacattatcagtttgcattataaattcacagctgtgaggatgtgggtgaggtgccaaatgaaaagagggattaggtgaaagttggccaacttggcttctttcccttgctcagctcctagacgctggcagccagacctgtagagcccagcaagaaactaagattcctctgtgggaaaattgccatggccaagagaagacagagatgttgacactcgtccttgccagtgaagctcatttacttaagggcctctgatcaactttggtgctgcttataaatatgaacagacagccaaggatcatcaaacctttcaggccaacttctataaaagaaggaccaaaacaaagagttgaaattgtatgaaatagatgcaatgcagggagcggaagaaaacctaaaaatatactgcaatagcttcagagaactaggagaatatatttcattgatgaaataaaaatgggtagttattttaaatggatcattcagagaacaagaaagtaaacttggaaactttttttaaaaaccacctcactgtttttttccccgccgagaaatagaagggcgtgtgctgtggcttacataatcccagcactttgggaggctgaggtgggcagatcacgaggttaggagttaaagaccagcctggccaatatggtgaaacccggtctctactaaaaatgcaaaaattagccaggcctggtggcatgcacctgtagttccagctacttgagaggctgaggcagaagaatcgcttgaacccgggaggccaaggtcgcaatgagctgagatcgtgccattgcaccccagcctggcgacagagcaagattctgtctcaaaagaaaaaaaaaaaaaagagagagagagaaagaaagaaatagaagttttgagaactaaggttgaggaatttattctctgaaaatagtcctaaaacaaagaggtggcatatgagaaagaaagtaaagtaagaagatcagattagaaggttcagcatccaaataatagaagttctgggggagtgggaaggagaacaaaaacgtgaagaaattgaatttgcaaataaataacaagaaaatttgctggaactcattgatcgtctagatcaaaggtccgcaaactttttctgggaagggccatctgtgtcatttgctagactcttcctttgtagctcgccatagacaaaacggaaataaatggttgtagccagatttggccctagggctgtatacagtttgctagcttctggtttaggtcaaaaaagctcaccaaaagtccagcccagtaagtggggaaaaaaacaaagacctcccaccaagacctctcactatggtattttagaatgttgtcctagaataagtaagatttcaaatgcttggtaaggggtggtgggagtgacaaggtgggggagcttcaaaatcctaagagaatctctttccagtctaaaatctcctcttctgcacaacttcctaagaagctattggaagatgtgttctgttaagatgagggagtaaagcaagaatgatgaacccatgacagcatccaggagacaaggaatccaacttaggaaagagataggtaattcccgcacgactaaggtcaaagcaaaacctagggaatagcccatccggttgggggcgctgggagggctgaaggctcccgacgggtagtttctgagggaaagcaaaacaaaagaatagaaaaacctgaccgtggttctgctatgttggaccatgttgatagggattacagttctaatggagagtttggggtgaagtagggacaggtatatagaaaaagaatcaaatttttaaaagtactactttttagcaccaaagtaagaaaaaaattgttctagaaagtaaatgtgatcagcagtgaattatgtgatatgtgaatattggtgtatccaaagtggtggtatgagtttattgggaaaatggagaagaaaaagttttggggagctagagatataggaattaaatcatttgtatagtaggaagtcagtagataacatctaaatatgaaaagtctagaagtaatagttctaaatgaattactgtatttagaaacatgtgataagtaccagagtattgaaaataattgcttctggggagcaaaatcagaagtggtgagcgttagtaagaggattactgttctaagtcttataatataatttggctttttaagttatttattactactgttatgtttaattttttatttttaataaatgtagagtcaatagagcacatgtctaagtgttcattcttattagtccaataccctttattattatatcatttattaaatagtttttggttcctactcatataattaatatttggcttggccatgatgaggaaacatattctaagaaacatgagtcagtcctatgttagtctccacatagaaccttaatatagttaatatctataaatagttcgcaaatcaccagtactatctgaaagttataaaaggggaataataattgcggcacagaactgagcagttggaacaatgttggaacaatgagagtgtatagccctcctattggccttcggaggccggatggaccaaaagttgaccgccttctcttgtgagtatcaactcttgcctcagcggctttgtaatattaaaacttagctgtcttattacattttatccattttttatttgtttactgatagtgaagtgaaatgctcatgttatacaatcaaactgtatctgtgtagttttattttctgagaaatgtcaataataacagtgttactaaatattaccaactcagaacatttttcctagactgttcctacttcattttgttaaaattgaaatcattcttatttacctagtaacactattcattataggtaaagctgggtgaaatgtattttgaactgatgttacttaacattttacttgcttcaagaaatgtctttgagtcaacataaactaaataatgaatatatatttaaaaagctattaatctcaatgtgggctgatgctttgtgcatctatttacatttggggatagctgttttggagagaaataggtatttgggtggtggaggaactgtgtctgatattttttaaatgcttaaaaaataatattggtgatttgcactataattgtttctgaaaaaaatttatattctcagaaactttcaaattattgtagaatatatatgcctagcttaaaagaaaaattaaagtagtccgtcaggatttttcatggttcagaattaaggcactctttctttgaaaaaagtcctcagacgattctattaatgactgaagaaaacagttggagagagaactctaggaagaggagccatgtgcatttccagtatgtgaattggcagcgataattctgaggaaaagcaaagtttataaatttggaaactcctcctagaaagctacacaaatgtcttgctttagaggtcaaaacatgagagtcaaatttataaaccatccaatttaggtgggaattattcatgccacacaagattcggaagccagagattttctgcttgaatcactattttgggaaatccgtttagatgggcatcttttcagcaagcaagctaaaaattagcttaaagtgttcaacactttcttttcttaccttcagaacaagaaaatagtaagaatctcctgcagctatatgaattgcctgcttgaatcatctgtctgtgaacttagaaatattctccagcattgtgtccttttcctatatcagtagacactccttatcttttatagcctgaaaaccctggaatatgatgacatgtggaacaaacttcttaagtcaatacaacctagctgtaaatgctgttaccaataattctttcagattcacctcacccatgcctggccttctgcttgtgacttaagcttactttttgtgtgttaaaagcattgtattgcttagagaaacagccattaacttggtggttaaaaaaaaacccaactactaagaacttgaatgagaaatgaaatgtagtcatagaatactatttggttcagctgtgagcagtatttacattatcatgttaataatgtaagctgtgaatattgattttccatattgggagaagcatgagtgtagtgagggagttgtagaaggcatcttcctgttagaaagtagatagcaaaagctaaaatgtaagaaacagctgcaagagtaggaaacgggtgggagggttgaggcagtgaactactgatttttgttataaactttaaaaactatatatttatgttgttttggtaaaatagaagaagtaacaaatgctcaaagatctaaaaacttagatcttttcatcatagatttcttgggacagctactgtgctcttaaatgtttctctttagcttctgtatttaaatttgttctaattagaataatatgggtgtatcttttgccctttgggcccaacagattgcttagagcattatatgtaaaatggcccatattttttgatgtaggttgaattatctgaaatttaatacaggctccagctgagtttattaactgcaggttactggagaaacaacaacaaccaaccctgactttcctctgtttattattaaaaacattcttttgaatacatctaatttcttcccctcatccctgcagataaagttattgttatccctcaaaaactttggcagctagtgatttatcaaatagcataatgaagtccgtactagatcctgaaaatctgattttattagtagtcagtatctcaaacaactactcataaataaataactactcataaataaagtcagtttcttgtgtttttctcttgcagtcattgttaagtgtgatggtatgtccaggagagggtgtgtgttttatgagagcagtggggttgatgtatttgtcaaatgggccttttcttttgttgtatagccagcttaggaaacatgaaggagagagatttttggaaagatcttactggtgtgttggtaccgctggaaggaacaaagggatagcatgcatgtgctgtcatttagctttgtctctaactagacccacccagtttattagccagtccagaaagtcccaatttgaaatttccaaataataactattgttgggccgggcgcggtggctcacacctgtaatcccagcactttgggaggccaaggcgggtggatcatgaggtcaggagatcgagaccatcctggctaacactgtgaaaccccgtctctactaaaaatacaaaaaattagccgggcatggtggcgggcacctgtagtcccagctactcgggaggctgaggcaagagaatggtgtgaacctgggaggtggagcttgcagtgagccaagattgcatggctgtactccagcctgggcgacagagcaagactctgtctcggggaagaaaaaacaaaacaaaacaaaaaaactatcgttatagcccacattgaacgttcttatgtttcaagtacttcttaaagagcttttaggtattacttcatttaatcttccccacagtgctatgaaatacgtatgtgtaagataaagatacttttttttttttttttttggagacagggtcttactctgtcacccaggctggggtacaggggcatagtctcagctcacagccacctccattccccgggttcaagtgatcctcctgcctcagcctcccaagtagctgggattacaggcgcacaccaccacgcccagctaatttttgtaattttagtagagacagggttccaccatgttggccaagctagtctcaaactcctgacctcggcctcccaaagtgctgggattacaggcatgagccaccgtgcctggcaaagataactttttttttagggaaggttaattgacacaacttttcctaaagacaatttggaaccatgtatcaaaaatcttaaattcataccttttcacctagcaaaatttatgtccttattgatcctatagaaacagaaaaagattcaaagatgaagacaaatgttattgcagtattgccaatagtgttaggataacttaatatcctactgtaggagactgcttagactgtggacagcaaaataatcgaatattattatgcactcatggaaaataaagatgctgaactaagtgccttaggataactctgtgtgtgtgtgcgcgcgcgtgcgtgtgtccatccagagttgtacacacaggcaggttctcatcccagatatcctcagttttactaacttatgtctccctccctccctccctccctccctccctccctccctccctccctccctcccttcctcccttccttcccttctttttcttccttccccgcttcctcctttcttttctttcattgtttttggagacaaggtgtcattctgttgcctgggctgatgtgtgatgatgcaatcttatcttactgtagcctcagactcctaggcccaagcaatccttctccctcagcctcccaagtagctgggaatacaggtgcatggcaccatgcctggctgattttaaaattttttgtagagatgggtcttgctttgttgtgcaggcccatcttgaactcttgggttcagacaatcctcccactcagcctcccaaagtgctaggattacagctgagccactgctcccagaccaactttcacaatatattaagtgagagaaaggaaagcagatttcacagtagcgggaaatggttacattttattttgtttttaaagtttatatgtgtatttttacacaaggggaagtctagaggtatataggggtgcgtgtgtgcgcgtatgtgtatatatagatgtgtgtctttatatacatatgttgatgatagttgcctctggatatgagatttcaatcatttaaagtttatttcttctttcttgactctttttcattcagtaaactttttttttttttttgaggtggagtcttgctctgtcacccaggctggagtgcagtggcacgatctcggctcactgcagcctctgcctcccaggttcaagcgattctcctgcctcagcctcccaagtagctgggattataggcgcacgctaccatgcccggctaattttttatatttttggtagagatggggtttcaccatgttggccaggccagtctcgaactcctgacctcaagtgatgcacctgcctcggcctcccaaagtgctgggattacaggtgtgagtcactacacctggcccattcagtaaatatttattgagctattgctgtggccagtcattgtattttctgaaatattatttgtacaattaaatttgatattaaggatattacaattacaaatgttttcactaaataattaaaataatgacttggttattaaagtggtatgttatttggaaaattcatttacttgcaacactactcatgaaaagtacagaataaaatgaaatgttagtgcaatgtgctgaagcattcagccaatatgatgctaataggagaaatgattttcatttgtatgaaacagtctctatccaaggtagccttcatgtgggaggagagatgtttgcatgctctacattgcttttatttgactcagaaatagtttacataggtgaaaagaatcgctttttcatgatgagtagccatagatgcatgtttttacttttttttttttttttccagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggtaagaagtttacaaactcttctgtgttcttgtatctgagcttggatgatgtctcttgtgcagtcatgtgttaaaatatttcacatttgagatgtttgggattaagccatacaatttgaaattatgaataaatatgcagcaattactactttaacattttctttttatttctctctgtattgcttttattgcttggagacttaaagaaagctcttggaaatttttattctgccattctaattcttctaacaccctataaaatggctataaagtgtaagtgtgtttttatgggaaattttttatactggatgaacttcaaatatatttccctcatgagatcacttaaattgtctcaaatactatagtactgtagtaccattcagcaagaaatttgcttgattgcattctaaagattttggaggaagaattattttagagaaatattctctaagactagttatttaaatatgctttctagtattatgaaaaattagtgaaaattatggaatctggaatttactgaaagacataagggttaatatatggctgaaagtttgagatattttaacgtttattaaaattaacattcattataggatttaagaatattccttatggcctaattaaaaagtcttaatgtggtttgattaaacagtggttggttggttggtttattaagttaatttatgtatttttagctacctaattattttctggagttatggccaacaaaacaaaacttttccacaagttagcattgaataggagcattgaacccttcatattaaatgttttgccagctttactagttttgctatttgttgtttttaaaaaaacaactaaatttattcttctgtttatggtcctattcatgtgattttaatgtcctttttcttgtagactaaataaaaattaagactaatactagctttttcttgtaaaagaaattagtcaattaaatttattaatccacttattagataaaaggaaacttatttcatccccttctgaatctcaaaatgtatttacaagttaaaatattcttgggtgaaaatagttatttgcgtttgtgcctaattctctgatactaactgtagtctacatttatacattgtgtctgaatgctggttttgtggcttcactagctccctttttctctctccttttttatcctgtcttttgctgctgctttccaccttctgtccagctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgactctgtaacatatccagtgtctccaccgcctacctcagggccagcagctcctccgccgccgcctccactgccttccctcgcatcactctcacactgtggatctcaagcttctcctcctccaagcacccctattgcctcaactccctcatccaagcctagtgttctcccttctccctctgcagctgcccctgcctctgttgagactcctctaaactctgtgctgggagactcttctgcttctgagccaggcttgcaggcagcctctcagccggccgagactccatcccaacagggtaaggctttcattattgctactaacagctaatcacttgaaaatgttatatagcagtgactttaattgcctgaatggatgggtaggatggttttgatccttgaacatttatatgccataatgccatgctttttttttttttaattaaaaaaattaaagtagaaaaatgtttttcctgttggattaattgcatttggaggaatttccttattgaactaggttttgatatcttttatagtatcgcagttaaagatgttttctagtatttaagagcccctcataatacatttctttatttttttcttttttttttttgtttttttgagacagagtcttgctgtgttgcccaggctggagtagagtggcacgatctcagctcactgcaacctccacctcccgggttccagcaattctcctgccttagccagctgagtagcaggagttacaggcacatgccaccacgcctggctaatttttgtatttttagtagagacagggttttgtcatgttggccaggctggtcttgaactcctgacctcatgtgatctgccccttcggcctcccaaagttgctaggattacaagtgtgagcaccgcacccagctaatacatgtctttcactgggaaaactttgcttgacacgttgatctaccacacaataaatacatgatctaaattgttttccttcatttttctgggagacttagagagatatatttagtgcccaactgtagtcattagatacgtcatcccagagtttcctttggaacagttctgatcttgggccctgtttccttcttgcctttcctatattagatgccccatgttggacttccaggataggtgtcaccctaacccttggagcattatgactttgcaggaggagtagagaggatggcagggttcatatatgccctaaagggttccaaggtccaaaattacaataagtagtggcttgaaggggtaatcaagagagaatagcatcctctgtagttattctccccgtccctaccttattgttatggtaacagggaaggcaggatgtaatctctaagtggattatttgtaagtagaaaaggacctggttctgtaagtaaataagaagatgcttggcaaccctagtttttaaaatatgatttaaggaggactacagaaagaaaactgaaaacaaatttgtacttaaacattgcaaggcttgttattgctgtatatgtatatattttgttgttgttgacttacaaatttgcttaaaaggttagtcagaattctaagacgttcagtttggtttcaccatgacagttatactgtacaaaatgggcacagtcagcctgacaaagtgacctgctgtaccctcagaactcttaacaacccctacagaagggacagactatttctagatgcttcttttaacaattgatgttttctgcttgtgtaactgctcaagctgaaaaagttagcaattaccacccagtgtgcaaaatagcattttattcgttctgaaaacacccctcttaaaccttaactaaaagagcacctactgtttcaggattctgttattaaataaattcttgttcactccctttgtgattttataacatttgaacatttctcttcttgccccccattttgtgggataaaaacaactctacttcaaatcctatggtatttaattatttccgagcgttattttgaggttttactttgtactagtaaattcctttacttcagtgattctcagccttggctatccattgaatttaaatgtgaagtattttttaaaatgctgaagctgggacttactcctccttcatgtttttaatacagccactttgactgtaaacaattaaatgtatgtgttcactgttactgaatttactgtctcaacacttaaggttaatgtggattattttgggtctgatatttcaagtagtactaactgccatcctatatactagtttgttttttcagggacgcttacctctcttccaaattttataagtatttattttgcttatttaccaaatccccatgaaaaaaaaaagtcttaattagatgatctgttgcatagttctattactaaagctctaacctaaagtaagtagttatatatacttggaccttacatttcagtatctttcaaaaactgatctagacttttacaactatgataaattggactcattaagtaaatacatgagtcagtttaatttagcatggcattctgcgtaccttcccacataaaataatatcactcagctctattgttgatggtcttacttaacatttctctctctcaggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacgggtaaatacctttctgaaaaatttttttaatatgtcttattcttcctaaatatctaaaatgttgaatttattgtattctaattttatgaaatgttatgaacttcattgatttaaaaaattgaaataatttaccctggcgcaatggctcatacctgtataatccctgcactttgggaggctggggtgggcggatcacctgaggtcaggagttcgagaccaggctggccaacatgttaaaaccctatctcactaaaaatacaaaacttagccagatgtgtgacacatgcctataatcccagctgctcgggaggctgaggcagaagaatcgcttgaacccgggaggtggaggttgcagtgagccgagatcatgccactgcgctctagcctgggtgacagagtaagactttgtctcaaaaaataaaataaataaaaattaaaaattgacataatttaaatttttatagtgaagttgtaagaatagtataaataatttctataaattcatcacctacattcacccattaacattttaccagtatttgcttttttattccttctttggatatgtttccttctttacacatgcactttttttgttttttctcttgagacggagtttcactcttgttatccagactggagtgccatggcgcgatctcagctcactgcaacctccacctcccaggttcaagcgattttgcctcagcctcctgagtagctgggattacaggcacccaccaccatgcttagctaatttttgtatttttagtagagatagggtttcgcgatgttgaccagactggtcttgaaatcctgacctcaggtgatccacccgcctcagcctcccacagtgccgggattacaggtgtgagccatcgcacccggcctacacatgcacttttgtttgaatgatttgagagtaactcagagacacaagcttctattttcctaagtacctcagtgtgaattttataagaacaaggacatttacctgcataaccagtaatataattatcaaaatcaggaaagttaacatgatagaatactgtaatctacaaatgtattattcaaatttcatctatagtccaatgacatctttagtgacagtttttttcctagtgcaagatcatttattgcatttagttataatgtctctttgatatactttatgacagttcctcaatctttcataatactggcatttttgaagactgtaggacaattattttgcctgttatccttcactttggcttatctgatttttcctcaagattagattctagttatgcaggggttgttttagcaggaatattatcagagcaaagtcatgcccttttcatggcagcacaggaagagatacatgatactgtttcattgcattcttggtgatagtagttttgataaactcttgttgatatataaagtcatgctaagaatctattggttcttaaagcttaaaaaataatatttaggttttttaaaattaatgctgatgtttccttctgttttagatgtaatatattaataaaaatatggttgtctaacataggagttgattatgtctgtatattctcattaagatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggtaaggaatttcattataatggacatgcccagaattgagaggattttaattgtattccaaatacaactaactagatgcacttctttcctcgtagagaagtggtttttatactgaatcagataatatttttaaaaatcggatttgccttctttgtaggagaagaattgctgaaaagggatcaacaatagaaacagaacaaaaagaggacaaaggtgtaagttaataaagatagtctaccataccttaaaatatggaattcaggcacagctcattcaggaaatagtgtcagcatttatttaatttgggcttaattagtttgaacttatatttgctaatttttaactatgcatgtgaagtggcttgttttgactgttatttataaatttttaatggcagtcttagtaaagtgagttgaatatgtgaaattatgggaaaagcattgaagttcaaacctgtggagtttaattctgttccttaaatgagtgaatgacatttcactacttttttcatctcttagaatctcagttcccttgcattaatttaaaaggaaggaattcgcctaaattcatatgtttcccttaggagcttgatggttattggctgtgccccttcagagtgtaaccttcatgccctcctccctgattcagctgggcaaactctgctttgtctgtgctgtatattggtgtgcaacaaataatatgttccccctgctccatctggccaccttagatgccattcctcaaatctgtctctcgtgtctggctttgtagcattggctagtgaaagttctcaaggagaacacatgaggaaaggagctgtggggagggttgaagggaagatggttgaagacaggagaagaaagtctaagctgaaatgaaagggagagaagaccgatgaaagagaaagtggggagtggcagaaagaatattagaagtgttcgtgtaaaacactaaatgtatatagcaacaggggactggtagatgtgatattaatatatatctgtatatttaggaagattcagagcctgtaacttctaaggcctcttcaacaagtacacctggtaagttcaagataaatattttaacctttataaactttctctaaatattaatactccccagttaaaaattccccctttccccatatttggaccaagtgactggacactaaaatgccagagttctttgttcccacctgaaagcattcacttttttcctcctggaagctgctgttactttcttgaggttacttactaaaacaaggaaaatattaatgtactattagatgacaagagtatttttcataattgtttttctagaggtaaaaataaagtgagcatgttagttagtactacagtctgcttcagaacattctcaaattgagaaggatgtcctagccattcatttgggtgatattgataattaagggaataaagtttctgatttgtaaacttaaaaagtctccttaaaattttggggaagtgttcttgaattcagtgaaatttctgacattgagaattcttgagcatctgataaatcacctagaatattaacaaaagtatatttcactagaagtacttgatgagtactgtatccaagatgagaatacgaactcattacatattcacatgttatttcttcatatttgattaaagactaagggctggactatctattgaactccttatctattctggaatgaaatgacataaataaacttgatgagttaatatctagagtggtccataagaaaccattatagagaaatgcttatattcctacagttttgatttaaagacaaccagctgcatctacagttccctttttaattttcatttttttaatttttttgagatggggtcttgctctgttgcccaggctggagtgcagtggtgcagtcttggctcaccgcaacccccacctcctgggctcaagtgatcctcccaccttagccccccagccccctaagtagctggggccacaggcacatggcaccactcctggctaattgtttggatttttggtagagacagggtttcaccatgttgcccaggctggtctcaaactcctgagctcaagtgatccacctgtctcagtcttccaaagtgctaggattacaggcgtgagccacagtgcaccacctagaattcctttttttttttttttttttttaagtacctctgaagtttttgtttttgtgattgtaatccatcttttcaccactccccccattcctcattcttattattaaatggtgactcttcagtaggttgattgctataccataattaacatcatggctttgttttccctctgaataggactcagtttgttattttcattaaaaattcactggtttgtgacccacttattttagctttatccttctttctgtaagccaaaattaattgtatgtactctcattagtaccgcatagatgttgtaaatccgaaccatattttgggctcacagaacctttagaatatgatgagagctatagatcctctttccagggaggaaaattgtatttttattcagatttgttcataatttcagaatattcatgaatttcttgaaggttatccatggactccaagttaaaaattccttatctaatatataatcccttatataaaatatgaaaaactaaggcacaggttttgtgtgtgtgtcatatatataaaatcaaaaagggcagggcctgttttctcacttgtttcattccgtttttaaactgacattgtgtcaggcacctgaagtgaaaggtacaggtcctaagcccaaaaaaactcatggtacagctgggaagatgagacacacaggtgtgaagttaacctttttacaaccacttgttgaatactaagtagtgtgtcacagagggaggaaatgacacatacgagtcacctgagtcaactttgtagggaaaagtgacatcttagtattccttgaagagtatttagtttggctgaaagtgaggggaaggtgtgatatttcaggatgtaagtatagcatgagcaaggtatggagttggagatgagcaagaagagattaggaaataggaaatagactagaacggggaattctttttgaggaatattgtagggaaaaggttgaaaatatgagttagaaacaaaaatgttgagagccttttataaaattatcaagagtttagactttatcctgcaagtactgagttcagtggacatttaatccactgaaactgtttgaggcacattaaaatggcacttgtgattttcccattgaaactagggaggattaagataggcagaccaattaggaagctctatacgcatgccagtaaagatcctctgaagggaacccagccttgcccctcctgaaacacacccgagctccttagagagaagaggcccttgcttctcagcttccacagggccagctgaaccagatgagcccttttaagactaaaagatagttctggtttggctgattgagaaaggacctcagccagctgttaaaaggtagcacttgctacatcttaaccactttggaattactccctcatccttccacccgccgcctctttagtgacagtgtccgatgaccgttcccttccctgtcccggtgtccctcagtttcattcaggacttcccttttttcacctgcttgggctggtgtcacttggatatgtttctgattcggcctgtcccaaaccccatccgattatttgatcttcctggtcaagtgtggaacttgacaccactgtggcggtcattgagaggctgtgttagctgttagaatacaaaagaaggaatataaaaaagaaggaatttagttgatgaggagtaaagcaagatcaataatgactttaaggtttcacatctaatgccttcatgcaacaagaaatccagaaccaaaagcagggcttcatggaagagtgtgagtttatttttgcgttaagtgtactttgaagagacggtaagctacctgagaatgtgcaaaagccagctgaggagctgcattggaactcagagcagttttagttaaaactatacaatgagatcacaattcatgaatagacttcattctcctgtggcccaaattctttcctccatgagaagattccacttctgattttacccagtcatgtagtgaggccagtgacagcatcagtgagtcagcccagattagaaaaacaattcaagcacaatagacagccaactagtgagtcactgactacatagtgtcttttgtaataagagcttagagcgagcttgtttatatttaactggaataatcggctaaggcccaagaattaattgtttaagaatcaaggaagtacaatagaatttcaggattctgatatttattttgagttgttcctatttttttccccaagagggactatttggatttagattaaatgttgaaatacatgaacatattataagttatacttactgtttttatcattggcactaaaaaataatttaaaacagtgtcggtaatactattccattttaattaattgaactatcctaattttaaaattatcctactttattcttactgtcctttctttgttagagaaactccttactatcctaaggttatagaatcataatattttagacttaacaatgtaagttttccttggaaacttactgtactagcttataatttcttctcattttaaggtctggcattgtgcaaattagagtccttacagatttcaattaaagtttagaatttaaatttttatttatattactactatgtaaacaggtataatgagatttagtattttgttatttgttttataataactctggaagcatttatttatttaatagcttttgttttttatttttaaagaaccaacaagaaaaccttgggaaagaacaaatacaatgaatggcagcaagtcacctgttatctccaggtatcaatttttttctctaagttttatattttatttgtataaaaaaaaattaatgcattcttagtgtagaaaaaaattgaatggtaagaaattatacagaggagcccataaaactctcgtgatcctcctagtattggacaaccaccaagcctcattatatattactcatctacattactagtgattgataaattctaccctacatttattaaccagatgatctgagattttaagatagctttctttttcccaatttgtattttgaaaaattcaaaactacagaaaaattaaaaggatagtacagtgaatatgcgtatacccatttcctaggtttaacagttgtcaacattttgccccacttgtcttaaatatctacctatccacacttttttcccctctgattagtttgaaagcaattcacaaataagaactgtttcaccctaaatacttcagtgttttttggaagaaccaggacatctgctatgtaaccacaataccattattactctcaagaaatttaacattaagcaataatattatctactatagtatatagtcacatttccccattagttccaatgacatagattttatgtatatatatttatgtatatatataatttttggagccttttttaaacctgaatatcagctggagagaaaagagagcaaaataaaacatacatctttgaatttgtaaagtagaaacatgtatttccctatctcatttgaaacttgtaagtgtaatcaagttagaaaagatagtatccagaaacaaggctagttaatacttgtttctacaagtacatgtgggcatatttaggcaaatttgttcttcctttagctaggcatactttattttcatgactaaatttatatcacagctcctgaacatagatgaaaccttttcttggtttatgagacagtttaaaggacttgtatttttcccagaaaaaaaaaaagtatgtatttagaaactaaaaggtattttgtcttttctttctgagctatttgccttatttttgtctcgtaaaaagcaacttgactctaattatagaaacctaataaagataagtacagggatagactttatattatcacagacctgttctgtgttagtctaagtctgaatttggatttggcttcctatgtggttctttctgctagtaggaaagaagatttggtagtgacacaattgtttaagctccacaaagaaactaggccttttggaatgtataaaagcttttagtttctaagtgattgaaagatgatcatattttactttagaagaaagggggaattgcttttggtggacatgtgttttcagtagagtagaaaaattgcacatttatgtttctcagactcctaactgagatggccttctaacacatctctactagttacggattttcttcagtagcacattatgaagtgctgatttattaagcccataacaaggagctggctaggcgtggtggctcatgcctgtaatcccagcactttgggaggctaaggtgggtagatcacttgaggtcacgaatttgagaccagcttggctaacatgatgaaaccccatctctactaaaaatacaaaaattagctgggcatggtggcgcacacctgcgatgccagctacttgggaggctgagacacaagaatcacttgaacctgggagacggaggttgcagtgagctgatatcgcgctattgcactccagtctgcagacctgtcatgtgtcatttgtcctttctcttcatcatgcttcattgatctgcatttcacagtgaactaaaagctaagcctacgttgatggcagaagtcatgtcttagaagggacatggacgaggttctccaaatggaatacattctttgatgtatttggtccatttagtaaaggaaaagttgttctttgaaagatttttttatttttcctaattccagggtagggaaaaaaagatttttttttcagacttggaaatttaataagtgctctaaaggtcaccattttgaaaataattttatatagatgagttgaatcttgattcttaatatccagtagtgcaccataatcatgttccaattctgttaggtggttttccttccctttcccaaaatagaaattctggaactcctgattatttcctgaccactcatatatcttttgatagatttgatccaactactgatatataggttttaaaatttcaccaaaagctgttttaaaccataaaggatttttaaaatatgtttaaaagagtaagaactatattgcttttcttcctaagttatctctcctgttccttcggaaagcaagtgtattaagtatgtcttatccttgcattgtagtgaaggtccccatttctctttggaatagctttgtcaaaattacgttagtggtaagatggattaatgtcccataatatgcatgagatattgcatattgctgtatttgttaagtgaatatgtcagagtaaaagcaagactgtttggttaaaaatgctttaaactatgactggattataacgtttgggaagttggtgcattcatctgtggttattaagaccttacagatcttgtattcaagatgggaaaactagtcctttacatgcctcctgagaagagttaattttgtatacttttatatacttactgtgcctacaacctatataaaaagtagccattgtgtaatgatttttaaaattttctgtaactggtatcttcacataactaaaagtaatcttaaaatatcttttattggggaaaaattggttattttaaggttaatagactcaattcttgttttgtttgctattaacaacctataaaacagtaacataatgagaattattttttaaagttctattgtgtatccctttcaatggttttccccttcatagacgggattctccaaggaaaaatcagattgtttttgacaacaggtcctatgattcattacacaggtatcatcctgctgtgacgttgtgatttgagacttttaaataacatgttcaggatagggctgagctttttctacctggattggtaatcaccacaagggagatttttttttctttattttgaataccttttaaaaattctgccatcacttcacagttggattcaaggataaatacaaatggtaaacatattagaaatactagactgggaatctaaggccacatgtattatctaggccatttgtagcttaagcgttttcttttaaaggctgttcgccttatgattataagacaaggtttcaaaaaagttgaatagaagatccttttccatctgttactggaacatggactaatattaaagccatggttgtggataattgattatttgaggaaaatctctgtttcctagatactttgtagtaaattatcttggacagtttaacatctaacaccctgagtagattgttttctaggatgagccctattataccattttttaattaagaagacttaagaactagttttttcttaattaaaaaaattgacagctaaaaataatcctgcaatgcttttcagttacttacacaattaatttgacagaatagggacttaaatatagtagtacagtcattttataggcagatgtttaaaggcaacgctctcatcataaaaaaataaaaactgacccagcacctggtggttcacacctatagtttcagcaccttgggaggccaaggctggaggatcatttggggcccggagttcaagaccagcctgggaaacatagcgagaccccatctttacaaaaaataaaaaaaaattagctgggcctggtggcttgtgcctatagtctcagctactcaggaggctaagacaggaggatatcttgtgcataggagttagaggctgcagtgagccatgataacaccactgcaccctagcctgggtgacagagtgagaccctcttttaggaaaaaaaaaaaaaagtgaaataaaaacctgagaaaccctcattttgtgatcaattatgatgaaaacccataggttagaaataactgaaatatatttatgttattttacacatctattttttaaaaaaatatacatcaagttcactgggaatatgaattaagtggtgttcatagtggatgtctattgcagtgagttgggagttctgtaagcagactctggccaaattcttacttgctaaaattatttttatgctattaatgatcaaaatacttgacaagttaattttgtcagccagttaaatcttcacaaaatgtttatattccagtagtgaaatagttttgtgttttttttttttttttttttgaggtggtttgttttggccaaaagatttctttagaaaatttgctagtacatagaaaagtagcatttaacaatgagatttttaaggctgggtgccatggctcatgcctataatcccagcactttgggaggccgaggcaggaggatcacttgagtccaggagtttgagactagcctaggcaatgtggttaaaccctgtctctacaaaacatacaaaaattagctgggcatggttgcatgtgcctgtgggaggctgaggtgggaagaagacttgaggccaggaggtcaaggctgcggtgagctgagatcatgcacactgcagcctgggtgacagaatgagaccctgtgtccaaaaatacatatattttttaaatgtagtaaatctgctcagttatcttgctgctttcacacatagtaccccctgggataatgttattgataaacttttttggtaaaagttaagaaaaaaagtggtgattacatctttccttcagtatgaaaagttcccccctttagttaattatcatggtggtggtggtggtgatggattgcatgttagcatgaattaaatttttaaaaatttgcatgtttccacaattgtttattacataacaataatttttgcattgcctagtaaatatggatatattcataacatacttgcccaattaaatagcaggctgtagttcatgtgaatttcagaggtattcattatataacttgagaaaataactagctaaatgggccacttaaatgggaaatgtaaaagaaaagcagagtatgaattatagtttaattctagagaacaggaataggtagcatgagtgaatatatgaaataacatcctaaactttaagaatatttgccagaagtgactctgcattttatggatctaagtaaatcttaagtgaccttggaatttagtagtcttccctagcaaagtaagaaggtgtagcctcacaagaggaaaggaaatatttcatataaatattattccctacagtgcctagctcagtgcttattgaatgaaattttctggaagttatttttccccctattcatataagcagatacctaataaagtaaaattggacgacttgcttcctaacagtcttttaagcagtaatacgttttgatagtaaagcagattaacaggctgggcgtggtggctcacacctacacccagcaatttgggaggctgaagtgggcaaatcatgaagtcaggagtttgagaccagcctggctaacatggtgaaaccccgtctctactcagaatacaaaaaaattagccaggcattgtggtgcacctgtaatcccagctactccagaggctgaggcaggaaaatcacttgaaccggggaggcggaggttgcagtgagccaagatcgcaccactgcactccagcctgggagacacagcaagactgcatctcataaacagcagcaacaacaacaacaaaaagcagattaactcagtgtttaatcttcaggaaccatgcctatgggtttaaagtattttatgtcttataagaattataaattataactttgaaaaatttattatgccttttgggtcttgcttcagattgctaacattggtactctgcaaaattgggaatatatgatttgcctgatggttttaaattgcatttatttgtggctcataaaggagggcatttactagactaaaccagaacccggaggagtgcccatttaaaactctaggttttccactggggactcttttattgccggacttggagagggcgccatgactggtttatttggtgttgaaacttgtttaaaatatacctaatcattgacttattaagaattataatagaaactaaacttttgaaagtgcaataataattgacaatctgcttctgtctggcatatcctttttatttaataaaataaatttatggaagtagttagcctgaaacacaccattcaaatgacgtctccataaaaatttcacaaggaaatagtcacatagtctaatctaataaacatttttaaaacattttttattttgatgcttgaaatggaataatatgtataaagcaaatcatgctcactaaaaatgttttcttcctgcaatccaaggcatcagctttgtaagctgatttatgttagtgtaaaacattcaagtctttatgtttctcctttcactggtttgtccaggtatttaagtagataatgtaaaagttcaaaagaaagacaaaacaagattgtgttatttgagcctcagatgtttcagctggcctcttcatcactgttttggtcaacgtgccacgttacctggttacctcatgcccaaagaatactgtcttctactcttttctgaagaagtctcaccatcttgtcacctttttctagttcctttataaataagaaatactgagaaaagtgaaaaaatgttgttttatgttctaatcagccctacaattttgataattttttaagaaaatggcttttttaaagaaatgtatttaaatctggtgttgggttggtaaatttgcaattatttatgaactcattaagtattaagaatgttgtttacctgtcctggaaatctcatttatacagaccaaaatccacacccttatcacagcccagtgccaatggagtccagacggaaggacttgactatgacaggctgaagcaggtgggtgctcagtggcagctttcctttatttgtacttgtttctttttaaaaaatatcccatatgcatatctttgacatggatcctgaatgtacttagaaagacgatagagctattgttatacaaattaaacagtggcattagtagtactgcatttttgcaaatctacacttccggttcattgagtttgcatgaaggtccagaggtagtggagggtggggttgtggttcagtgataacagcataaggtgtaaatgtaagtgcatggtacgcagttgtaaagaaaacaatgggcttttacttttcagtgactgtcttggcaaaattgaacccaacaaatctgattttggcaagagtgcaaggaaacaggcactcttctatacttctgctttctaaaaagcagtttggaaaaacagaatcaaaagcctgaaaaataaatgtcttaccttgaattctgtgatatgaattccaggaatttatttaaagaaaatattatggaagtatacaaatgtatagtgggtggagtagaggctctgtaggcttcaagggatcataatttagtatgcttaatagtaaattgtgaacagttgcctgtgttaggtaacaaaacaaatgtgtacagttatctcaattttataaaaaagaaaaagatactgtccacgtttggattcatatgccttatagttaatacctatgtactcaggaaaaagtagtaagtgataagattgtgatttaaaataccttattcacagaagaggtgaagtacattttttagataaactgaattttcatactgcaaagctattggaaaagttaaattgagttataaaattttaaaggggagcacgtggccattgaaaatcaagccttgttttgccgtgtactgaatatggctttcttgaaaaatattttaaaatagagcacttccacacgcttcaaaacatggtcagttcttggtcatatgaagaattggaggataacaggaatagatttgatttgggggatgagatgtaaagagtaatttggatcagggcatctgtgagtctatttaataacttctgtgtctcagtcttttccattgttaaaatgaagacaaactaattgatagttttattttaaacatgagaagcttttcaaaaggtaaactttaacagagcaatttaatttttcctggggtattcagtgttaaagtcacacaattcaaaactaattcttccaaaggacagctgttacttttcacccattaaaattgtgtcactttgtcatgggacctctgatcttgaatctgcagggggtttttttatttctttgttttttgtttttgagacagagtctcactctgctacccaggctggagtgcagtagtgcaatctcaggtcgctgcagcctccacctcccgggttcaagcgattctcctgcctcagcctcctgagtagctgggattacaggtgtgcactaccacgcccggctaacttttgtagtttttgtagagacagggtttcaccatgttggccaggctggtctcaaattcccagcctcaagtgatctgcctgccttggcctcccaaagtgctgagattacaggtgtgagccaccacacctggccaaatctgcagttcttgaaggagggcccagagcaccacagttaaatagaagtataatgtgggctacgtatatattttaaaatttttctagtagctgcattatttatttatttattttttttttgagacagagtctcgctttgtcgccgaggctggagtgcagtggcgtgagccaccgtgcctggctgtagctgcattttaaaaatacaaaacaaaaggacattaattttaaaacttaattatttaaagtatgttttaatatgtagtcaatttttataaattactaacgagttattttacattattttcatcatactaaatctttggaatctggtgtgtgttttgcacttcacagcacatctcatttcagattagcctcatttcaggggctcagcagctgcatatgattcgtgcctgccgtattggacagcatgggtcaaccagggcctcatccaccttcctgcctacccattagggcaatccctgaggtcccttcagggaaatcctagactccttgaaatatggtttggcagctatggtgattcctgagaaatctccatacatacttcagacaaaaggacagatttgccaagagccagtttttcagtttactgtaatatcttcctcctctaaacttcctttgcatcacctctcagactgttcccagaggactagattaaaagcacagctgttatcatttctagaaactatctgactcatacgtttcactggatgacagagtaattatcttaattttaggaagcattctatttcacatattgctaggctagaataagccaggattgggaagggcagaatattaaaacaaaattcaccaaggctagtcttccaagaaatagaattgtggctctggaaacaaaaaaaactacacatcatatttcatgacattcttaaaattttatgagtaagaatctctttagtggtaattttgttctgtatttctggtatttttctctaatattttaggacattttagatgaaatgagaaaagaattaacaaagctaaaagaagagctcattgatggtaagtgtctggacaaatttactattcctataaaacaatgtttaagattgaccatttttaagaaaatgcaaataaggaaatacccagctgattagttgagggcaatgacttccatagtcctgcccttttaggattagggttttggggaggaggtttctccttcatataatggaaattatttttataaatagggattaaacaatatccctaagtttcaggtgttgtcttttcttagatggaaaaccacatgaacagatctttctctaggttacctctactcacctatcccagtgtcctcttgtttttgagcccacataatcagtgttttcattttgtatacaaaaggagaaaataaatatatagaaattagtatcatctttctaatattaaagatgtgtgcaatgaaagatgcaaagttaatcttcttattactgtgagtttgagcacaatccttaaagtttcttaggaatgaatcactcatttatcttactttatcattatatttattttcaatacttgttcttttccatccagcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagagaatatagcttttcatagaaattattagaaaagcttacatatttcattagagagcccagtttgttagactacatttattccgtaaaagttctatatacaaatgacaacccatagtttatcatgtaaatctgatttaactgttcccttcaattccaagaaagatttcttcagcagtagatgacaattctaaaagcataaagaaataactaataaaggagatggatgatgttataggttggtttggttgggttttagtaaatagttattcttctaagaaggcttagaaaatcgagaattgaatagttggtactttgaattccataggaaaaagcactcagaagaaaaagtctacattggctagtgtttagattgagagttaattttcccatcaagtccaaaagtttccatccaagtctatagaaactgagagaaaaggttcttggcttacacttaaaatacacattgttgcaaccatataagagagatacattacagaacgcttttaaaaatttggtctcttaagcgcctaacagtccatgctttagtcacatctgtgaaacctcttttctttttttctttttcttttatttttttttttaaagattaaaggcattttaaaaataaatgtttcatggccgggcatggtggctcacgcctgtaatcccagcactttgggaggctgaggtgggcagatcacctgaggtcaggagtttgagaccagcctggccaacatgatgaaaccccatctctactaaaaatacaaaaaaattggctgggcatagtggtgggcacctgtaatcccagctcttcgggaggctgagacagaagagtcgcttgaatccaggaggtggaggttgcagtgagctaagaccgcgccactgtactccagcctgggcgacagagcgagattccatctctaaataaataaatgtttttcaacgtgttttatgtgagaaataccagcttttcattattactaccagttgatctcaggtgtcacttggttggttctgctgaccgaggcactgggcattttaaatatggagtttccctccacccattgatcaagtctgaggtttgtccatccttggtggcaggctagcttaaccatggattcacaaaccccatttgattgtcgtaagtcataaggccaccccagtgccagtggttgggcatcacagtgagtctgaggtgatgaatttgagttagctgtaggctagttccgcaactcagcaatagcccatggatggttggtaaaagacgttgactttgccacttaaatttccaggagaagaatagcttatagtttatctgaggaaagtaattgggaaggcttagatattgagaagaaagccctgttaaaatctaggtagcatttcctttcttctttattactagagggatgggaggttcaggcctgagtcaggactttacaatttggtgtccttcccagaggtactttgggcttgatcattttaagtttcaattgcaaaaaaaaatttttgacggagtgttgctctgtcactcaggttggagtgcagtggtgcgatctcggctcactgcaacttcccccccctgggttcaaagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatggtaaaaattgttattgagtccatgtctttgccaccttgttggacttgatttccctttctctgtgttcctcccgccctcagtctctctcagtctgtccttttttgtgtgtggagttgtgggcaggtcattggactgggactgactttaccagttttcaggctgtggggctagtcagtcattctctctgagccttctacctctaaagttgagttctttttttaaattctttttgttttgtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattc

SEQ ID NO: 38224 - DNA, 26275 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccgggtgagcagggctggggcccctgggcgaggagggcggagtgaccctggaccccggggtggtcgccgcctcggtcccctcgcgtctggcgccactcgcggctcagctcctggtttcgcgctctacgcgagaccgccgcctgcccgggaagtacaggccgcagggcgaggtggccgggtggacgtccgctgccaatcccccggccggccagcgcgccccgcagcacccagcctctcccttttctcatcttcgcctggtcccgtagagctgggtcagaaactcatccctgagaacaggtgtaaaggtgatgtcggtgggcgatagtcatcaaccccctcgctgtacctggtcgctattccctccctgtcgctgccaccggacttctatttacttctatttactgccggctgatttactcacatttgaggagttggtcgtttaaatatcctatttgcagcacttgggcgaatacaattacagacataaaggaaatgttctgtaactaaaccagttaactatagagctaaagcaaaacaaaacaacaacaaaaaaacacctcgttgagccctgttcttgagagctaaccttgatttttgccagactggctaatatgaaatgtatctgtattcagtcgtagcgattcctttcctgcatttaatgatcctgctttatatttacacaagcagtcccagcaatcctagcctctaattactttctggtgcattataaagataagcaactagctttctcagcttaataaaacaggcttgaaatgaatcattggatcctctaaatggtattttttctatctgtaccttgatacattttgtcagggggaagaaactccacagttaactctgcatgataaactctaggatattagtgatgatttcaccaacttttgctgttgcttaaaatttccttccaaaaaaagctgtttctcagtaggaattagcaagactagcatccttgtggaaagagttgacactgtgaatctttgggttttttgtaaggtttcagaatatgcaaaaaccccagaaaagcctgaggatattgattggagggagctttgttagcctgagtgctgtcaggctaagaaatgtccttaggtgaccaagtgtgtagaactggtcataatattttaggagccactgactccttaaaaaaatctgatgaagacctggcacggtggcacacgcttgtaatcccagcactttgggaggcttgagcccaggaggtggagagcagcctggccaacatggtgaaaccccgtctctactaaaaacacaaaaatcagccgggcatggtggtggcgcactcctgtagttccagccactcgggaggctgaggcaggaggatggcttgacccggggaggaggttgcagtgagccgagatcgcgccactgcactccagtgtgggcgacagagcgagactccatctcaaaaaaaaaaaaaaaaaaaaaaaaaaaaaagagaatcccggggtggggagggaggaagaaaagaccaaagagaaagagggaaagaaaagcttaatttttaagctagatggtaaaatgattgaattatttacattgtggtatatttaactggagctgtttgggtaaaaatgtatggtggctccctggtcacacggttccttaggacagcagaggtgcttagtgaaaggtccagaggataatgcacatgtgagtagtagtgcagtttagaatggagaactggtggaacccaagagattgttgtcagaaaacatcgctcaatttcgataggttagacttaatactatgatgataagcttttaaaaatctccagaattttgtatatttccaaagtatgtgaactattgtcagctggttgagctttggttgacatgcttctagctgtgtcataaattgcttcctttttctggtttcatttcctcaaagatagtgttgctgctctaaaaaaaaaaacacaatgcttcttaaaaatctatttttgttagtgtgtgaattatttggagttcatggagaagttgaattaggtaagatatgggacttactgaaaatgctgggaggcattgtgaaaatacttccttcctttgctttattctcagtcctgtggtatttttagagtaatgcctgtgtgaaggggagcaactgaaaactccaatttcctgtgtatggcagggtgcacacacacacacacgtaaaataccaacataccagacaaacaaaaaacaaccacacaatgtgagggatataatcttttactctttatctgatgtgggattgtctttgatgtatgagtggaaagattaagtgaagacaatacagatagctggttaagggccagtgtactagcatgtggatatagtaaattttttcatttcataggtggggaaactttttgctttatggtttttttttggaatggacttgtgattatggatagagctgttgtgtaggatcacctcacagtagttgtctgtggtagttgtcagtagttgtctatggatctgctactgtagtagcagtagttgtctatggatcatgctacttgtctataatctgtcaatagttgtctatggatcaagctacttgacccgtgtttgggtctgctctggccaaggaagtagggtcttatagtacaaagtgaagaaatgtgtataaagcacctcctttggcagcttcttcatcagggggccattgacatgtgcagcaggtggtgggagtataagagactggtgcaaaagtacccactgcctccaccagaagtctaagagttacctatccatgccattggtgtcaactgcaccttcccactaatccactcaaggtttcatgtccaactcaggcccttctcgtaagctatagatacacagaacttatggtgactcaacatcttcatttcccatagagtgaaaaaaatctctgtaagtataaagacaaaactcatcagttttcttctcctcccctaaacttgcagtttaccctagtatttcatatctcagggatagacagcactcaggcacctatgggagtcattttttatttcttggtcgcttccttgctccatccctgccctgaaacacacaactcaatacacacacagaaacacatatatctaatcagtcactgttgtcaccagatcaatcaaaacaaaaactgattacccccaaattgaaaaattttcagtagctttctgatagctgtcaataaagttcaaagtaaactgcttagcttggcctacagggctgctcatgattgaccctgcccttcctcaccagcctcactgtccaccactcttatgctcttcctcattttctttttttttgaggcagggtctcccagcctggagtgcagtggtgccatcacagctcactacagcctcaacctcctgggctgaagtgattcttccacctctgcctcccgagtagcagggaccacaggtgtgtgccaccacacccagctaatttgtgtattttttgtagagacgagggtttcaccatgttgcccaggctggtctcaaacgcctgagctcaagtgttccctccaccttggcttcccaaagtggtgagattacaggtgagagccactgcaccaggcctgcgtttttacctatccattttgcctgaatgactctctagctggagtagcttttctcacttaggtgctttggttcctgttggaacctctgcttagaatgccttcctttaaatccatctgaaattcctatagttcttcaagctttaaggttcagccttgtctagctcccctaggcagactaaagtagttcctatatatacttgtacatatatacttggtcaatattaccacttggttgtaattattttcatgtctttctctactgactgttacggaagacaagaagcaggtcttggtcattgttttatctccaacactcagacattctttaaatgtttgttgaactgatacatttgcagggtcctcctgggcagaaacatcactctgtaggcatttgcttaagtaccttcattatgggagcaggaagaggcagttagggagcatgccttccttaatatacctgtctcctgcatttcactcatgctttgggaattgataatatcaagataattgcttttgaagaggaatccatatatgggaagcagtggcctgtagaagatccctttatttttagctgtatacaaaccccaatgtgaggctagtgagctagccaaggtgtgtgaagaatgctaatgcctaggcccacagcacctagagcatggctccagagtgtccatgtggcctctataagaaagaagaacaagagcaggcatccaggtgccaccccttcctttcctggcacatcttatctcaccacagtgaaaggattccatggaaaaacctttccaagagataggagaggagctggaataaaagtttcctctctagccatgtagaagcaagagatggagtatcaggaggggcagactatgctgtagcccggttgccaggcagcactgtgaaccatgactgtttcctaacagtggtatttctcctcaggagccagggagccatatcataaggccagcgaaatctgctgaggcatggttttgagttaggaagaatcattgagaaggccttatataccagtccattttcaaccttaatgactcagggactgggcaggaaggaggggtgaaaaggaaaggagaattttgtggagaaattattgactcttatttgacagatgtaaacatcagatcaagtgacttgttcaaggacttagagctacaaaatgtcagagtcagaattttaatgcagctctaaatcgagtccctgtttcttttcactgaagcattcataatatatgttatttttgcaaaaaaaatagcttatggaaacaagagactaatctcaccttttggctacatgaccttagctcttacatggtatgtgcctgagtgacttatgaactaattagctatttagctgttgaaccaatgattgttcctttacaggattggtacagatacattcttataacaattctgaccctttatacatctctcataatatccaggtacaagttttgagtgtttattttcttctctcctgttgaactgaactgagtagggaagaggcagagaaaatgcgataagggtatagaatgacataaaatctgacttcagcttaatcattattgagttcagccagttgacgaggaatgaaggaaaaacaatctttttggcatctccaaactaattaacttcataacagcttccataattgcatttctatctaataatattaacttaaaggaatgatatgtttatgtggctttaaagcagggttttccatctttgttctatgggtcccttcaggagtgaaatggaaggacagggagtagatagtccgcaggcccttccactggcctctgcaaccaaagcggctctgtggtttttgtttcacctgttggggttctcattaagctttctttgaatgaaggattttgttttattaaataagtttaattgttttattaagtaagtttaaaaaccattgcctttaatcggattctgagagctatgttgagagaagatagtaaaatttaattcaactaatatttgagtacttaccatgtgctaagccctgaggagactgtactgctacagctacactgtcattactattgcttagcaggaaaaacagatattaaacaagtaattacaagtgagatgaacttcataagaggaaaaatacagtgttatgatggcatagagcaaggagactcaacctggtctctagggcagtggtttctaaacctaaccagagtaattcagagagcattcctagtctctacccctccctaggacgcctcagagattttgatctgcccagattgaaatctccaagcactgtagggggtggggggcagggggcaaccagggaaggtgtcatagagacattcctgagaagttacttaaaggtctagggtagccagactagacggtgaggcggaggatggggccggagcagcctgggccctgaggaaagctgtatagaaaggctgagagtggaggggaggtaaagtgtgttcagggaattgaccaaagcccagtctctagacttggagggagagggtgtctcagtatgtacatatttctaatatagcatttatcattctgttttgtattgactgcacctcccagccgtcagtctttagtgaccaaagccatattttgtttacgcatgaagctgtagcatctagtacctagtaggaactcaagaaatagttgatgatccagtgaacaaagtctctgcatataggggcttagttcagagtaagaaatggaaaagaatattaataattgtgaagtaggatagtaacaacttttttttggccaggcatgctgattcccgcctgtaatctcagcactttggaaggctgaggtaggaggattgcccgagaccagcctgggcaagacagggggaccccagctctacaaaaaatttaaaaattagccaggcatggtggtgcatgcctgtggtctcagctattggggaggccaaggtgggaggactgcatgagcttgggaggttgaggcttcagtgagtgagctgtgttcgtaccactgccctccggcctggagggcttttttttttttttttagacgtagtttcgctcttgttgcccaggctggagtgcaacagcacgatctcagctcactgcagcctccacttcctgggtttaagcgattctcctgcctcagcctccctagtagctgggattataggcatgtgccatcacaccaggctaattttgtatttttagtagagatggggtttcactatgctggtcaggctggtttcaaactcctgacctcaggtgatccacctgcctcggcctcccaaagtgctgggattacaggcctaagccaccgtgcctggttttgtttgtttgtttgtttgttttattgagatagtctctctctgaagcccaggctggagtgcaatggcacgacctcagctcactgcaacctccacctcctgggtgcaagcgattctcctgcctcagcctcccgagtagctgggattacaggcgtccgccaccatgcctggctaatttttgtatttttagtagagacagggtttcaccatgttggccaggctagtctcgaactcttgacctcaggtgatccactcgcctcggtctcccaaagtgctaggattacaggcatgagccaccacgcctggcctcaaatgcaattttatgcaaaagtcttgatacataccaaaccattgtggttatatacatgtaggggttccttctcagttaatctctctccccataacattccaacctgtgcctctacacattttacttttattattacctcttcctattcatatctacctggggagtttctactgttatttctttcacattcagtacctgactccttttctcttccatttgctctaaagttagatgcccagcctgtcctcccagcatctggtgcatacctctcttttgagctacatcagtggttgcaaacccagttttgagaagccttttccctaactcagccatcccactgcagtatcctgacatgttttagcaccaaaagcttgaaatgagaggggttgggatccagagtgcatatcaaaggattgaattttgagagccaatagaagacagagggtgcagatacagataggattgtagattgtgataggcatctgagcagctcctgctagcagtcattcatcagggagataaaaagctgggtgccattaactgaaagagaggagaaattagactaggtgggaaataatcttggagtgctaggtggaaagagtaggctggaaggcctactagagaaatgtggggacattaggtggcattgtatcccagtagaggttgttggtaatgacttgtaatggcattactgcaccatcctctctgactttttttcctcctttcagtgatgctcagctgtttgggtatagacagcaaataagatggttgggttgggtcaggcacagttggattttattaagggagtgtacaagagggactcctaagagccaagggtgtggataaagaggaaaatgaatataagtataggaggggtgaagaaagttgtggggtcagtggactggaggttttagtgaagctgaaggatcatttcaagaaggaatttcatcggggctttggagagtcagtgaattcaggggacagtccattcatttaatgcaagatagtggatggaaagtcccaagagttggaggatatagaggtgtttcctgttcaccgagcatgagatccagagaatacattttttgttaataaagacattttaacaggtagagccaaattgcctgtgttggaatcccatctctgtcatttactagctgtgtgactatataatctctccgtgtctcggcttcttcatctggaaaatggggataaaaataatacctatctagtaatgttgtattaagggttaaatgagttattaatgtctgtaaaagcacttcaataaataccaccatataggaagtatatataagtacttattaaataaaaatagtgtcttcactatatatttaatatataactcttttaaagtgttaatgcctagcaactgtttccttcctctccccctctatttattcccataatcttataattaaacctttgccatatgctcatttgcactagttctctacacattttttcattaggctcgtaagactgtgctaatcattcagaaaagtatattttaaatatctctattttatgaattttattttagctgttaaacgtttaatgaaagaagcggcagaattgaaagatccaacagatcattaccatgcgcagcctttagaggttagtttctatctccatgttcttcatatggattttaatatttaaaacaaattttttaaaattgcttttcattgctttgagtcattacagatgtgtgtgatgtagtttgacgttttattcaccatatttcatgaatatttcattagccattccaaatcactttagaagaaacggattttgtggtctttataaaatgggtctcagatgctaagttgaggttagatctttttttttttttttttttttttgaggcggagtctcactgtgttgcccaggctggagtgcagtgatgtgatctcggctcactgcaacctctacctcccaggttcaagcaattctcctgcctcagcctcctgaatagctgggattacaggcccccaccaccacgcccggctaatttttgtatttttagtagagacagggtttcaccatgttggtcaggctggtctcaaactcctgacctcgtgatccacccgccttggcctcccaaagtgctgggattacaggcgtgagccactgcacccggccgaggttagatcttgagtctgagggaggggaggtggaaagaaccccagatactttacagtttggaagccttttgatgggtctccgtagctactcaaggctttttgtataaacatctcggcctctctcagtcttctcatttgtaaaaggagggtatttaaatatacccaggcaggttttcatggtaacagtgggaataaaaatatcataacttaagtgcaagtattttgtaaactgaaaagtacatggtaactgtaagatgacattaaatacattagtattaccattttataaataagctcttaggcatctataagggataatttttaaagatttgttaaaataacccaaacatagtaattttttgattatataattatcataatttgctattctttcaaggattaatttccaatttaaacctgtaagttacttatgaatatataacaacactcagaaatttttaatgtgtttattataaaatattttagctcaatggaacatgaaagctagattaaatagcttttacttataaatttaatttatcacttatagtctcgagacatctcatgcattagaaactatactagcaataatataaagcatttaatttttcttgcttggtaatatttctaatattcagataaaatgatcaaacttttcaatattattaattccttgtggattattgtttttgttcaggataacctttttgaatggcacttcacggttagagggcccccagactccgattttgatggaggagtttatcacgggcggatagtactgccaccagagtatcccatgaaaccaccaagcattattctcctaacggtaagaattttggatttttagagtgcttgtggcttcactcttcctggtagctgcaaaatatagtaagcaaatcattttcattaagaaataatagaacagtataattttgcttttggggtccaggccctgggactacaatttttttcctccaaaataattcctaggaagctgatgcatctgagaagtaaaaatgatacaactgaatgcataaatgtcatatcatggttgttaggattcaatgaattaatatatgccaagtgctgggcatacacatctggcacttcataagtactcactaaagggtagctaatgttattgtaccttgtaatcatattgtctcctttaacttcccacctttcttacactctcttcctcagttttctcatctttacaatgagaataatgatacctacctcattgagtttatgtgggatgaaaagtatcaagatcttattgtatagctcttagaatagagcctgacacagaatactcaataagtgttagcattattattactgtttatatctcagattttctctctttctctccaaatttacacatcttttcttcatgtgaaggaaaacttttttttttttttaagagacacggtctttctctgttgcccaggctggagcgcagtagcacgatcatagctcactgtagcctcaaactcctgggctcaagctatcctcccacctcagcctcctgagtagctgggactataggcacatgccactgcacccagctaattaaaaagttttttggtagagacatggtctcattggtcttgaactactggcctcaggcagtcctcccatctcagcctcccaaagtgctaggatgacaggtgtcaccatcatacctggccaaggaaaactattgatctaattcctctttaattgttaagcttttcttctctcatttcctttaactatgtttaattatcccctaaccttgaaaaaagcaaaaacaaacacaaaaaccattccctgtatctgttatcactttaagctgtgcctatttttctctttggtaacctccaaggcatcctttccgtagtttggcctgctgcagtccaccttccacacatagtgccctgttgaaacatgaaactacaccaatctcagagaccagtttgagaaatctcactgcttctcctcagccttcatcctgttctcagttaaacatcttacccacacggagtagcaaatggtgaaacaacaggtattcatcaataaataccaaattaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcgagactccatctcaaaaaaaaaaaacataaataaataaataaataaataaataaataccaaattaatgctgcttttacctctattttgtataacagagagaacatttgtttaagagccaataggcctagattctgactggtgctctttccattacactatgggtgggttacacaatgtctttaaaattgttttctcatcagtcaaaatgaatgttgtgtttggtaattgtaatcacaccataaagtacctgacatatagaagctgcttaataagtattagctgatatagagaactgctaatgctggcagtagagttggagcagggtcctggagacactctactgtgtcaggagtcattttatttagttgctagatcatggggagagctaagtggtcttcggggagggaggggctggtgcatggggagactggtggtggtggaggacagtagttagcagcagctctttaccaacaaatacaggtatatttcaatagttagccaatggtatggtcatactaaccacactggctgagaatcagccctgattttcaacattacactctttctggttcacttcttttttgaaaagtcttctccaactttcattcaataagtatttatttatcctttcattcatcactcctctgaaaatcacacctctctcagagcctttctccccatgtctttcctcactaacatctagttaggtgatactgagtccttaggtttcgtcctggcctcttgaatgtcttctcttttagattctttttttttttttaacttgagatagggtctcactctgtcacccaggctggagtccaatagcatgatcacagctcactgcagccttgatgtcccacactcaaatgatcctcccacgtcagcctcctgagtagctgagactatagtcacacataccacgcttggctaaattttttttatttttattttttgtagagacagggtttcactttgttgcccaggctggtctcaaactcctggcctcaagtgaccttcctaccttagcctcccaagtgctgggattacagacatgagtcaccatgcctggcctcttttagattcttaactgagcctagctccatactaggcacagggtaggacattagtaaatcctctcccctcccctcccctcccccactccttccctcctccccttccccctcccctctccttcccccctctccttcccccttcccctccccacccctcttccctccccatcccttcccccctcccctccccacttccctcccttcccccctcccctcccctctctcctcccccatcccctctcctcccccctccccccctctcctcccctcctctcctctttttttttcttttcttggggacagggtctcacactgtcacccaggctggcatgcagcaatgcagtcatagttcactgtggccttgaactcctgggctcaagtaatcttcctgtcttagcctcccaagtaggtaggactagaggcacatgccaccactcctggctaattttctttcttttctttttttggtgacagtgtctcactaagttgctcaagctggccttgaactcctggcctcaagtgatcctcctgcctcagtctcccagagtgctaggattacaggcgtgagccacttcgctggccagtaaaactttacatgttaattatttagatttcacttgtgcaactcagtttcaaaaggtgctgtaaaacaccttctaaaaacagcttttattattcagcatccaacaagtatttttggagtctataaggacaaaaaatctgtgtcccatgagaggttacatttaaaaaaaaatctttttggccgggcgcggtggctcatgcctgtaatcccagcactttgggaggccaaggtgggcagatcacaaggtcaggatatcgagaccatcctggctaacacggtgaaaccccgtctctactaaaaatacaaaacattagccaggcctggtggcaggcgcctgtagttccagctacttgggaggctgaggcaggagaatggcgtgaacccgggaggtggatcttgcagtgagctgatatcacaccactgcactccagcctgggtgacagagcgagactccatctcaaaaaaaaaaaaaaaaaaaaaaaaaacaaactttttaagataatctctaaaattattatatataaatagtatatttttacagaaagtataaacattaagcacatgtatttaattttctaaatgcattgtttattcctcaggctaatggtcgatttgaagtgggcaagaaaatctgtttgagcatctcaggccatcatcctgaaacttggcagccttcgtggagtagtaagtgttaatttatagtgaatataaatctcataacttcagtcaattcatagttatgaagtataatactctgattttttctttttccagaataaacccagttgcttttacaaagcaatttagattgatatttacttttttatttcagtaaggacagcattattagccatcattgggtttatgccaacaaaaggagagggagccataggttctctagattacactcctgaggaaagaagagcacttgccaaaaagtaagttttgcatttcattcttcttgaggtctgaatagtattcagggtaatggctattaggaggtagggcctacctcttactatgtgacttattttctgagtgactgtagctacaggatcttatctcagttttgctcttttaggaattcagttgtaataatttccttggagtgaccagaatctaagtaatttatttaatgctatctagtcttaaaaagtagttgatactatttcactatttttaaaaaattcagtgggagatatattctcctggaaaacaataccagtcatttgtttccactatggcattatagatggaaaagaaccagagcaattatttgtagctttccacaagattacaaacctcttgagggccaagaggtaatccactttatccatctttgcatctagctcatagcaagtgcttaataaatgatctggaataaagcaaaagagattttatcaagttgtgattgcccagtggcaatcacaaacagagaagtgatgccttctctgtttttttcaggtgcaggtgcacttttgtctatatgaccaagatcagtccttccattcagagtagcccctctttgagtagtgctgatacctaatttttgatgttgataatttttctgctctggagtctgctgcctaccacccttcagacatattatgttaattaaattatatcatattttaccctagcacaccccagagtaggccctctacagatatttgctaaatcagttagattttagcatctggaagatttggtagacttcttggtcttataagcaacttttctttttaaaccttatttccaaactatgggtatgtactttatttatacagctcttcatagattacactatgtactttgaatacatagtatttgttttcattcgatttactacgttggtttttttatcttgatgcctttatccagttgatttcatgtgcgaggtaaaaaaaaaaaaaaaagaactggagttcttgttcttctaggcttctcactgtatattctagattctcagtctataatagaaaccttttaaaaaatgattttgggccgggcatggtggctcacacttgtaatcccagctctttggcaggccaagacaggtggattgcttgagttcaggagttcgagaccagcctgggtaaaatggcgaaactgcagctctacaaaaaaatacaaaaattagctgggcgtggtggcacgtgcctgtagtctcagctacttagagactgaggtggaaggattgcttgacctggggaggttgagactgcagtgagccatgattgtgccactgcactcaagcctgtgggacagagttgagaccttgtctcaaaaaaaaaaaacaaagatttttgcattcaaccgtggtagcatgctaccattgtggataaactaatacattcaaaataaacactccccttaaggttcatctgactcagttaaaagtgaatacattttgaagcaaataatttgtatataaccaattctcaaaggtgtgtggtcaacagtgccacttctggtaaaacaagaaatactcatcaataaatactaaattaggctgggcacagtggctcatgcttgtaatcccaggactttgggaagctgaggcaggaggatcgcttgagcctaggagttctggaccaatctggataacacagggagacactgtctctacaaaaaaaaaaataataataaaatgaaataaaaaaaaaaaataaaataaaataaaaattagcggggtgtggtggcacacacctgtggtcctagctacttgggaggctgaagtgggaagatcactggggtctgggaggttgaggctgcagcaagccatgattgcaccactgcattccagcctgggtgatagaacgaggagaccctgtctcaaacaaacaaacaaacaaacagaaaaactaaattattgctacttttacatatattttgtttatatgatatttcataattttaaatagcatgttcttcaagacctaaggttttttaatagaactagaagtactatgaaaaacaattttttagaaggaagtttaacagtgtaacaatatatgttttatatatgatgcatgtttactttcagtcattcatatcctcagaggactcttgtaaacttcaaggaagttttgactatatctggaatacaaagggaaaaatggaaaaacaaatatattttagaaaataatctagttaacagacatatcctgagtctctacctaatgtataatcagcaataaattaagtctttggattttctgcaagttctcccaagtctttcaagttatactgctatttgtgaggggtttttttttccctagaaatatctgtaaattctatgtttaattagtttctttactgctttatatatatttctgctaacagataatttgatcttgttaaaggacttttttcacagccttaaaataggtttgttatatgtgatctcaaggacagtataatagacaattttctcattgtatagatgtaaaacttatttttctttagatagtttattggaaaaaatagcatctgagccctggatttttttaaagccagcctaacatttacttgtctcaggactataatcattacattaattttctaattcatagcatgtggataaatgtgatgtggaattttccagtgttcctttcttttaagtttaatgatcgagcatttgagtgtctcagtgagagggaattaaacatttaactatttattttcatttaaaaaatctttttctactagatcacaagatttctgttgtgaaggatgtggctctgccatgaaggatgtcctgttgcctttaaaatctggaagcgattcaagccaagctgaccaagaagccaaagaactggctaggcaaataagctttaaggtactataaattcttaaataaatgctaatcttgcaacccttttgtttactgctggattctgcatagaaaggaaagcgatgcagttctattacaatatgacatttgccaatgtttttcttttttcatatttttatatttttaatttctgtggttacatagtaggtgtatatatgtatagggtacatgaaatgttttaatactggcatggaatgtttttcttattacaaaattcctaactacattcatgaaagctttatagaatagtgagggagtgaaacttgaactctggtatacaatgccagggttcaaatcccagctctgttgcttattagtagtatgatgtcagacatattaattaaccactttgtgcctttttattatctataaataataatggtacctaaatcataggattgctgtgaggattgaattaatatatgtaatacatgtgttgcattcagaactgtccctggtgcttaataaattctagctattattacagaatatatagataagcaacaagaagaaaatgatggccgggcgcggtggctcacgcctgtaatcccagcactttgggaggccaaggcgggcggatcacctgaagtcaggagttcgagaccagcctcaacatggagaaaccccgtctctactaaaaatacaaaattagccaagcatggtggtacatgcctgtaatcccagctactcgggaggctgaggcaggagaattgcttgaacctgggaggcagaggttgcggtgagccgagatcgcgccattgcactccagcctgggcaacaagagcgaaactccatctcaaaaaaaaaaaaaagaaaaaagaaaaagaaaatgacattcataatctcaccgccaagaaatagctactgttaatattttggcatccctcctatatatcccttttttctgtatatgttttacccgaacataggattatataatattttaatactttgagtattaaatatttaattattgaaggtattagctgggcgcagtggctcacgcctgtaatcccagcactttgggaggccgagacaggcagatcacgaggtcaggagattgagaccatccaggctaacacggtgaaaccctgtctctactaaaaatacaaaaaattagctcggcatggtggtgtgtgcctgtaatcccagctacttgggaggctgagtcaggagaatcgcttgaacctggaaggtggaggttgcagtgagccaagattgtgcctctgcactccagcctgggtgacagagtgagactccatctcaaaaaaatataaataaataaatacatacatacatacagacgtaaagtattaagtatttaatccttctggaatttaattagcttcacaaacagaaatgtcaacctgcattaagcagcatgctctcttcctcttccctctccacttctctatggactgtctgtctttccaggtccagttcccttctcttttattgtagtgcctggaggaggagttgctcagaacatgtttactttcttccttctgaggattcctattacacttaaaattgcttctgaaaaatctcaggaccaaatgtgttttgtacatgagaatttttcagacttaagaaaagatcttacatataccatatattaactaacctgccgtgcgatctggggcagcacctcataatcaaatccattaggatttcttcagcaaatctgggaatattacattaatgtgggattaatgtttacactaatgtgggataaagactattcataggttcacatcagctcatatcaggctttgcctaaaaattaccaaaaaaaccttgagttttgagagctttttagcattgtggattgtgaaccatgggtgttagttttgtccctcatcaagtaacggcttcttgagaacaggtgttgtgtatgcttcttcctatgatacctagtacagtgttggacacaagagtgctcagtgattaactgcctgataatagatattaaactagcaattaaaataaatccaacagagaggatttagcaggttgtagattgtgtatgtttcctgttgtttcctgttgtcacactgctcttgggtctatcttgtttataggcagaagtcaattcatctggaaagactatctctgagtcagacttaaaccactctttttcactaactgatttacaagatgatatacctacaacattccagggtgctacggccagtacatcggtatggctcttatcttttaatatatatgtatgtctctatcattatcactgtttgcaataggaggagaagatcctggatcaaatatctgaaaaatttggttctcttaacaactggattctaactcatcagtcccgctaatgaattattatgttgagcaagttgttcatgctttctggcctcagttttctttttttgttaaatggggctggattaaataatttttgtcttgtccctccagaattctgtgattctctgaaaagttaattttaatatagtgttagactgaataaaacaaaatatccatatgttagccactttctaaatagacactatttttggcaggattgttcagctgcattaaggtactgacttaataaagtcgtagagccaaaaatttacttagacttgctctgtccaacacagtagccaccagccacatgcaggtgtctacatttaaatttaatcaaaatcaagtagaatttaaaattcagttcctcagtcacaccacatttcaagtgctccatagccacatgtggctaatgggtaccatattggacagtgtagacataaacattactatcatcacaaaattctgttggacaatgctacctcgtatatactaagtgtccaataaataattgttgaataaaagaatgaatgctatgagtgttgttagtggtgccctgacctgttgtctaagaaattgtttggcctaggtgatcagagagagtgatttaaaaaatatgactggattggtgccaaaaaataaggattatgggaaaaaaatgattttccttcctatatataaaagattaactgtctttggaagtctttttggtaacagattgtttggttaagtagtcacattttttttgttgttgtttctccagtttattgaagactttaaagggtgagggaaaattgaaatagaagttgggcaaatatagatttgccctttacccagcaataacgtacgtaaagtgggagtgaatagtcttgagtgagtctctcctattcagagagtgagctgggcagagaaaagttggttgaagaagaacagggtggtagtctagggggactgaagatggaggtccaagaaaaaagtgtgtagcgatgagtttaaatcatttttgtgtgatcccaatgtaattttatgaattgcaggggaaaacaatgaattaattttaaggtcaatatgttttagttcaagatattgaaaaagctttctaattactttttatttcatagttttttttctaatagaagcattctattacaaaaaggaaggtggtaatcttttttcaccttttaggacagcctcctaatgtttgtgatgtatttaaatcttttgtgtattttcaatctatgttaagtccccttgttacatattccagttatacttattccagttgtaatttactttgtaattatttattgtctatctctcttcccagaatgtaagttctgtgagggtcaggggtctctttccgcttctccactgtatccccagtgcctggcttagtgccttctatatagtagattgccaatgtttgtttgttgattgaatgaatgaatcttaggattggtactttaaaaaatgctaagaatacaattaaataaatcaagaagtttaagtaaattagagtgtacaaataatgatgttattatagtagtatttcttgttttgatttagtacataaaacttagaattcttattcatagatacaggtcattaattgagactatttttagtgaaaataccaacaagcaataaattgtctaaaattgcaagttaagtttttaattatatttacatataaactatctcagagtatgattatataatttgaccactatgaaagtaactgaaacctggtttggctaagggtggttattttacattaagtataatataaattaattgagatgttatacatcaaatcccagataagctatgatttttttgttgttgttagcctgaaggagaggcaagagattgccacaactctaaatacctcagataacatcaggccatctgttgctttttaatgcagatattttagcatcaaaaagcaatgggaaatgtagaaatgggaaaaacactgaaggcagttttgttcttgcagtctgtcagattttctccttttcccagggtagggatcgaggttctgaataagccatttcattttataataaaaagcaaaactccctcacacatgctggttattctagaaaaatttatatatatatcactagggacttaactaagaatgtgattttttatctttttaagggagagtctcactctgttgctcaggttggagtgcaggcatgtgatcatagctcaccgaagcctcaacctcctgagctcaagtgatcctcttgccttaacctcccaagtagctaggaccacaggtgggcatgaccacacctggctaagttttaaaatttttctgtagagatagtgtctcactatgttggccagactggtctcagatgcctgggctcaagcagtcctcctgcctcaacctcccaaagtgctgtatgattgttttaaataggaaaaaatttagaattttataatatcaaggcacttaatttttagttagtgatataccatccaaaaggcatctgaggctgggcacgttggttcatgcctataatcccagcactttgggaggccaaggcaggaggatcgcttgatcccaggagttcaagaccagcctgggcaatgtaacaagatcccatctctaaaaaaataatgattaaaaaaatagagacaaaaggcatctgaaacataggaacctaattaaaacattatatgtatatacatattttcattaagcgtatgtgttaaaatatcatctagaccaatgttttaagggattgtttttctaaatatattaataaaactattaaaaggccaaaaagctgtcctaacttatgacttttttttgaacctaaatttagatgcccctcaagggatgtattattagtaacaatcattcttggtagtgttgcccttagtcatatgttgtcctctgagattgtgtattcttgaatagataacaagtgtatttacaaatcttctttgccagtttcaaacaaagtttcttaaaatttcctagtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcat

SEQ ID NO: 38225 - DNA, 26275 bp, Homo sapiens; identical to SEQ ID NO: 38224

SEQ ID NO: 38226 - DNA, 26889 bp, Homo sapiens
ggagtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggtgagggtgggcgaagccctgggaagcggctgggtgtgcggtatgcggggttgtaggtgtgtgtgtgtggcgcgtggctgccttggttggtgtgactttgtgagtgtgttctgagtgggccggtccatgtgaccacgcacgtgatcacgtgcccttgtgagtgtgtgtctggggccgaatctgggctgtggggtggtcggtgtgcttgtgaccctgcctttgtgtggctgtcaccggtgggactggcggggagctgtgtgtgagtctccagcgggaggtgggggcggcacagggcttaaccggggcatcctcctgtaaacccatcctggggctacacgactgcagcccaggaacatttctttctttctttctttctttttttttttctcagcaaacttttaagaactgtgagcagaggccagtaattttggagacaggacctcggcctgaaagtgatagatgtctttgttgttactgagtgtgggccaggtgtaaggtttgtaaacgggggatgaggaacagagcgggaccggagtgtctcatttttcctcttctcgttttcctggggagttataagttagacatttatgctgcttcctttgtctccacctacactggttcagctccttttggcacaaagattcaacaaattaaggagtaactttttttttttttttttttttgagacggagtctcgctccgtcgcccaggctggagtgcagtggcgccatcccagctcactgcaagctctgtctgctgggtttacgccattctcctgcctcagcctcccgagtagctggcactacaggctcccgccaccacgcccggctaattttttgtatttttagtagagacggggtttcaccgtgttagccaggatggcctcgatctcctgacctcgtgatccgcccgcctcggcctcccaaagggctgagattacaggcgtgagccatcgcggctggccactgaggagtaacttaatagctgtgtccaaattccaaaagcttttttcccaagagcatgagaagagatgtcacagatgtcaggtaggcaccttttcctcctgtaaggtttagagataatgcaatgaagaaaagagggatagatctcccctgaagagatctaagaaaaggatagctgtgtacttctgtggtgagggatggagacgtgcattaaaaagccagttgcatctcccagagactctcagcttctaatattttgttatggctagtatttataagcacagattttccacaatgcacatcaactatagattgaaataaagtagcagaaacctctgactaattatgctggttatgtgacttaaacattgataaaggtgattttgttgactttaaagtggcaggttctgttgaagccatgagggataggggcatagtcacaactggcaggtttttttgtttgtttgtttgtttgttttttgagacagagtctcactctgtcgcccaggctggagtgcagtggtgtgatctcagctcactgcaacctccgccacccaggttcaagcaattctcctgcctcagcctcctaagtagctgggattacaggagcccatcaccgcgcccagctaatttgtttttgttgttgttgctgttttgtttgtttttttgagatggagtttcgctctcgttgcccaggctggagtgcaatggcgtgatctcggctcaccgcaacctctgcctcccgggttcaagtgattcttctgcctcagcttcctgcgtagctgggattacaggcatgtgccaccacgcctagctaattttgtatttttagtagagacggggctgcaccatgttggccaggctggtctcgaactcctgacctcaggtgatccacctgcctcagcctcccaaagtgctgggattataggcgtgagccactgcacccagccacaactggcagtttttattgtccagcagcacaagggccagagaagacagggagtccacagcacaccctgaagagggctttccttaggcaagattaaggctaatattgtggctcttttcccaccagcatgaacaggtgcttttgtttttgtgaagaacaaaatcatgagagataaaatcagttttgagctcatggtccacattctttcttattcagtactgaccagtttggtcacaatctcagttaacctttgccatatacagaatattcctcttatgatttggaaaagtatacccctttggtggatgaaagagagctaggagaacaaactttcctattcataccactcacagctgttttccctttgcagcagtgatctttttttcacttagacgtcagttggtcagatgcaacatttggtatccattttacctttcatgtactgccaaactagcacaagtgttaaaattacttgtctctacaaaaatttagtcacagcggagtggaatctctccatcttgtaagattacttttaacacgttggcatcctgaggtggttgtgaattattctgaagactgttggtaaggaacatctttctatttactgctatgggaaagaagaggatgaccgcgtgaatatgtgtgcctgtgtatgtgtgtatttgtatggtggtttggtttgtgcattgcaactgatttcaaagctatgaatgatttatcccatttggtgactctagaagcacactttctggctttagttagctaaggtgttttataaatctattgagtagatgttatttgctaaacatgtttttattttccctcctttagaatagattgtttctaataatgcaatactaggaaatgtctccattaagaagtatttagatgatatagaagtatttcaagtctgtccaggtagaaaatattccagaattaagtatatgtgctagttgctttcaattaaaagttataatcagcttagagaaagcctatagttaaaatggcttagtttttttttgttttttgtttttttgttttttgttttgttttgttttgttttgttttgtttttgagacagactctcactctgtcacccaggctggagtgcagtcttggctcactgcaacctccgcctcctgggttcaagcgattctcctgcctcgcctcccgagtatttgggattacaggcggccactgccatgcctggctaattttttttgtatttttagtagagatggggtttcgccatgttggtcaggctggtcttgaactcctcacctcaggtgatccacctgcctcagcctcccaaactgctgggattacaggtgtgagccgccgcgcctggcaaaattttttaacatattaatttttttgtttgtttttttgagattgagtctcactctgtcgcccaggctggagtgcagtggcacaatcttggctcaccgcaacctctgcctcccgggttcaagtgattctcctgcctcaccctcctgagtagctgggactacgggcgtgcgccaccacgccaggctaatttttgtatttttagtagagacagggtttcactaccttggctaggctggtcttgaactcctgacctcgtgatccacctgcctcagcctcccaaaatgctgggattacaggcgtgagccactgtgcctggccttaacatattaatatttaagataaaatggatatgcaaagaattttctttatttcactatatatatctgtgcacactaattttcagtataagactggctgatgattttcttggtactttaaagcaacttatgattttaacacacttctctaaaattaccatcttagctttgagaagagagaccattatcacaatgtcaaggttgtaaatcaagtttagtgttagaatgtctacatctgctgtctcctcggggttcagcttagtacgtctccaaggtcacagttgagtctactgagggctctgtgttcctgagggagcagatctcgagggccaccaaggaagagttccattgagtttagaatcccctgttccttgccagtccagagaactccctctaaaacgacagttcagagtcagcccgggagttaggtctcacgaatctcacctcgtgttagccgtgctaggatcaaggcttgctcttgaggtagaggaagtggtacaaagcaaatatttgaatccttcctggtggaatttcctcacttggcaataagaatctgcaacagggaactataatttcagtttcctgttatgacatagcacagatgcctgagcaaagaggggcagccttttagttgaggatgttcagctaggccaaagctcacagatgccagggttagaaggatggcccccttcattctccttagaatgtagttattcgttcaatcaacagataatgcctgctgtgtgccaagcactgatctaagctttggggacacagtggtaacacagtcatagatgaggaaacaaactccaaaaggatcaagacttatctaagatcacagagctatgaaaaccagaagtcactaagctcacaacaaaagactacacattttttcctaagggcaaatgtttcattttgttgttagttatagtgccttcaagtttacattatagatctttctgaggacattgtgtaacttttaatcacgtccatatgagtggcaaatttgcctgtattttgtattaagaactacatgtaggcggggcacggtggctcatgcctgtaatcccagcactttgggaggctgaggcgggtggatcatgaggtcaggagctcaaggccagcctggccaagatggtgaaaccccgtctctactaaaaatacaaaaaattagccgggcgcagtggcaggtgcctgtaatcccagctactcaggaggctgaggcaggagaatcgcttgaacttggagggtggaggttgcagtgagctgagatcacgccactgcactccagcctgggtgacagagtgagactctgtctcaaaaaaaaaaaaaaagggaactacatgtgaatttctggttatgtgctattacagttagatttatggtgtattgcgaatttatcaggaagcaggcttaacttaaacttctttctctaggctgggtgtggtagctcatacccgtaatcccagcactttgggaggcaagatgggaggattgcttgagcctaggaattcgagaccagtgcaggcaacacagggaggcccccatctctacaaaaccaaaaaattcacctgacgtggtggtgtgtgcccattgtctcagctacttaggaggctgaggttgggataatcacttgagcctcagaggttaaggctgtggtgagctgtgattgtgccattgaactgcagcctggacaacagagcaagactgtctcaaaaattaaaaaagtaaaaaaacatcaactcctttctctagcgtggactatccctataatcagacaggagcatctttattaaagggattcttaaggtaatgtcaaaagataactgatggtactgcagttgagaactaagacaggaagtatggtgtcagaaaaggctgtctcacatctggtcctagcattgccatgtgatcttgggtaagtcatttaaattttctagaccagattccttttctggaagaactaagggtgttggaataatttctgtaagagctcttctggtggccgggcatggtggctcacgcctgtaatcccaacactttaggaggctgaggtgggtggatcacctgaggtcaggagttcgagaccagcctggccaacatggtgaacccccatccctactaaaaatacaaaaattagttgggcgtggtggcgggcacctgtaatcccagatactcgggaggctgaggcaggagaatcacttgaactgcaggaggtagaggatgcagtgagctgagatcacgccactgcactccagcctgggcaacaagactgagactgtctcaaaaaaaaaaaaaaaagagtgcttctgattctgtgattgtagtatttcaccaaattgttttctgtagttggactatatactgacaaaatagccagtttccttggctttcttctttaaaatattgttggtatagctagatgagactctacatttagttctgatgtaaacatgaattcttgacgtgaaatatcacatgcttttatttcaggattaacctccatttcagctaatcatgggagagattaaagtctctcctgattataactggtttagaggtacagttccccttaaaaaggtatgtatggttttactatacctcttatttgcaaaatcttgtattgtttttgtgtgtgatttagatgtcatgtcttagtagtgtttgagagtaaaggttactgccgagtatcatgactgtgggttgcagaggattaagttcactccttccctgtcatgtacagtcaacttttgagactcattttagagtgaaagcaagtgtaactgtactcatttttatttatttatttatttatatttatttttgagatggagtctcgctctgccgtccaggctggagtgcagtgcactgcatgatctcggctcactgcaacctctgcttcccaggttcaagagattctcctgcctcaacctgccaagtagctaggattacaggcatgcgctaccacactcagctaatttttgtatttttagtagaggcagagtttcaccatgttggccaggctggtctcgaactcctgaccacaagtgatccgcccaccttggcctcccaaagtgctgggattacaggcgtgagccaccgcacccagcctgtactcattttttataattgcttttacatatacaagcaagcaggtatgtatgtactcttctgtatagtttagtggaaagtttacagcaactgtatagtgagtacagtcagattatattcctgttcctcagatttaagaatggggtcacattatagagcttctgtttgcaatgacatactcattctgccacagtcatcttctagaagctttattttcctgggatgtttgaaaacccaaaacacttatattgcagttgagtattgactctgcttcccaaattaatcccagatgtttggggatcacactagacaaaggcagttcaagtcactgagtagagtaaaacctttgctgattcccttgcaggagtgttagaatccagtgatcttaagatcttttgcagctgtttgtgatggctcatgcctgtaatcctagcactttagagacctaggaggatcatttgaggccaggagtttgagaccagcctgggcaacatagcgaaactctgtctctataaaaaaatgaaaaaattagccaggcatggtgctgtgcacctgtaatcccagcactttggaaggccgaggcaggaagattgcttgagcctaggaatttgagatcagcctgggcaatatgatgagaccctttctctacaaaaactagaaaaaattaactgggcgtgttggtgcacgcctgtagtcccggacactcaggaggctgagatgggaggattgcttaagcccaggaagacaagcttgcagtaagctgtgatcgtgccactgcactccagcctgggtgacagagccagaccttgtctcaaaaaaaaaaaaaaaaaaaagaaaagaaaagaaaaaatgtgagtggcaagatacacaggacaaaaacatgagcgtgagatacattatcaccatctgtgacctgtggaagtccaaagggaactgttaggcctctctggactttgccttgctccatttatctgctcctagtgatgccagtgaccctggttagtgtgctgccacccacagagtgacactgtggagtccatagccctgctagtgaggagctctcagaaaaaagagcctggaggccttgagttttttaatatgaaagtagaataaatactgatttgcattgtcaaatgtttaagcagttaatgtacttttctaaataccaccaaaagtgaaagcaaaaattaaactaggatgccgtgaataataataatagctaatatttctaggacacttaacatctgccagactctgctgagcacttgtcttacctcagcttgccttttttttttttaagagacaggatctctccctctgttgctcaggctggagtgttgttgtatttttatttatttatttatgtattttaaagagacaggatccaggccgggcgcagtggctcacgcctgtaatcccagcactttgggaggccaaggcgggtggatcatgagctcaggagttcgagaccagcctgaccaatatggtgaaaccccgtctctactaaaaatacaaaaaattagctgggcatgagggtgtgtgcctataatcccagctacttgggaggctgaggcaggagaatcgcttgaacctgggaggcagaggttgtagtgagccaagatcgtgccactgcactccagcctgggctacagagcgagactctgtctcaaaaaaaaaaaaaaaaaaggaggagggggaagaaacagagaagcagcagccctttggaagattataaagtagttctaagtagttctgtggaatacgttagccctgaggaaagaaaaggagatcagaggagtttgtcatgcatgctaatctggtgtgagctccaggttaccttgtaacaaacaaggcagtagtagtaaaattgtcagtgaaatgacagtgtaaaataacataaaaagcaaatttataaggttttccacttttttcttttaaccttccctccagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctgtaagtattactgattaaaattcagacccacgttttgtgtgtttttttttttttatgcttctgtctctcatcagctatagtaatgggcacagtttgtttgtttgtttgtttgtttgtttgtttgttgagatggattctcactctgtcgcccgggctggagtgcagtggcgtgatctctgctcactgcaacctccgtctcccgggttcaagcgattctcctgcctcagcctcccgagtagctgggattacaggcgcccgccactacgcccagctaattttttgtatttttagtagagacggggtttcgccgtgttggccaggctggtctcgaactcctgacctcatgattcatccacctcagcctcgcaaagtgctgagattacagccacgagccactgcgcccagccaggcagtttttttaattgaggaaagatactgtttgcttattttaatatgtgagatgaagccttttgaaggaggctggtgtgagtccacggtcacacagagattcagagggaacaaacctcttttggcagcctctccatgcccagcatttacgtgcattctctcctgacgcccttctctcaactcagagcggtaggaagcgttgtccttctttacagatgaagaaactgaggtccggctcacacagccagtagtggtggagggaggaactgagctccgtctcctggctctgtttctgctcctcattttatcacagcactgcttccagggttgctgagcatggaatattagacaacaaagggatttgctaacatacaagtgacttgaaaagctggcttttcatgtaaatctttgatatttgaggtgagattcattaattagctcatatgttagcatttggttaggaagtttttttgttcctgattgttactttatagctgagtttggtctaaatccagtttcccactgatcattcttgagtcttctctgggagaaaggtgtgtgggaaaggcactcttcctggtgactgatttttttttttttttttttttttgcatgcttccacattggtcaggacattggtctcctaattttccaggaaggagagagtctctttagctggcagtcgcctgcagtattcacttgtaagtggtactcccagtgggagtactgctgttagtgtacgttttatttactgtttaaagggatgaaaaggcaggtcacgtctctccttttggaaggtaactgaaaattctactgaggttaccaccaactgaggccacacaaaggaaatcagttcctcttcctcctgagagcccgtctcttacttgagaaaacagttatcatcactacctgctgcttttctcctgggtcttttcttctctggcttaatttctccagcttctttaaccattcctcacgtgacatgtttgagcctctgcaacataatcctcctttgttcagattttcagtcattcctcttcacaaacagcattctagaacagggtgggaactgccctcatcccagccctctgcagcctgagacatgacactaccatttttggtggcccctgttgatcagccagggagggggaaaccgagcaacccataggcgcccgtcccactcgggagtgctgtccagcagtgtgtttctcgctccacagtggcaggtcatgagagccttggcttctggctggatgtttcttcttcactctcaaggttcttgttgtgcgctttccctgtttcattaggaggagagttaatcaagaaaaggtcaacagtgtcttcaaaattattttgtcatcaagatgtgatcagaatgttcagctccatgaggttttggaacttatttaatatttgttagtatctagcagttaaaatgcacagatctttttaatttaaatttttttgttgttgtaattgtagattcacatgcagtgtaaaaaatagtaaagagaaatataccttttacacatttccccagtttctgccgaacctttgcaaaactgtagtacaaaatcacaaccaggatattgatattactacaatctaccaatctcattcaggcttccccagttctgcttgaactcatttgtttgtatgtattaagttgcatataattttgtcacctgtgtgggcatggatatttataaattaaagactccatgaaagtatcatcccctttcttttaggctatcatctgactcaaattctcaaactttctgctaggtagaatcagttccccattctttcttggaatggtggaagtcttatccacaaatagaattttaataatgaaagtcatacatcaaatctaaaatgattccataattcatatggcagtatccattccagtgattcatcaataacaaaatgaacctaagtgcttaaacagtaagcctgttagacgaggtttttgggggagtttttttgtttttgtttttgttttttggagatggagtctcactctgtcactcaggctagagtgcagtagtatgatctcggctcatgcaacctccacctctcaggctcaagcaattctcatgcctcagcttccccagtagctgggattacaggtgcctgtcaccatgcctggctaatttttgtattttttagtagagatggggtttcaccatgttgtccaggctggtctcgaactcctgacctcaagtgattcacccgcctcggcctcccaaagcgctgggattgcaagcgtgagccaccacgcccagccagttggttttatatgtatataaaaaaggaattcttggccaggcgcggtggctcacgcctgtaatcccagcactttgggaggccgaggcaggcggatcacaagatcaggagatcgagaccatcctggctaacatggtgaaaccccgtctctactaaaaatacaacaacaacaaaaaattagtcgggtgtggtggcacatgcctgtagtcccagctactcaggagactgaggcaggagaatcgcttgaacctgggaggtggaggttgcagtgagccgagatcgcgccactgcactccagcctgggcgacagagcgagaccccagttcaaacaaacaaaaaaaaggaattcttaggggacaaacctgagtcccttagaaatgagtttgtgacttgtacttctttttcctcatcattgccagcattaatagataggctacgtatagtcaagtaccatacttcttttgtcacaaacagaagtacagtagcctggcatggtggctcacacccgtaatcccagcactttgggaagttaaggcagttatattgcttgaggcaggcaaatcgcttgagcccaggagttcaagaccagcctgggcaacgtggcaaaaccccatttctacaaaaaagtatacatataaaaattagccaggcatggtggtgcatgcctgtgattccagctaccggggggctgaggtgggagaatcgcttgcacccaagaggttgtggctgcagtgagctacaatcgtgccaatgcactccagcctgggtgagagagagtgagaccctatcacaaaaacaaacaagctgggtggagtgactcacgcctaaaattccaacactttgggaggccaaggcagttagatcacttgaggtcaggagttcgagactagcctggccaacatggcaaaactgtgtctgtactaaaaatacaaaaatcagctgggtgtggtggtggacatctgtaatctcagctactcaggaggctgaggtaggagaatcgttcaaacccgggaggcggaggtggcatgagtcgagatcgcgccgctgcactccagcctgggcaacagaggagactctgtctcaagaaacaaacagacaccccaaagtacaataaatgaaatagagtaactaagtcatttaaaagaagaggaacaattttactgaataccctcttaaagaaatgctaccaaaaagagaggaagctctccttagaacaaattttgtttccatctctcctgagccataattctgaatgaaattagatttaagagaaaacggtatttctttactggaatgggttctgctgtattcatccttgaaccccagactttttcagctatttagaaaggaaattgatgggaattgaaattgttactcacgtaatatcattagagtgtgcttactttttatactcttttaatttggtctgttagaaaaatgtgaaatatgaagtttagtaaaaagtgagagcttatttttacatattttgaataaggagcagcgcttgagcaaacgagaaatgtcagtgtttgagtcctaagtttttcaaatacgtgagttgcatttttacttttatgatttttaaaaataaaattatcgttattatttcagttgcagtatccagtttattgggaccatctcgagttctgtgatggattcagaaaacttttagaccatttacaattggataaagtgagtaccctgaaactaattacatacatacaattttttttttattttttgagatgaagtctcactctgtcacccaggctggagtgcagtggcgcgatctcggctcaccgcaacctccacctcccggattcaagtgattctcctgcctcagtctccaaaatagctgggattacaggcgtgtgccaccatgcccggctagtttttgtatttttagtaaagatggggtttcgccaggttggccaggctgctctcaaactcctgacctcaagtgatccgcccgcctcagcctccctaagtgctgggattacaggcgtgagccaccgtgccgagccctcttttattttttaataatagctttattgcaacataattcatataccatataatttacccttttaagtatacagttccatgtttttcagtatactcccaggtatgtgcaaccatcactgcagtcaatgttttataatttttttaatgccaaaaacctcatattcattagcagtcggtcctcatcttcccccctactagccctgcaacctaatttatttttatctctatggatttgcctattctagatattttacataagtggaatcgtatcatatgtggtctttttgactggctttttttatttagcattgtgagtttaaggttcattcatgttgaagccggaatcaatacttcgtttctctttacagttaaatcatatttttataaatatgccatatcttgtttaacgattcatcagctgatgcacatttgggttgtttttaccctttggatatcatgaataatgctgccatgaacattcatgtacaagtttttgtgttgacatatgttttcagttctcttaggtatgtgtttaggggtggaattactgaatcacagttttcttagacataaaccactaagtggttttgagttttttctttttttttttttttgagacaggctttcactttgttgcccaggctggagtgcggtggtgcaatcatggctcactgcagcctcaaccttttgggctcaagcgatcctcccacctcaacctcccaagtagctaggactctaggcacgtaccaccatgcctggctaatttttgtatttttagtatacaggccttttccatatttccctagcttggttttgttggtttctttttttcttttctttttttttttttttttaagacggagtctcgctctgttgcccaggctggagtgcagtggtgcgatcttggctcactgcaacctccgcctgccaggttcaagcgattctgctgcctcagcctcccgagtagctgggactacaggcacgcaccaccatgcctggctagtttttttgtatttttagtagagacggtttcaccatgctggctaggctggtctcgaactcctgacctcgtgatctgcctgcctcggcctcccaaagtgctgggattacaggtgtgagccaccgtgcctggactggttttgttttctaatgcaatctgtgaatgatattttttttaattatataacttggatgccaagttgtattatcttgatggactgtataaattgcatttaaatacaatattttctaaatttctagctgctgtaaatattttagtctattggctagtgataacatattctgtggttagtgataattgaagcaactttttaatactcaggttcaagattgatcagtatttcagaatctgccttatatttgtttataattaggttcatctttttggcgcttctttgggaggctttttggcccagaaatttgctgaatacactcacaaatctcctagagtccattccctaatcctctgcaattccttcagtgacacctctatcttcaaccaaacttggactgcaaacaggtaagaacaaaattactttttttgttcagtgaaattttgaaaatgttggcttttgagtgtttggtacattaggaagggaagacttatatctacttctatattctgcaacttccttggctttttttttgagacagagtcttgctctgtcacccaggctgaagtgcagtggtgcaatcacagcttactgcagcctttatttcccaggctcaagcgatcctcctacctcagcctcccaagtagctggaactacaggcaggcatgcatggcaccacacctggttaatttctgtatatttttgtacagatgaggttttgccatgttgtcccatgctggtctctaactcccgggctcaagccatctgcccaccttggcctcccaaagttctgggattacaggcatgagccactgtgcccggctctttcttggcttttaaaattagaaacaattacctttgcaaaaggaaagaattgaatgaactctaaattcagctttttttattaccttaaatttttaaattttgtttaatattcattaatatacttttgctgtttttattcagtatttctatgtaactaataccatgttctgtttatcccacttattattatgtgtaaacagttccgtgtattgactgacatagttttattaggcatttggcttttcccaattcttcatcacattctacagtaaatctttgtacaaattactgggttttttccctttccaatttatttccttgagatatgttctccaaatggaaagaatagagcatttggtctgtcaacagatgttctgcacatcatgacccttgatattagtctgttcttccaaaagatagaaatggtggaaatgaggctgggtgcggtggctcacacctgtaatcccagcactttgggaggccgaggcggccggatcacctgaggtcgggagttcgagaccagcctgaccaacgtggagaaaccctgtctactaaaaatacaaaattagctgggcaaggtggcacatgcctataatcccagctactcaggaggctgaggcaggagaatcacttgaacccaggatgcggaggttgtggtgagccgagatcacgccattgcactccagcctaggcaacaggagcgaaactccatctcaaaaaaaaaacaaaccaaaaacaaaatggtggaaatgctttgggtgcagccagtggggtacttgtttcctaggagccatcctttcattgattttatcattttaagtaattggtaggtatctatgatgccatacagctggcttactgtgcacttctttcattgctggcaaggcgaggctctagccttaaaataaagcccagtggccaggtgtgatggctcatgccgtactcccaacactttgggaggccaagacaggaggatcacttcaggccaagagtttgaaaccagcctgagcaacatagtgagaccccatctctacaaataacaataataataaattagccaggtatcatggtatgcacctgcagtcctagctactcaggaggctgaggcaggaggatcgcttgagcccaagagttcaaggctgcagtgagccacaactgtgcctctgtactccaggctgggtgacagagcaagaccctacttcaaaaaaaaagcccagtgagtaaacacatctgtatgatcagtgttttcaaataatgtatagggaaatatcgttttcacatctacttaaaattgcactctgatattttttagttttttttgttgttgtttgtttttttgtttgtttgtttttgagatggagtctcgctctgtcgcccaggctggagtgcagtggcacgatctcagctcactgcaagctctgcctcccaggttcacgccattctcctgcctcagcctcccgaatagctgggactacaggcgcccgccaccatgcctggctaattttttatgtttttagtagagacggggtttcaccgtgttcaccagtatggtctcgatctcctgacctcgtgatccgcccgcctcagcctcccaaagtgctgggattacaggcatgagccactgtgcccagctattttttagtttttctgatgttatcttagtaattactcagcattcatgcaacaatttcttgtatacattagctactttacaaatccttcccgtccagataatgcactaaataatgctcattatttttggtgatttttattgctgttctaattgttagaatgccaagacagcccccattcagtttgtgctctggcacatcagctgcttattgtcaaatatctgagtgcttactgtgtgccacacactgaggatccaggagtgagcaaagtcaacagggtccaccccttacagagcgtacttagacctcatcaccttcaaaagataagaaagtgatggggctgggagagaacttagaaagttaactggaaggtgacctagtggtccttttgagggaagctcaacttccagcaaggctgtcccagtggtaataagcatcagaaggtagtttgcacctcatctaagtaattttcgtcataggtttacagaaattagtgtttgccctccatgatggctcttaacagttgaaattaatggaataaatataaactaaagatcatatatagaaatccgtaaagatctgaccagtcacagtggctcacacctgtaatcccagcactttgggaggcagaggtaagagcattgcttgagtccaggagttctagaccagcctgggcaacagagcaagatcctgtctctacagaaaaaaaattttcttttttgagatgggagtctcgctctgttgcccaggctggagtgcagtggcacgttctcactgcagcctctgccccccaggttcaagtgattctcctgcctcagcctcccaagtagctgggattacaggcgctggccaccgcccctggctaatttttgtatttttagtagagacggggtttcaccatcttggccaggctggtcttgaactcctgaccttgtgatcacccaccttggcctcccaaagttctggattacaggcatgagccattgcgcctggctcagtaaatttttttttttggagacggagtctggctctgtcgcccaggctggagtgccatggcacgatcttggctcactgcaagctccatctcctgggttcacgccattctcctgcctcagcctcccgagtagctgggactacaggcgcccgccaccaagcccggctaatttttagtatttttagtggagacggggtttcaccgtgttagccaggatggtctcaatctcctgacctcgtgatctgcccaccttggcctcccaaagtgctgggattacaggcatgagccaccgtgcctggccccggctcccccagctcagtaaatttttaaaaaattagtcaggcctggtggtacgagcccgtagtcccagctactcgggaggccaaggtagaaggatcacttgataggagtttgaggctacagtgagctatgatcacaatactgcacttcagcctgggcaacagagtgagaccctgtctctaaaagtttttttttaaattttttaattaaaaaataaaaagaggccaggagtggctcacgcctgtgatcccagcactgtgggaggctgaggtgggtggatcacttgaggccaggagttcaccaccagtctggccaacattgcaaaagctcatctttactaaaaatacagaagttagccgggcgtggtggcatgtgcctgtagtcgcagctactcgaaaggctgaggcatgagaattgcttgagcccgggaggcagaggttgcacccagccgagatcatgccactgtacttccagcatgggtaactgactgagactctgtctcaaaaaataataacaataataaatttaaaaaataaatctataaatatcaatttgccttgaattagccaagttgaatctaatagtagcaaatttggggaggtgcaatagctttcatattggtattttgaaatctgttttgaaatatcaatcgataaaaacataatatcaaccagaaggaaagaatacttctcttaatattcagttttccaaaagaaatagtttaatccttggaaatagggccaattagagaaaaaaaacaatcttggactcatcagaatgtctatctcagtaaaggtattttgaaatatctcttataattatcctaaatcctcaaataaaagtttaattatatgaagccataactctttggaagcttgggaaagtgtgtgtaaaaactagatgctgagctctttggaggaggggattaggactttttatttctagatcccaagctaatacaaagctttaatgttgaatgaatatttgccatgtgtagtcttggaagtttaaattataaggtctttgtgttttacagcttttggctgatgcctgcatttatgctcaaaaaaatagttcttggaaatttttcatctggcccggtggaccctatgatggctgatgccattgatttcatggtagacagggtaaggatcatgacattgggttggggacacattgtattgggaattttcacatctacttggttccagaagatagatctgtctcacaagtatgtgtaagaggtatttgctaagcagagtaatacatctgagcagatattattgctggtaagggcttgcctacattagtgcttcccaccagctattcatcaaaatcacttaggggagctttcaaaaatacagattgtaaggcctcacagcagatcatccatctggaatccctgggcatgggatctgggaatctatttttacttcacacttttcctctacccaccaggtaaatctgatgaaccaggtctgttggcttgcatttaggaactgctgggctagatgatttctcaaatctcttttaagatcccttaaaggtttatcttaaaaaaaaaaaaaaaaacaaaaacatatatctgtcacctttgagcagtaggaattggcttgctgcccatgggcacctggctggagtaggcagtgtaggctgagggctgtaaaaggccgggtttcattggtttgtacccaggtttccagaatagaaaaatgccacaacctcctgagaagcccagttcatggtctctcacctaagttgtggttcctcactgatgacttttctggccccaccacagatgataccacctttataagcacaaatgttgtctgtggatttaatgtaaatgtgaaaaacaaaattatttcaaaaactttacctgtgtttcttcctgcagctagaaagtttgggtcagagtgaactggcttcaagacttaccttgaattgtcaaaattcttatgtggaacctcataaaattcgggacatacctgtaactattatggatgtaagcttccttttaagtaaaatagctgctttactttttaaaatgtgtatgtcaagatctcctataaaactatttgataactttcaatgtgcctcttcaaatgctgccttggcttttgtttttaccctccagctttctcaattccaaaataatctgtttattgcttatcttggatttctttctggcaggaataacaccattgaaatcaaaataggccgagcacagtggcttatgcctgtaatcccagcgctttgggaggctgaggcaggaggattgcttgagtccaagagttcaggaccagcctgggcaacatagtgagaccctgtctgtatttatttaaaaaaaataaaaataaaaatgaatcaaaataaatttaaacaagggagtctacccatttgatgtatttttgctgttctcatcaatagatattgcaccatatattgcacatatatgggcagcaaagagaaggtgcttcacaagggtaacaagggtagagaatcaagaattccatagtttaattaccacaaaagcttgcttatttttttattgtggtaaaatgtacatttaaaatatgccattttaaccatttttaagtgcatagttcagtggcattaagtatattcacagttcggcaaccatcaccattttcacaacattttcatcattccaagaagaaattgcatacccattaaacaataactcctgttccctttcttcccccggcctctgataatcaacggttttattttctgtctataaaaatttacctattctagaacctcatataagtagaatcatacaacatttatccttttgtgtggccatttcacttagcataatgtttcacaagacttatcttgaaatgttatacatgtgtcagaatgtcatttctttcttttttttttttttttttttggaaacagggtctcactctgttccccaggctggagtgcagtggtgcaatctcagctcactgcaacctctgcctcccgggcccaaacaatcctccctcctcagcctccttagtagcttggaccacaggctcacaccactacgttcggctaattttttgtagagatggggtttcaccatgttgcccatgctggactcaaactctgggactcaagctgtctgcctgcctgggcctcccaaagtgctatgacaggcatgagccaccacgcccagcctatttctttttaaagctgaataatatctaccaataaaaccaatgttggtttataccacattttgtttatccattcatccgtcagtggtcacttgggttgtgttcagcttttggcaattgtgaatagtgcttctatgaacattggtgtaaaagtatatgtttgggcagggcacagtggctcattcctgcaatcccagcactttgggaggctgactcaagaggattgcttgagcccaggaattcgagaccagtctgggcaatacaggagaccctgtctctactactaataaagaaaattaggccgggcgcggtggctcacccctgtaatcccagaactttgggaggccaaggcgggtggatcatgaggtcaagagatcgagaccatcctggccaacgtggtgaaacccgtctctactgaaaatacaaaaattagccgggcatggtggcacacacctgtactcccagctattcgggaggctgaggcaggagaattgcttgaatctgggcggtggaggttgcagtgagctgagatcgcaccactgcattccagcctgccaatagagtgagacttcgtctcaaaaaaaagaaaaaaaaaaaaaaggaaaattagctggacatggtgccacatccctgtgatcccagctacttgggaggttgaggtgggaggatcacctgagcctggggtgagccatgatcatgccactgcgttccagcctgggcaacagagtgagaccctgtcaaaaaatatatgtatatttgtttgagttcctgcttttaatttttttttatttatttttaaattattttttaaaaataattttttgttttttatttttatgggtacatagtagatgtatcctacttttaattcttttggacatatcgtttgaagtagaatcacactttttgaagtaccaccatactgtcttccacagtggctataccatttcatgttcccaccaacaatgcacaaagattccagtttctctatatcctggacccttatttctggttttttggttgatacttatcctaatggatatgaattggtatctcactatggtttcaatttacttaaaaaaaaatcatatgattattttgccttataaatggatttgttcctaaattcaaataatatggttttttgtttttgtttttgtttttttgagacaaagtctcactcagttgcctaggctggagtgcagtggcgcgatcttggctcactgcaagctccgcctcctgggttgacgccattctcctgcctcagcctcccaagtagctgggactacaggcacccaccaccacgcccagctaattttttgtatttttagtagaggcagggtttcaccatgttagccaggatggtctcgatctcctgacctcatgatctgcctgcctcagcctcccaaagtgctgggattacaggtgtgagccaccgcacctggccataatatggtatttttaataattggtttttgttgggaaattattcattataagcgtgtaaacaacttcttatcatcctctgccataatcgctgcattctgacatttgccataacatagaacaagcttttcaatggtcctcacaggacatttgctctgcctgcccttctttcaaagctgtgctcactgcctgggttcatggtcactgaaaacagcctgtaagttttagttggagatgcacttaaacatacagatttggtatggtatatttagtatacaattttttttgcttattttactttttgaaaaattttgttgcatgtaaaaacgtaaatgtgtatgggtattgaaggatgtctagaatcatatgctgcaaactggtttccccaagaaagaatagcttgtactctacatttttttggaatttttttcactgagcctaaatgacttagtttattgctttaaattaatgataaaagtaaaaagttcttttggggcttcgtgatctttttgaaacttattgacatttgcaatgattgttctctattaatattctgttaatctacttagctatatttgaggaaaaaggaaattcatggtagaatttcccccgaccccagccgggctcggtggctcacgcctgtaatcccagcactttgggaggccgaggtgggcagatcacctgaggtcaggagtttgagaccagcctggccaacatggtgaaaccccatctctactaaaaatgcaaaaattagccaggcgtgatggcgcatgcctgtagtcccaggtacttaggaggctgaggcaggagaatcacttgagcccaggaggtggagattgcagtgagccgagatcacaccactgcactctacctcaaaaaaaaaaaaagaatttccccccaccaaaagaatgcaggagatgctgtgcagcaaaatctgtagctaatgtcttcggttggagttataagtcaccagggatcagcagtggaggtagttcaggctgctgggggttcaggattgtcttcatatgaaaggaatacttagggtaacatttccataatgtgaaaagaacatattaaaacactagttgattacagctttctgtatgtgtgtgtgtgttttacctttcctatggtgctgaagctttgtgttttttaaaggtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacaggtaaggcctagcttgaaacccagagcactctgagcccaacatatgtttgcaacataaagacttcttttaatggactagttagggaatcagtgaactacagaattccttgtagaaatgaggcattgacttgataaaagtggtttacatttataacttgtaggagaatttgaacaggtatattagagatcccccagtgactctctggccaccatcccttttctaaggacagcaggcctgcattcacacactgaggttactattggtatgatgtgaccttgccctctggacacagtgaattccatcagagcaagacaccagacctaaatggggtcaatctgagtcctgtgaagtgacttcttgatctaattttaatgcattaaaagaaaaccctaccaggcatagtggctcatgcctgtaatctcagcactttgcgaggctgaggcaggcagatcacaaggtcaggaggtcaagaccagcctggccaatatggtgaaaccgtctctactaaaaatacaaaaaaaattagctggacgtggtggtgcacacctgtagtcccagctactcgggaggctgaggcagaagaatcacttgaatcctggaggcagaggttgcagtgagccgaggtcacgccattgcactccagcctgggcaacagaacaagactccgtctcaaaaaaaaagaaaagaaaagaaagccctaacaaacaccatcccttcatactctaactaaatggataatagaatagcagtgaggggtgagtgccctggcagtttggcaagatgaatcaagagccttaaaaaaccagtcatatcctggccacgcatggtggctcacacctgtaatcccaaaaaccagtcatatcccttgatcctgtcatccccttatagaagacaggatcctaaacaggaatacttgatgcccagagatattcatcatagcagcactagtcacagtagcagaagattggaaggacctaactcacagcagcagaagggaagggtaaacatctcatgagcatgcaccatctaagatgtctcaggagactctgcagggactcagggagactgctcagggagtgaggaacaaagatcccaaatgtggtttcaaaaaattgtttgacttttctctatttagtatgtcttagtctgtaaattttagaagtataaaacatttgtccactatggtgatgttttcctaccaaactttttatagaaggcagtatacattttactctgtaatgcagccatttaaaacaatgattctggcagggtgcagtggctcacacctgtaatctggcactttgggaggccgaggcagatggatcacttgaggccaggagttcaaaaccagcctggccaacatggtgaaaccctgtctctactaaaaatacaaaaattagctgggcatggtggcgggcacctgtaatcccagctactcgggaggctgaggcaggagaattgggtgaacccgggaggcggaggttggagtgaaccaagatagtgccactgcactccagcctgggcaacaagagtgacactccagctcaaaaaataaataaaataatgattctgcatttcaacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactga

SEQ ID NO: 38227 - DNA, 25607 bp, Homo sapiens
aactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcaggtagcgccgcgcggcgggctgtgtcgggtgggccggggactgctgggagcgggcgcctggtgccttaagcccgcggcggccgaagcgcacagtcatccccgctctaccgcggcccgacccaggcctcatggtcccgggaccgcttgtcacgcgtcgcctgctcggcttgggagtgggggaacgcgggccagccccagccagttctgccgtgccagtttcaccctgcctcgcccgcttgcggcgtcagcgagacttcgggcgctgcggcagccggcgaggagagggagcgcctgggggcgtggctgccgcgccgagtatctgctggaggccgggctggtccgagtgagcagctcttgggtgaagccccactcgggactaggtggccgctcatttccacttccgaagtccagcccgggagttgaccgccgcccagccttcctaattgctgggagaatacctctggggtggtggcgcaaggttggagcttcttcaccttgcgtagttaacttatctgtaaaatgggagtctcgtggaaattgctgtgtagttcattggcacgtactgagtattcactaaatacttgctaagaagacttaagcttcacgaggcagggatttttgtacactgatgaattcccagtgcctggaacaatgcctggcacataataagcattcggtaattaactgtagaaagaattgcataaatattcttggccagcttcgtcttaggtagatgatgacggtgatgactaatatttattgagtacctaccatgagccaagcgctgttctgactgctttacatgtcttttgtcatttaaccttcgcattttgcagctgagattaaagaggttaagtaacttgctcaaggcctcactagctaccaggcagaagaggtagaagtggaacccagttctgtctgattgcaagcagacagagcccaagctttaaaccaccatgtgccaagcactttacataatatgattcgttggatcctagcaacactatgaggtaaagactagacccattttatggatgaggaattggaagcacagagggcaaagaatttgctcagggtcacatagccagtaagtagcggggttggaatttgaactgagtctgctgccaaacgtaaattactccccaaacataagaattcggtaaagcatcacacctagatcacacctagacacaatgggaagcccctatgctgggcagaaataaaaagtttctacctgaaagacctaaaagcacacagtgttgtgaccaacagatcttctgtctcgttcccctcacattgtagtggggaaactgaggatcatgcatgtgacttgcctggcaggaacaggacttgaatgtaggctccctgagaatgccagttcactacatggcctgagacagcacactgcctcccagcagattacttttatcccttgacagctcactgtctcctgtgaagttggtgaccctgaggacagaggccatgtctatttcatctctgtgacctcaatgctttcttgtgtttgtgcaaagcaagtgattagtgaatgcctgtccgttgagttggtgacagagatgtcacaaatgaccaaaggattcccatattccttctgtatgtgtaaacctaagatgcgagtatgcataaatcttaatggattatctcatccagtgtgcaggttggtgagacaggtacccccatttcacagattaggaaacaacttgaaagaaaggaaaagtagcaacctggactgactccacagttcctgactccgggctgtactggaagcgcttaagagtgagggcctaagcacactagcagggatggaacctggctcctctctttaccagttgtgtaaacttgaacaaatttttttttaatcctcagtgcttctgtatcaactataaaatgagatgataagagtactaatagcatagagttcttgaggattaaacaaattaacgtatgtagaatgctcagaacaacctggcatgtaaatgctcactaaatgtgtgctacttttactagatcacgtttcttcataaaatgagaataaagagtgtcttccaccccagccattcttactgccttcttttcaccttagtgggtggaatttgtttcagttgacacgaagactaacagctgagctgttaaccttctggtctaattttctttggcccatggatgcaagctaccttgtaagtgttggccatgtctgtattcctttgtgctcaaaggagatgtgcgttaggtgaaggcctgtttaagggtcccaaggtactacctctctgtttcagatcgcgctagcgagcttttatgaggacggaggggatgaagacattgtgaccatttcgcaggcaacccccagttcagtgtccagaggcacagcccccaggtaagggccagcttcaattatcgctacatgagtgtttccagcagtgaagaggagctattttctgaccagagcgttcaggcctgggtgtgtggaccaggtctgaatgagaaggttagactgagtcaatgggtagtacttcccagcaggcctcagtcatttcctatacagagatgcatgacttttaactgggtgtggtttatggttcaatcctgggggaaaccacaaacctacttttaagacttttacttatgtagtatgaggaatgaccactgcaactctaaagtttttaagtaaaagccaaaaaacttcctttcaagggtgctatagatgtgaaagtttaggcgaaatgacttaggaaagctgttttgatattttaggatgcccgttaccttattaagaagtcttgtacaaaataaacctgtgtaacccaccctttgccaagttgattagggagaccttgtcttactaggtaaaacagtgttaacctttgcaatcccatttgcatcccctgtcgctgcctcccacagcacccacagcagattactcctgtgctctgcagagtgagacaatgctggtcttccaggagacaggcaggggtgcttcctgtaaaggtgtctgaacctttacagagagtgtgtaagcagaggtgtctcccctctctgctttcgccttattgcttctactctctagtgtatgttttagccaggaaattttatttgggtttgaattcaaccccagaatataaccaacagtgtttctttgccatgaagtggtaaattatgtttctctctaaaggcaactgaggtttaaaatatatttcctcccttcgaagaaggagcactaaccccagatctcattgctttcttctttccctaactcccatccagagaaaagaggtaggaggaaagtgatcttgtaactgtttgcacgtgctaacctatgagatgttggtgatggcacatctgggtattactgcttgggacatgttgttagggtaagtgctgttcttgcagctgctagtagagatggctgattttctggggtatgagtctttgacagccaccttagggtgttgttgggatgttggcatgtcagaattatagagggggagagatttaaacttagtctctaatgccagttacatgtttactcctttcttttctccagtaatcccaaagttctattaaggcagtggtttattagcatgggcccaggagcctgactgcgttggttcaaatcccagctctgccacttaagtaaaagctttgtgaccttgggcaggttacttaacgtttcagttcctcattttcctcgcctgtcaaatggtaatgatagtgcctaccacatgggagactgaatgagttaatacttacaaagcaaatagaacacagcatgtgttgttattataattttagtattatcatttttagcattcattctcaattgacctgttttgtttactctattccccaacaagtatgtacatttaagaataggcataaaagtggccaggcgcggtggctcacacctgtaatcccagcactttgggaggccgagactggtggatcacgaggtcaggagattgagaccatcctggctaacatggtgaaaccccgtctctactaaaaatacaaaaaaaattagccaggtgtggtggcaggagcctgtcatcccagctacccgggaggctgaggcaggagaatggcgtgaacccggggggcggagcttgcagtgagtcgagattgcgccactgcactccagcctgggcgacagagcaagactctgtctcaaaaaaaaaaaaggcataaaagtaaaagaatcaaggacatagagtttaacattagaactgaagtgagtaaaaagactggacgcacatttggtccaagaggcattgctttattgctctggttaaggctcagacttggtagtaggcttagaaaagaactgaagacaagaaaaagggagggaggagggcgcagtgtgttgcatggtttgtccttgttgaggaggaaagcaaatgctaggactacattctcaggaaaaaccaaacttgtgctagcacctcagaggaattctgtgtggggcctgcctctgctttgacctggcagttgcaggacacttagccagctgctgccctctcccatcccccacttttgacttctcacatacccttttatgttgtcactgctgcctcagagcaacacccaactctagaataaggattcttaatatggagcccgagaaccctaggaggaatctatgaaatgagcgtgagaaggtctctattaatacctgaaattacaggcaaaagtttgtgtacatgttagcaggtatcttttgtggcaagagagtccatggcttttatgagattctcaaagggctgacagacataaaaatgttaaccattgctataggagacagtttaaactcagtaataacagctgccatttattgagtatttacgagtgaggcactgagttaagcttttacatgaacatctttttagtcctcacagcaaccctgtgaggttagtactgttgttagtactgttagcactgaggttagtactattcctattttacagatgaggacactgaagttgggtatctttccaagatcacagagctagtaaaacaaggatttaagtgtagggctgttttctacattcagcatttcagctctcagccccaacaatgttctgcctcttcttgtggacattcaaagtcctccagagtttacccttggacccaccttcctaatctgattcccttttcctcatttcttaaatcctttgttccaaccaaactgatttctttggtgctctaattcttccttatttttggttctcctgcttttgtttgagcctctcacctgatcaggtgtgcccgctctcttgctttctgcctatacaaatcccatgcatccttccatgtttacctccatccccactctgctgagcgtgttattgctaaccctgtgaccaggctgcacgccataattctgttccacagaactccagtcacaactatcactccttcagttctttgactatatccatgtactactgggtggcatctctcccacattgccctgaactcttttcctgatatttaacttaatttttctccccaagtaaattgtaaattcctggaagtgggacggctagtatttcaggagcagtcaccaaagctctgccatgtttctcacctgtgttctcttctgatactgttcaacagctttgaaataggtaaggtgcttaccatttcgctggtcaggatgctaattcttagaaaggtcaagtaacttacagctgctgttaccacagattcaaggcgaagtctgcctaagtccaaagctgcttctgctgccacatgctacctccctgccagcacctcccacccctgtatgcagggtcaagcaagaggtaacagtttcttccttttttcccctctttcatccagcaaaagttgtactttaaacttccgggaactacgattgtctgattctctaaaattacacgatccaacaaggtagctactagctatttaaattaattgaaattaaacaaacattgttactcgttttctctaaccacatttcagatgcttaatagccaaatgtggctagtggcttctctgttggacagtgcagatagagcatttccatcatcacagagaggcagagctagggtaaccggattaaaagcagaaaatgtcatctgatgaaggagttttgtgccacttcagtatgccagagtagcctgggagatagttctaatattgaaaaattgaactttctgagatatttagccaatttgtagagaccataggacaaaagtattgtgcaattgctaatatccctaggacatccatgccataaggtaactgaaagcattactccagacagtggttctgaacttgaatatatgtcggaattacctcaggggctccttaaggctagattgctggataccccttccagaggctctgattcaggagaattaagagggggcctggggatttgcatttctgacaggttcactgtaatgctgatgctcctggtccatgaccacactttgagaactgctactcaagagtagtacttaaatgtgccacaccatgcaaaagactttccgtgcatcagtaccccacctgcacacagaaagcccataggttggtgctgtgattgtcttatttacatgtgagaaaatgaaggctttgagaatttaaatagcatgtccaagatcccaagggtaggaggcagaattgggattggaatctggtacatggataccagaatcaatgtcggataccatcagagtctgggtgtatgagttttgggggaaagaaacaaagccatagcagagcaagtgatttgcccaagcaagtgtacacacatatatttgaaagtttaacaacagggagatagaaaatatttttttcatagatgctcatcctagcctagtcattggaagaaactttaggctgagcatgtatggaaaattccctttgggaagatgaatgagtggaactagtactctcagggtactagtacagatctcatcacttggatccttttgaaccatgtcatatcaagcatcaaggaatgcccggcagactgttctcaggagccaactcatgcagggagcttgtttgctacattgattggtttttgtcttctcacttctagttgatggatcctcaaaactcttctgtcccctgattgtctccttgaaataaatcttcaagactgaactggagctttcttcctagtaaacagctcattaaagcctcactaaacctgtattactctctgttagtcttttctcacactgctataaaaaactacctgagactaggtaatttatgaagaaaagagatttaattgactcacatttccacagctgtacaggaagcatagctggaaggccttaggaaacttacaatcatggtagaaggcgaaggggaagcaagcacatcttcacatggtggcaggagaaagcatgtgtgaagggggaagtgccagacattttaaaacgatcatatcttgtgagagctcactcactatcatgagaacagcatgagggaaatccacctgcatgatccaggtccctcctccaacactgggaattacaattcaacatgagatttgggtggggacacagagccaaaccatgtcaccctctttgtcccatattatatggaagctgcttttttcccctaagaaatacagaatttttttaaatcttgataaaacttgtcttatgatccttgaaaaacttaagcttgttccttgaggacagatctaaactaggtggaaagtggcagtggaagataatttcagagagaattaacccttctcacgctcatttttagttgtgcccatcccatacaacactgctttttttctaaaaataaatacttcttgactaacctgcagcagaagtacactggagcttgcttttcctccagtgctgtcaccctcgtattcattcattcctacttcttggctatgtgtccttccttcaactctctggtctctgtgcactgtgtatgctgctttcctataatgctacaccaaccccttttccccagcagccccatcaccatgattgtccactagttctttggcagttggtccaaatatttcatttttctgggaagcctttcttagtttccctgttactccccgctgtctgtactacttaagtctgtactcatttttagttgtgcccaccccacacaacactgctttttttcctaaatattaataaatactttctagtttttattaaagccagggcagcttaaattgggattccattttacctcatgataggactttctaatttatactcaatctgtgtgatcttgaaaaaataaatgccacattattttatgtgtaatcttaggggattaacctttctccacataacgtcctcctctcgcctaccaaaaatgtaacctcagtgtcttcacctccttagcagctggtgatgagggttacctttcttaatgctccctgagatcattttgctcctttctgtgtctccagtgataatagagtgacatccttcagagacctcattcatgaccaagatgaagatgaggaggaagaggaaggccagaggtgagtcttctagagggggtcagggggacagttcacagggaagtccagggtaatgtgtaaatcacctagaacaggacctggtaaacatgtttggttattgttagccattactactgtgggctggtctgtgtgggttatatcttaggaagtctcttctactccttgtagcttagaagtgacccctgttccgttacttaatgtatttattgaggaatattaggggagggaaacaaggaaaagatctagcagtcccactttttggtattgactaaaaagatttgaaatcagtttgtaaagaggtgtctacgttcccgtgctcattgcggtgctcttcacagtagcgaagttatggatcagcataagtgtcttaccagcagatgaatggataaagcaaatgtggtgtatatacacagtaggaatactactcagtctttaaaaagaaggaaattgtcattttcaacaacatggatagagaacattatgctaactaaaataagccaggcacagaaacacaaataaagcatgctctcgtgtggaatctagaacaattccaatctagaacaatcgacagagtgtggttacagaggcagaagtgagggcataatggggagatggtggtcaaagggtataaaatcttaagacaggaggaatatggtttggggctttttcttttttagatctcttgcacagcatgatgaatatagttaataaaacagcattgtacatttcaaaattgccaagtgttaatttcaagtgttctcaccacaaaaattttgagtatttgaggtgatgaatatgctaactagcttgatttaatccacttcatattgttaaagcataacatcactttgtacaccataagtatatacaattataaattgccaatttacaattttaaaaaataaggaaaagaaagaaaaagttattcattatattacagtccatacgtaaccaggtatccattttttggtatatttctttccagctttttctttttaatttaaaaaacatcatgtaaaaaacagaataataggcttataagtgtatatttcccccaatagacatgtacccatcaactatttgtttttaacctttagaacattataataaaaatatccattatggaaactacagactagtataatgaaaaagtcttaaactcatctaccctttggtaactacggttgatattctggcatatttccatccagtctttgttctgtatataaatatggttttgctggatcaatgctacatctcagacgtttccccatgtccttaaaatccttcatatgccttttcatatgctataataataatccattatatgggatgcctgacatttagatttttttcaatgttttactactgtaaatatcagtgctatgaacatttttgtggattaattaaccacatttcagattttttttaggatagtttttaaaaatggaaataccaggtcaagggcatgcatatttttaaggctcttgatcacaggctcccagttctgaagccagggctttgagatcccttaataaagactttatagtccatttagcagaacttcatctacctggaatgaacaagaatgaacgccagcctcatttcatgggttttggttctccacaggatctgcctcggtctgtcagacattcctaaggaaaattgtataataactatttcgggaatgcagttatctcatcatggtcagtctttggggaagtgggctgagaaattacatgtgttctattctctattttcattcctattgtgaccttcacaccgactcaaaaccttccttttagatacttctggatataaaaatatatgttaattttggggtttcacactcctgagtgaaaggcagtgtcatcaagtacgtgaatgcccagctcctaaatgtctttctcgttctcctcccacccagtcacgtcctccaggcagtgaccttcctttatttcacattccgcttacttccttgacccctcagcatttcagacctgaaaggacactggtactgttgtccttgtcggggcctgtggctttgcctctcattccctggtgaatgtcaggaaatagagggctgagactaatttttataggttctcaatttttcttgcttggggacaagctgttgacttagctctgaataggagtaataaggaggcagtgggccaggctgcatgacaactggttttcaggcccatataaaaaagtactaactttattatctcaagccatgcctggcctattgcaaagcccagtgtgggtgtcttggggcttgtatttgagattggagcttctctgacctccagtaccctttcctcaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaaggagcaggtaggtagggcatgtggtccttccctcccgtttcaaagacaaggaaagtgagtcacagagtagtgcactggcttacccaggacatacagtggcagagccaagactggagcctagctgcttgtactaaccatgccagtgccaccattaaccccaagtcactagtggtagctacttctgactatgactgtagtcactgtctcctggagaggagcctggccaccagattgatagtcccagctgagactctctcctgaactgataagctgttttgcatgcttggaatgcctttccccagtttgttcacctgataaactcatccttatcctcaagattcagcccagaagacacccttaaaggaagccttggctgtccttcccacccagtgttccctcactgacttctgttgctgctcacactgcattttacctgcttgcctccttccatgtgttcccaactagccagtaaattctttaaagacaagcattgtaccctttgcctcagtgtgcccagcaccaacctggcacatgctctattcatgttttccatgagtgtttcatgttagaggtgtattttgtacacaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagtgagtataagggtcattgtctgtgcccacaggactgagattccagaactgggaatgccaccttcttcaccccggtagtgactgatttttttctttttttcatttgcttacttggtcttctgtgcggaacacgagtgtagtttatctcaccctttaacgtgaaaccaagatttggggcagagttttcagacctacagcctatggtctagattgggttctgcatacatgttttgtttggcctatcaaatttgactgacttagtgttttattttgttttacttgaattaatagtcatctgttttatataaaatcgggatttctgtctcctttgagaaaatcaaaaagtctttgatattgtcttgtacccaaattcctacatggtcacggttaatgagagtttagtagcatctgtttcctttagccaggcactgccccttccagctcttaaccccaattctggccacctaattcatttaccatactgcctgggcatgtaggcactgagtctgatatcagagaaagtgcatctagtagctaacaagcttgatcaggaaccctgtcctctttcttcctcttacctaagatatatatatcattgtatctgagtaacccttgtaccatggaccaaccccttaaatgtgtatgaacttgtcccttatagccatttgcaggaggtggctaccgccttggggcagcaccagaggaagagtctgcctatgtggcaggagaaaagaggcagcattccagccaagatgtgagtgcatccaccttcccatgagggaagcttgtggactgttctgccatttttctgaagggattggttacatattgtgcattaaccagcagcctctgaaagggaaactaacagagacagtgcccttgctgtggttcacgaacaaagacgcttactggaaaatcaaaggaggtttcctgggtgctgggtgagagagctggtgagaacaggtggggaaaggggatgggcaaatgaaggagttttttgagcagcccatggatctcaggcagaggtacagtgtatctggggttctctagtgatgcgagtatagctgaagaacttggtcttcagaccaccagagaagacttaacaccaatttttcttttctttttttttagttttcctcattgtccactactttttagccctgtgcatagggtctccttccccacaagtgtaatcatacacacaattttgagtcttttttattcaatattataccacaaacatcttcttgtagtcttgtgatcattaatttctataatatgttttaaatcattttgggttttattccaaaataaagtcaagcaagaagaaaataaaaattttatcctccgaggcagctgctaatgcattggtttttagccttctagaccctttgctgtgaatgtgtgtgggagttgttgtgaacagaacttgtagataacatttttaatgactgtggaatagtccatgagcaagatttgccatggtagtttagtcggacactcacggcataccaagcacaagcaaagcgtcgattgagtcacctgcccagagccatatagctagtgagtggcacagtcaagatgcaacctcaggtgtcctaaaacaaaacccctgctcttagtctgtgctaggccaccttcctattctaggttaatgcttatttagtttgcttgttgagttgcttgtgcacacatgtatatatgtgtgtctctatgtgtgttttaatagtagcaacactgagaaatagtaaaaacctgctaatttgcaagttcaaattggtatgcttgccagatccctggtaactgtttactccctgtcatcacaggttcatgtagtattgaaactctggaagagtggattcagcctggataatggagaactcagaagctaccaagacccatccaatgcccagtttctggagtctatccgcagagggtgagtgaaaaagccctcctgtaggtcccaaatcagtgagtggatagcagttgggaaaggaggaggcagaatgtttattatttgaggagtaaattgtttgaagcagattcagcatagttgagatacggattcatagatctgctccaaaaaccttgtatgtccatttttcccctttgggcctgaggcagacctaagtggccaaataagaaataggtgtcggccatggctgaacaaacaagagaaaaggtggaggcagacaggtagccaccagagtagcctgctccctttggaggcccagcgatttttcaccacgggactgagaggtttcttctccccttttcccatcactgtcatttccatcttctctctgtggacctcagcatggccttttcttccacagggaggtgccagcagagcttcggaggctagctcacggtggacaggtgaacttggatatggaggaccatcgggacgaggactttgtgaagcccaaaggagccttcaaagccttcactggcgagggtcagaaactgggcaggtaaggggcagcacaggttagagccagactctgtcaatcacacctgccaagcccagcagaccctgtgtatcactcactttggttattagctctttactgtttacaaaatacttcaaattttatttgtatgggaggaagagtgtggagaacatggactggagttaacagacctgagtttatatctctgcttcactttctagcagtgtgaccttggactatatagcctcagtttcctcaactataaattggtactaataagagtccatacctcctaggattattgttgcaaggaataagtgagctgatgcatgtagaacactgttccatagtgagcagtcaatgtaagcagaaagtgtacgtaattgctgctgtggctcagtaatctagggtgttcagggaaggtgtcatctccttgatggcttaaggctgaaatgaggattccaaggggaataagaaattacagactcttgcctagccaggcctcacagtgtgttgctcaggatgcagggacactcaggaaccttgctgcccctttgcaggctggtgtgccaccattatgacagctcagcagctcttatttctacttatttggcccttcctgacactcactctgccacttgtgactttttctgcattgtgtcctctgctactgccttctcactcctgtaccctctactaacagacattctctatcttccattcaaagcctctgatgatatctgattggttaatagtcactggtatccctcatacggttctcccaccagactcttggccagcccataggtaggctgccttctctcaggatccacttagctttggccatggccatggggtcacctgatgagtgttcttcagagggaactgtgcacatgataggcatttagagcatagtgaccctccttgccaatatgatccttattttgtagagagaaagctgaggctcttggatattaggggcctttccttgggcacatggctggtgtgtgttagagccaagaccccaggccttctgactggcattccttcctgcactcctgcacaatgagacatcctttctaacctagatctggcagttctcaaagtagctactgcccttgctcacctcactatcttcagagatcaaagcttggtcttccaacaaccatgccctctgagcttctggctggccctctcctggaatcccttacctgcctgttgaccattcatgcctcatcaggagcaagggtcagagttcagggtattagatttacctggcccaaagtagttaagtcatccctgttctcatcatttcatctactgcatcaagggctgtggactagcccaggacagctattctcacagagagtgtccctgtcagttgtgatgagctttatagggcacctaattttttttttctttgattattaaaataatacatgttcatcttaatagaaagtgcaggtaaagaataaaagctgtcctgaagctaacacccagaaatatctggcaagtgtatctttcttctcttactcatttgcatgtatttgtaaacatgctgttgtatcacctgctttttactttatcagtgaagtatggctatcatcctttatcagtaagcttatttctacacttttaattataatgcttacataattttctagcccataaatgtgccataatttaaccagtccttgctgttaaacatttaggcagctaccagaattacaacattgcagtgaatatctctgtgattaaatctttgtacacttgggctagacatatgattattgtttcaaaagggcttcatacttttaagatgtcaaattgcccttcaaaaaggctatattttttatgcccaccaccagttacaagggagggctcagaacttcagaacaccatgcactttgggtatgattttataatactaacaggaaatgtttctattggaaagtctaaccatattatgtgtgtgaaactctgcatctcagaaaattaaaatatctttaaagtctattttagcatgataggaataaatattaatgtggagaatgagcacaagatagaacttgatatcaccatgatgtttatcaacaaagtgttcactgccagttccacttgcattttatttcagttctggctttttatgaaaacttagcttaaaaaaaaaacagccacagttttataaagttaagtgagatgggactttagcttttcagtctaaatcaggacagctgctttagtttttctcataaattttactatgtttttcattgtcttgtgaaccaaaatgatcagaagccaaaagtcttgaacttttcttgaaatttttcctgaaaattttctcagatttgcttcaaaaatcagtcagtactgggctttttcaaaatcttaattatctgggaaaatacttcaagtgaatgaataagttgtctcagttaaaatattttgagaaaattcagttgtattaaattttttttgttgttttagtaaaaggcaaaagatgtatacaatctgaagagaaaccggagaattttgttgttgttttaggttttacgttagtttgtttgagttgggagctgatctgaaggttcgaattgcaaacagcaagagtgcacttgggaggaggggtcactgctgctggaagtgagctttagctgctcccgtgccttctgtagtggttatttttgtggagaagatggctggtctcaggatttgtaactgtggcaagaaagtacctagtgccagtttattccccctgtaaagataggaggagttgggtgattcgggctcttgaattgagactcattttccccataacttacgatgtttgcagggagacaccaaaaaacactatttatagacgtctgctctaacctttcctgcctgtgaatcaagcaccctcacagctgcagatggccagccgctcactgggagcagtagcccagctgttggcagttctcaggaagagctggcaggccagctcctttgaacagatgcgtgtggctgccctgcgggatgattagagcactatggaactaatattctttgaatgatgtgctcttattatttgaaaaatcaggaggcctggtcttcaggtttcccctcctcttccactccccatcctccttgagagcagtatagactgggaatgcctgtcaggtgaccttccacttacagcccatggcagctgatagcatttctagtcgattttggtccagaattgaggcaaatataagtggggcaggaccttgaagaatgatataattagttagtcgagtgttttatgttgttagctaagcgctatgctaagtatttcatttattttatcttctttaatcctgttttaatccccattctacaaagaaggatcctgagacttggtgagatccatattgctggccagtgcagagctgggtccctccagtctctgcctttacctgccaacctgcatagcatcctggatattcttgcatagccacatagacatttgtttgtacttttagtatgtgttgggtacagtgcatgtttttagctattttctcaagtatctgggaagttttaactctgttttattgatgaggaaactgggtcttgaaatccaggcctatacctgtctgagtgtaaggcccaacaggagagtgggacagtgtgaagagcacaggatggagagccaaatagctcggattgtatactgcctctaccgtgaaccaacactgggattttgggcaagttgcttcaccctgctgtgcctcagtttcttcatctgtaatgaatccctacctcataggctgggggttaagcctgtgggttaagtaagttaatacatgtgaagtactcagcacagggcctggcttaggaatgggtgcctcataaatagtcaccatgtttatcaggccaccctgcctcacctaatttttagggagtgtgtaagagaaacagccagtcagaagctacacagccaagtccaggcatcaggctttcctcatctcttccagtgatgacccaccagcagtctgcaatgggacgtgctgggaagcaaacccaaacagcagctgcttccttgtgtggaggatttcctaaataccaggccttgcgtgcacattatctcgtctcatcctcacaacagaacagctcctcattttacacacaaagacactgaagccctgggaagttgtgacttgcttaaggccacactgtctgtttagaggcagagcagaggccaaatggtggtggctcagctccaaagcttgtgccatttctctggcatcacaccaactctccttgataatagggacagtagggactgcttccccaaaaggcgtggagctgtggtaaggagagtatctccactttatagaaaaggaaattgaggtgccaagatgctcagtaacttgctgagggtcatcagctcataagtgaggagtgaaactcaaggagaagtttgagaaagcatttccaatataaatattatttttctaaaaccatcgtaattgtaaagcttgacaaaatcctggctggtgggaatacacagaatatatactgaaaggaggcttgttcattgcattagtttttaaaaatgatccatagcgtgtgtgtgtgttttctcatctataaaatggagatacacccctctcagaggatggttgtggtgattcagcgaggtcgtggctgtgaaagcccctttagacaatacctgcacagagtcggtgtaaatgtcactcctgttttttctgctccccacccccttaactgatatcagctattttggcttaacagcttctttctcatcttaggcctgcctgaaaacgttatagttccctttctggcaggcggtggtttcaatgagtacgtatactttgaattattataaatagttgagggacaggctgcctaaagtctaattggagagttaacctaatgtctgtgaaactaatgaacaaaacgagatagtgtagatcaggaatgtccagtcttttggcttccctgggccactttggaagaattgctttgggccacacataaaatacactgatactaatgatagctgatgagctaacaacaacaaaaagcaaaaaaaaaaaaaaactcataacattttaagaaagtttacaaatttgtgttgggctgcattcaaaactgtcctgggtcgcatacggcccatgagccatgggtggttggacaagcttggtgcagagcttaggcatttacaggtatatgagatttacctattcactatttccaatcaactcttgtggcctatcgtagtgtcatttaaactgtgtgtcccagcccacactttttgagtcccacatgctttgaggctgatgcagagaagcagcttctctagtgctagtaatgtgggtgacattctcctctgagctctactttgtaattctgtaagtccatgtttttcacattcacagaaaagagtaagtttgcttttcagtcattctttaattatatgcttcagggcaatatttaactgtgcaatctctcaaaacctttaatgtgccaatggcctctgaagctgctagtgtaatatgtggcctttcctacaccttccttcctatggaacacactttggaaagcactttcagttggatttgctctcagtaccatttttggggctgtgaagggggaagagtaagttacaagaactgatctaattagaggctttgaggggaagcaaatgctcatctagtggcctttcttctttgcaaaggtctaagtcaggtcatctgctaagagaaagactgggagtgaagtggacaggtggtttggaggagagaaggcggctccatacagttgtggagaattgggagtcctatgtgcattttgtgtttgtcagccatcctgagtgcattatgcaattttcccctttaatcctaacaaaaactgagcaaggcctatgccttaaccctttaaaaatctaattactacctttgttgaaactaagggtgcttgagtaattcaaaccctggtccatgtgattctgagatatgaaatctaacactgtgtctgacaccgtgtcctgttcattgtatgatgaatcccagcagaacccagcacttaattggcttttcagtgccctttagaactctctcccctgccctcaatagtggatgtatgagtacagatacacatgggagtgaggtgcactaggtaatgcaggcctgaaaattccatcacagaagaagaatctggattgctttgcctgcatcctgccactcacctgccaggctgtgccaaggctgcctcagctgcagacttggaacactcccctccaccactccattgaggctaaaactgaccctgttctattatgtcttccagccttatgaccctgtctctcccaccctaggctgtcctgctttcctcccttcaagcccttgttcagttgaagacaccaaggaggaaaaaggccgagtaacttgcccacattactcaggagcgagggagctagcaataacgtatgaaatatatgactcagggtttgaagtgaattctgctggacctgtaagttccataagggcacgattttccctgtctgggtcaatagatcagcagcaccaaacaatgccaggcgcattgcaaatgctcagtaacagtccaagaagggattcccttcttgctaggggccttgtttctgcttgtgttctgatgccatcctctctcctcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggtaccttgcattgtgtggcctagcttattctaggagtgtcctctgggcctcacgcaaatgtgtgggaagcagagagccgttcttcctcctaaataccagcaggcactccatgctttccccaaagcagacacgagggtggtaaggactacaagtctgaagccttaagttctggtccccactcttccattagtgtggccagtgactgttcacttccccctgtgtgtctcattcttcatctgtaaaattagagtattagatttctcagggctttttttaagctaccagacttcagaggaagtcccatgctaaagtcctgtgaagacatcaaattagaactgctgtggttgatggaggagaagggggtgcagtgtcagcgtcccactcacctggcttcctccacctccctccccacaaggggcctgtgaaaattactgggccaggaagatctcttctagatctggctgtcgagaattctgggaatgcctgctccacatctcagaccatctgggctggatcagtgccttcttcattttaaagatggggaaactgagccacagcaaagtgaagagactagtaggagaggtgctagaggactgttgccagtaaatatatttggtgcctcctttctgtagaacagaagtgtctaaatgttattggtcatgagccaactaagccagcacccacatgtgggatcagtgaattgtttgtcagtcgttgaatattgactgggctcgcctgtgggtgacagcgggagacaagccccagctgtgagccaggtgcatctagagcctattgagacctccttcatcaggaacattcattacactcaagtgcctggtggttaagcgagtgacccatcccagtgatgtgagttatttgtctcagtttcatttcactcattaagctcagcacactgctgcccattcccagggtggacagcccatgcagaggctttgctaggtgaaaaagcttggtttgctaaaagtcacaggcagaatcctgcaggtccatgcccttagatgtgccaaattgtaagttgcatagattttaggggtttggggcaaaaaggaaacttatgtttaagtgctctagggaaggaggcattgtttccaggtggtttcattgtcatatgatctccaggttcagaaggcaggtagtgtctggagaaacgattcctggccctgagaagttgaccattaatttctgacagatagtttaagtgcctcctgtgatatacaaaagagacacacactgtccttgtgaaattcatgagctgcaggaggagacactaatcagatcatcccagaaacgtggaaggagggccagggatggagccaaggagctaaggagggctttcctgaggaggtggcattggatccgaggcctgagttgtgattaggattacagaaaggggatcaggcaggggagcctctggaaagaaggacccaaatgtgggaagagagtatggcctgatgaactagaagcgggcagaagagaacgaggggaaagagggtggtataaaattaggtccttgggaacacagtagggttgttggtgtttatctcaaggaaaatggaaacaacagtgaaggactcttggcaaggaagggacttggtcccacatgcctgagcgtagctttcgctgttctgtggagaaagtcaggaaaggggatttgcgaggtgtttagctttccacagggcaggggtatggacagcagaggatggcactgctcaccgcttccccaactcctgcaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 38228 - DNA, 6792 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggtacggtggagtctgaacagggcgcgggtgcgaggagtcggctgggactcggggaacggaagactggcgcgggcctgccctcgtcctcgttccggcacaatcgagtagggcagtggggcgggtggcccaagggtgtcagagcaaacttggcgggcactgggcggacagctgggcttggagctccccgaagggtggcctaaggatgaagccccctagttatgcggaattggcgaggagcggggagaggcgttgtcattcgcgggcagggtttgtgcctgaactgggaaagggagctgaattcgattcggcctccgccttttatgtgcagtagggttttgagtaggttacttgtttctttcgaattaagtagcacaaacattaacagtaacagacttctgctgagaatgctttctacgtgccaggtgctctgcaagcggaatctcgtttaactcagaataactctgaagtggggtactgtggtacattaaagccttttgcacatagtgaggctcgctaatcttgagctgctgttgcttgttgaatgtaaaggaccgaatactttgataagcatgagtcaagaggggagactgagaccacccgctgggtgagtgtgaggtgtgggggtggagaaacgccaccagatatgtgcgagaattggttgggacttcagaacgttcttactcgtcccattcggaggatgcttcgtaactctgctccatgatctggaaggggccatcacaaacagcttgattccaggtagcttgaaaagcgtattatatttgcagtcatttcttggttttctgggctgccgaagtggattttccttcctgaagttcctgtaaagggggatgggaggcacttcctgaaggtgcccttgttctgcccccagccctgcccagctcttgcaaaacctgcagtctctaatctgctgtgtcatttctttcttttcttgtataaggactggtttctggaatctagggcagatcagaaacctgagtcgtctgtgttcttccattaaacttaaatatagtggcacctgcctccagcatttatggttctaatccgtatgtgcggccagtagcacaattattatcacagtcatttcattacaggccatattatatatgcacctctagaattttgatttagagcacagattctggaagtgatcgcttaatgatgtctaaatgtatctttttttttttttttttttgagacggagtttcactcttgttgccctgcaacctccacctcccaggttcaagcaattctcttgcctcagcctcccaagtagctgggattaaaggcgcccgccacaacacccggctaattttttgtatttttagtagagacagggtttcaccatgttggccgggctggtcttgaactcctgacatcaggtgatccacccgcctcggcctcccaaagtgctgggattacaggcttcagccaccacgcccagcccctaaatgtatcatttctaccacattttagtataagtaagaggtgaaacaggaagcacatactgttgcctttggggggaaacaaatttcctggatatgtttagcagaaaggtttaatattctccccttttgctgtcttgtggcacccactccagataattcttgcattttctgtcttttctacaggatgaatttttagatgtgatctactggttccgacagatcattgctgtggtcctgggtgtcatttggggagttttgccattacgagggttcttgggaatagcagggtaagtcttgggtatcttatattttcatggtatcatttctttttaaatagaggctttttttcctgttacaggaaaggccattgctgctctggagctgtgtgtgtgtgtgatgactaaagcaaagaagcagccctacagtggcactcctgggtctggtgcaccactcctcaggagcatctcaggtcaggcaggttaccttcctgccttcctgaaggctgggccagtccattcattcatgggtctaaagtgacctcatgcaagaggctatgactacttgttcgtggcatgcactctagttctgctgtgacctttgtacctgtgcgagtttgggaagtaggaacttctgtatttgacgaccatttcccttgttcctggcacagtgcttaatgtcctaaaccttggctttggtagaagttatttcaggtccctccattttgtttttttgagatagggccgcactttgttgcccaggtgggagcacactggcaccatcacagctgactgcagcctcgacctcctggactcaaatgattttcctgcctcagcctcctaagtagctggaactacaggtgtgagccaccacacctggctaatttttaaaaattttgtagagacaaggtttctctacatttcccaggctggtcttgaactcctgggctcaagtgatcctcctttcttggcctctcaaagtgttggtattataggcatgagtcagcaggtctggcatcggtctcattcttttttttttttttttttttttttaaagacagagtctttctctgtcgcccaggcaggcgtgtactggcgtgatctcggctcactgcaacctctacctctcaggttcaagcaattcttctgcctcagactcccaagtagctgggactacaggtgtctgcccccatgcccggcttattttttgtatttttagtagcgacggggtttcgccatgttggccaggttggtcttgaattcctgacctcaggtgatccgcctgtcttggcctcccaaagtgctgggattataggcatgagccaccatgcccggctcattgctgttcctagccccctaattgatggtgagctgagggcaggaacagtcatctttacgtttgcatcccgtagcaataacagacagtggatatccagaaatggtctcccactgggagttatacagggggtatactgttgcttgctcaactaggctacgaagcagcagcttcacatgtttttctcccatagccacaccctagctggagctacctggaggcccatgtcaggtcccgcttgggatggcttatcagccattctgttacttcaaggggctttggagaactatattacacacacacacacacacacacacacacacacacacacgcacacacgcacacacgcacacacgcacacacacacacacacacacacacacacacacacactatatatagagtttcgctgttgcccaggctgtagtgcagtggaacaatttcggctcactgcaacctctccgcctctgggttcaagcagttctcctgcctccacctcctgagcagctgggattacaggcgcccaccacaatgccctgctagtttttgtatttttagtggagatggggtttcaccatgttggctaggctggtcttgaactcctgaccgcaagtgatccgcccacctcagcctcccaaagtgctgggattacaggtgtgagccaccacacccggccccgagttctgagtcttctaagctttcaatttatgtttggtacttgttctctgttgctccagattctgcctgatcaatgcaggagtcctgtacctctacttcagcaattacctacagattgatgaggaagaatatggtggcacgtgggagctcacgaaggaagggtttatgacctcttttgccttgttcatggtatgtgtagctgatagttttacaacaggtactgttcatttcatgaggtgtcactcacaggaggggaccccactgattgagttacactgtgtgagcagggtgctatttttctaaaggcttctgaggctcagggccatggcctgtgttgagccacatcccagaagatgtggtctgatatactgtacagtcccctgtaatgtgtaaatccagggcccatcgtcagcttctacatctgattctcaagcctggctagatattagaaactaggagggctgagcatggtggctcacgcctgtaatcccagcattttgggagggcaaggcaggaggatcacctgaggtcaggagttcaagaccagcctggccagcgtggtgaaatcccatctctactaaaaatacaaaaaattagttgggtgtagtggcgggcgcctgtaatcccagctactccggaggccgaggcatgagaatcgcttgaacccgggaggcggaggttgcagtgagccaagatcgcgccatcgcattctagcctgggcaacaagagggaaactccatctcaaaaaggaaactaggaaatatttttcataatagctaaaaagtacaaacagtccaaatgaccatcacttgatgaatggataagatactatgtatccatacagtagaatgttatttggccttaaaaaggaatgaagtggccgggcgcggtcgctcacacctgtaatcccagcactttgggaggccgaggcgggcagatcacaaggtcaggagatcaagaccatcttggctaacatggtaaaaccctgtctctacttaaaaaaattagctgggcatggtggcgggcgcctgtagtcccagctacttgggaggctgaggcaggaaaatggtgtgaacctgggaggcagagcttgcagtgtgccgagatcgcgccactgcactccattccagcctgggcaacagagcgagactccgtctcaaaaaaaaaaaaaaaatgaagtcctgatacatgctatataacatggatgaaccttaaaacatcatactaagtggaagaatccagacacaaaagaccatgtgttgtgtaattccatatgcaaaatctccacagtgagcaaagccatagaggcaaaaagtagattagtggttgccagtggctgggaggaggggatggagagtagctgataaaggaaacaggctctttttggagtaatgttttggaatcagtggtgatgtttgcacaactgttcctatacagaaagcctctcaactgtacgctttatttttttgacacaggctcaccatttcacccaggctgtagtgcagtggcgcagtcttggctcactgcagcctctgcctcccatgctcaagtgatcctcccacctcagcctcccgagtagttgggactacaggtgtgagccaccatgcccggatattttttgtatttttagtagaaatggggtttcatcatgttggccaggctggtcttggaactcctgacctcaggtgatctgcctgcttccgcctcccaaagtactgggattacaggtgtgagccactgcacctggcccatttttttttaaattatactcatggcctggcatggtggctcatgcctgtaattatagcactttaggaggctgagacaggcagactgcttgagtccaggagttcgagaccagcttgggcaatatggtgaaacccatctctacaggggaaaaaaaaaaatagctaggagtggtggtgtgtacctgttgagtcccagcaggactcaaaaaaaaaaaaaaaaaaaaaaccacaaaaccttatgtgtccagactctaacccaaaccaataaaatcttttgagatgtagtgctggggcatctatatgtttttttaaaagaaccaagagattacaatgggtagccaaggtttgagaatccctgctttgatatgcagctgacaagttatagtattttcacattggtagtcgcagcacctgctagcagtgtaatatgctttacttgaatcatttccacatctgcacctcaattccctgggcctggggttgccatttggtaggggaggagcttatcaggagttcctttgcaagtgcaggagggcagtcctgggttctgttagtgacagcgtgatttcagtgaaataatttagaccccccaagcagactgtgcaacggatagcccctggagagtgccccgtgtttacattctcatctggcatttttgttttgtggaatcggcctgtgttaagccaggtgacctatgaacagtgcttgtctcctcactaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 38229 - DNA, 8573 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggtaagtgtagtgcttgagagagctgtaccaaacacattgctaaactgattttgccctgttcctttgcgggaaagtctgggttaatgtgatttggttttgggaaatggcattggatagactgaccatgggcacaagctcttaggcatcaggagtgcagctgtgagaaagtgcagtgatttggtgataagtctctaaatttgttcagcatgttaatctctgcatagagagccttctagttacaatttcttgctgttttatacttacatatgcattactttgtaagattccaattaaagctccattttcctaggacattttataggcataactaaattgcagccagattggtttctcacttgaattctgcttaagtataaagatatttttgtaagcagacaaaatctctttattttaataggttcgagaacatcatcgaaaattaagaaaggaggctaaaaagcggggtcacaagaagcctaggaaagacccaggagttccaaacagtgctccctttaaggaggctcttcttagggaagctgagctaaggaaacagagggtaagttatgttagccagaattttcattgagtggtgtagtgtgttatgtgtgatatttttcagagtaaggtaacaacactagtcactggttcacctatttcccttatggctctgacagcttgaagaactaaaacagcagcagaaacttgacaggcagaaggaactagaaaagaaaagaaaacttgaaactaatcctgatattaagccatcaaatgtggaacctatggaaaaggtatgattaggtctctttatgaatgagagatcaggggttttgattttggtttttttgcttgggcctgagtgcagtggcacaatcacaactcactgcaacctggaccacccaggctcaagcagtcttaccacctcagtctccaagtagctgggactacagaagcacaccatcacgcctggctaattttttttagcagacacgggctttcactatattgccaaggctggtctcaagtgatccacccaactcagcctcccgaagtttctggtattacaggtgtgggctgttgtgcctggctgagagatgagttctgatgcagaaataaaagcacatccacaggctgctgagcttcttgggaggaagacaactgagttcagactccatcttacctatttaacaactgcaagggctgctactcagctgtggaaaatggagttagaggttacagttgctctacttctaattttgtgttatttccccctttatcctctaggagtttgggctttgcaaaactgagaacaaagccaagtcgggcaaacagaattcaaagaagctgtactgccaagaacttaaaaaggtatcttagcctaggtcagtgtctgacagtagtaatgaggtttaaaagactcaagtcattttttttttaaccttttaagatgaagggtgcatgtgcaggtttgttatatgggtaaacttgcgtcataggggtttgctgtacagattatttcatcacccaggtattaagcctagtacgacattagttatctttcctgatcctctccctcctcccaccttttcaccaacaaatcatttcgtgactcgactctagcttatgctgtttaatgcctttcctgctatgtttacctgacggaaatagtttctttggttctaaatatttgcacaaaactggttctgcctgtaagcatgatttacaacattaaaaaaaaacgttgacatagtgttgagattgagaaaggtacattggagtaagcagtgtcaggctaaaggtctctaaagtactctgttgaaacctaagtgaaggaggacaacttggtgtagttgctctccagcactcccatccccaacatccattttcccaagctcactcccccatggatagaacctgactgcccctcagcagcttttggcaaggccagaaggacctatcaaactatataattcactatgggaggattcagacagggatatttgcatttttgaaatccatcttgatcagagactgctgagcaagcctatgttttactttcctgtgtgagaaatgatgagggtcaacattcttcataccaaagtgaagacatgagatccaactctgagctcaccctgttgctaaatggataatgccagtactctcttgtggaaggtattaccagaacaagggatgtagttctgatcattttctccttgataatgtagttctggtcattttttccttgataggtgattgaagcctccgatgttgtcctagaggtgttggatgccagagatcctcttggttgcagatgtcctcaggtagaagaggccattgtccagagtggacagaaaaagctggtacttatattaaataaatcaggtgagtaaagagggtaccctttgtcttctgtgtacatgggtgaggtacgaggaaacagtctgatagtcactgaagactgattagatccaactctgatctcagcaaagccagagtacgtgcactttgccagagacagtgctaggcagtggggagccaggtgacttttacaactgactcaactggtttctactattcttttgccattcagtatttaccatcttttaaataaagagtgtaagctgctatacccagcttattgtgtagtatatttcatctaggaagtgatgacagtgtgacaaattccccacacctacacaatgtcgggtattagttcaagagtgaaataaattggaacgtatgtgacaaaatatttaaatgaaatgcataattatgcatctgagtttgagcagcaggaaaaagaaaacccagaacagagaattacaaagcagaaaatgggaatgagatctaaaattgttgttggggttaagaaacaattggctgcttgggaggctgaagtgggcacatcacttgaggccaggagttcgagaaaagcctggccaacacggcgaaaccccatctctactaaaatacaaatattagccgggcatgatgatgggcacttgtagtcccagctactcggaaggctgaggcaggagaattgcttgaacccgggaggcggaggttgcagtgagccgatactgtgccactgcactccagcctgggcaacaacacttcgtctcaaaaatgaagaaacaattggctgctagctaaaggtaaattctggaaacatagctctagggttagtagggttgtaatccagacgttgagtctgtcctgaagttttcaagtgagcaatacaaggggaattgaaatagagaagtgcagatgctgagctctgttaagatacgggcagtatggtaggggagcttaccctgccctgattttctagttaaatccttttgaaaggactgggaaaatgtaaaccagagtaaaatctatagttgccagattttgcaaatgcatctcaacaaaatagccacattggagcaaatgtctttttctttttttctttttgagatggaggcttgctgtgtcacccaggctggagtgcagtggcgccatctcagctcactgcaagctccacctcccgggttcacgccgttctcctgcctcagcctcccgagtagctgggactacaggtgcccaccaccacgcccagctaatttttttgtatttttagtagagacggggttttatcgtgttagccaggatggtcttgatctcctgaactcgtgatccgcctgtctcggcctcccaaagtgctgggattacaggcgtgagccaccgtgcctggccgcaaatgtcttatttctaattgctatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtgagtttcagttcattactttttactttttaagtgttgaaatagttaagaagtttagccagctctccaagtgcccaagcagcagtgtatggagttgttgtcaagtaaaaggctcactcaaatactagcttcttgcttataccttactgaaagcacataaccacacacaatttaaagaaaaaaacttacacaactgctgccagattcaggttttttgttgggactgattactgtaggaagctggtttctaaaagttcttggtttgtttgaatttatagtattttcctgcctttgcattacttgtgcaagaaatgaagaaactaaaattggtcttagtattgaagtgaagacactgagatccaactctgatcttgccctaaacatcagggaaatggaaaattaggcagtgaaaatttcataagtgccaacatataatgctttttatatctggatttcccatttatttgtaggtttcccaaatgtggggaaaagcagcattatcaatagcttaaaacaagaacagatgtgtaatgttggtgtatccatggggcttacaaggtaaatggaggtgtccataattgtaatattatagtgacacactattttattttggttatctcaaggaaggtgattttttttttttttttttttgagacagtttcactcttgttcccaggctggagggcaatggcgcaatctcggctcactgcaacctccacctctcaggttcaagtgattctcctgcctcagcctccagagtagctgggattacaggcatgtgcccccacgcccggctaattttgtatttttaatagagacgggtttctccatgttggttaggctggtctcaaactcctgacttcagctgatctgcccgcctcggcctcccaaagtgctggggttacaggccaagccaccgcgcccggcctatttttattttttaaagcttttggtgaaagcagagatttaagccagtgctagaactgattggagtgggacagctgcccacaatttagtttgaaagacaagttcagcagatagattgagagagaggaaagctccctcagaggaagtgatgtttgaacctggccttgagaaattaatagaaatttgccagatagaagtctgccaccacacctggctagtttttgtatttttaatagagatggggtttcactgttggccaggctagcctcaaactcctggccttaagtcatccacccgcctaggcctcacaaagtgttgggattacacttgtgttgggtggcatgagccactgtgcctggccaacttttagattttttttttttgggagatggagtctgtctcccaggctggagtacagtggtgctatcttggctcactgcaacctcagcctcctgagtagctgggatcaaaggcacccggctaatttttgtatttttagtagagacagggctttcatcatgttggccaggctggtctcaaactcctgacctcaggtgatccacccacctcggcctcccaaagtgctgggattacaggcgtgagccaccgcgcccagccagaaggtggcatatttatagcaaaggaaatagcatgtgttttggttgatgtaaatatataagctataacatgtagtgttctctttagaacagtcgggtatgctgttacagttttagataaatgtgaagcaaatgatgataaactggatctgactgactgtgctgagtctgttcaatccaaccctgagcttcatgttctgtctcttaacctccaaatagaccaatgcccccatcaattccatcgctcttctttcaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagaggtgagaattgtgtgtcgctgctgtcttcatcagctgacaggccagtggagctcttacctgtttacatgggcttgctttctttcccagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgtaagtgtgtcctccatgagttaaaactgaagtgagttttctagcattataatacataatggaaggaactgaagataggaaatatttgaggcttgtgatccattagccttaattttgcacatcccgttatatgtacctccaaagagttaatttttcaggtacataactacttggattaaatgagcagacaagggctactaatccagcactatttttctttgtcacacaggaaaacagctcaggcatgtttgctgcagaagagacaggggaggcactgtctgaggagactacagcaggtgaggcaggcaaaaggggttctaacgaagcagcatggtatagaatcacttttactttttgaaaatctctttattttcctgcaatataggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 38230 - DNA, 63644 bp, Homo sapiens
ccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggtaagaaattctcaattttctgtcagctgtcaggatggctgtgagatagtagttttagttgcaaagggaagctgcttccctagttaaatctcaaagctgaaggtctcattaagaaagactatcttttttaaaagatacatgacacttaataatagaaagaaacctcatattcattagtggaattcttaacctggggtggatagatattccacggaagatcctggagtattctgaatcccctagaattgcttacaaaaatttgaggttctgtgcatttacctggagagaggcaccataacatttcttttgattctcagaggtttcatggaatcaagattccagattgttatcaagaaaataaatggagggctgggcgcggtggctcacgcctgtaatctcagcactttgggaggctgaggtggaaggatcgcttgggcccaggagttctagaccagcctgggcaacgtggcgggactttgtccctacaaatgaggctgaggcaggaggatcgcttgaccccaagtggttgaggctgcagtgagccgtgtttgggccactgcactccagcctggacagcagagtgagatcctgtctccaaaaaagaaaaaaaaagaaatggagaatgttatttttctacatgaactgaaatcaatatgataacttccttttgagaaagtcaaacacacctttctgaggaaagctgttttgttttttggatgtctgtactagaatgaatgtaagaaaaaactaagattgttcttaactcacatttccttttaaagaaggggagccttggaattgatattctgaagttgtttcaaatctatttgcttagcaatgaatttttggttaatacgttttgacattttcgttaatttgattggcaccttgaacagatgttaagcgagggtcccgggaagagggatagatgaaagcactgttcagtgaacatgctgataggtcctttaggtaggcaaaaggaattcacgaagtgcacagcgttcaaagatttaggggggaaaaactactacattcaaagggaacaagatttcatgagtttgtcctagagttcagcagtaaaataggccctagtttcagtgccattcctgaaagtactttcaaaggaggcctgaagtagaaaggaaaggtataaatgaaatattaagtacaccttgaagaaacctgaggaagaggagacattacaggtgaaaatagcctgtgggtgggaaagaaggtgggacaaggtgttgtcagtttgaggaaaagtaaagcccatagccagatggaacagatgcttaaattgttgttgttctttttctgtttcctttttaatctgtacccctcagcatctaatgatagcattttaaaaaattacgtgcattacctaacttcacttaaaaaactcaagctgggtgcggtggggcgcgcctgtagtcctagctactcaagaggataaggtaggaggattgcttgaacccaggagttggcctgggcaacattgagactctttctcttaaaaaaaaaaaaaaagaaaataaaaatcagtgacatatagatgaggaaacggagactggataggttcatgaagtttgttagaatcagaagagaggtattttttcagtctagcttttctgactcagactagttcgtagccactaagcatttcggcaaaggtacatggtacatatacatggtagcctgtgtgccaaatccagcctgcagactgttccattagcagaagtttattattgttgttctttaccagtatttcctagaggcaaaggttgggtcgggctgagtagcagctgttaggcacagtcctccttgcccttgaagcctgtttcacttatttgggttacctgcctgcccagtactttgtgaacctgctatgtttcctttgacataaccatattttcttataactatattagaattgaattgacattagtagggctgacatgtgtgagatttgggttggtttgtgtatttttaaacatattgaagtaacatttatgaataatcataattaattctgataagcaaccagtaaaactttttatttctataaaatgcctttaactttaccaattccagtattttttcaaactaccttgaatgattattgcaatatgcggatatatactatttcctttttcactagaaggaaatgtttacaggagtggtgttaataactgggtcattaatacagataattagtatgtcatgtcatttgtggctttcttaaattgacggtcagatggtcttttccagctgtaggtcttaaaatgctaaaatcagcattcataatatctgtttattattagagtagatgcaatgcattttgagctattagaataaaaaatgaaagttatatataacttaaagacatcctagaattcaactaggatttctatctcctaggaactaaacatattttctaggtaaattatgccattattatggaccaatgttgtaatgaaactagtgagatggtaaatttgtaaaaataaatttcattcacgggggactggaaagcaccatttctttccttagaaaataattccccaaactcctacactggataaatgacttgcctttttaaggaagtctggctttcttagaggctagtgttactgttttacagttcactttcgtttacatcaggggtgtccaatcttttggcttccctgggccacatcagaagaagaattatctcaagccacacataaaatacactaacactaagataggtgatgagctaaaaaaaaaaaatgcaaaaaaaaactcataatgttttaagaaagtttatgaatttgtgtaaggcttcattcaaagtgctcctgggttgcatgcggcccacgagccatgagttggacaagcttgatttacatgaaaagatatgctttttattcatgtttttaatcttgctgctgctttctcattcaatactttttctaaaaatatctcagaacaggaataaaagtcagatgatcaattatggcaagattagtatttaaaaacgagttaaaattaggtagtctgaaattgcagtagtggtggggtctacctgccagatgtgcccaccaagaggtttatgtgacattgatttctctgtcagtttctcctcaccccaaaactacctttcttgatacttttgtggccttcttccttgccctttgacctggcaactgtactttcatgccttaaaaatttataaaacaaaggaaaaaaaatccgattctcaaatgcaattataagtaactatgataatcaggatgtaaattttttcagtatacaggaaagagaaacacttttaacttttaaaggaggccagccaggtgctaagtggctcacgcctgtaatcccagcactttgggaggctgaggtgggcggattacctgaggtcaggagttcgagaccagcctggccaacatggcgaaaccccatctctactaaaaatacaaaaattagctgggcgtggtggcatgtgcctgtaatcccagctactcaggaggctgagacaggagaattgcttgaacccaggaggcggaggttgcagtgagccgagtcccaccattgcactccagcctggggaacaagagcaaaactttgtctcagaaaaaaataaaaataaataaataaaaataaataaataaaggaggccaaagcatgctttacacaaaggaagccctgtttggtaagggagtgagacccgttggtttatagttaacactgtcttatgttttttcgattgaattgctaatgagtagttttctttggctctaaataacaatgttacataagtaggttgagagcctatattacctagtataaactcagtgctgctgcagttgataaatggagctatgatacaaaaacagatggctcaagtgggatttcagattgattatctgagggttgttactcacctgagtatgtctcctctttgtcacagagctggtaacagagagcaagctgtttttggctcagagctctacagcaatattcctcaaactgcctggtaaaggatcagtttttgtttttaatttttatttcaatccataccaatacacttataaaaatgaaatagtaggaaaatgaagtgaaaaaaagacatagaaaatacaagcccaaatgtattgttaaattcaacagataaaaaattactactataattgtaataatcatattgctctaaaaatttctgaaggctttatctcagttgccatacttttcttattgcagaccagtttgagttataatgccacatttttcatgtattaaaacagcaaagcaggccaggcgtggtggctcacgcctgtaatcccagcactttgggaggccgaggcaggcgaatcatctgaggtcgggagttcgagaccaccctgaccaacacggagaaaccctgtgtctactgaaaatacaaaattatttgggcgtggtggcacgtgcctgtaatcccagctacttggggggctgaggcaggagaatcgcttgaacctgggaggcggaggttgcagtgaaccaacattgcgccattgcactccagcctgggcagcaagagcaaaactccctctcaaaaaaacaaaaaacaaacaaacaaaaacagcaaaactggatgtagtggcacacactggttagtcccagctactccaaatgctgatgtgggaggatcacttgagcccaggagttcagggttgcagtgagctatgagtgtgcctgtgaatagccactggcaacataaggagacctactccctaaaataaccaacagcataaatccataagttggcagatgaaagtagtgctattcttaggatgattttaaagatgaatatgattaataatgcactgatttcaaaagggactgtctgagacagtatcattcaaagtcaatgttactacttgaacaagctattaaaatccaaatctcttctgttaaatgaccttctaggattgttgtgaggttgaaataatataagcacaggcttaacactatgtctagaacataataaaaactttcaaaaatattgaggcagattctcaatactgattagaaaaacttgtaaagattttcatttttataactttgttctaatttataattgttaaaccttttatttggaaacagacttaataatgggaagctcctccccctcctccccttcgcagtcatggaaacttctcggcaatttgtttggaatccaaaggtcttgttgtggggtttggtttgcattactatttaccattctatttggagaggccagggcttttcctctaccctccctgctttatactatttttcttagtatttaactctcttttcttcattatacttactctcattttaagctttgttttgttctttcgtgttttaaagttttgtgtctgtattagtccattcttacactgctaataaagacatttctgagactgggtaatttataaacgaaagaggtttgattgactcacaattcagcatagctggggaggcctaaggaaacttacaatcatggcagaagaggaggcaaacacatccttcttcatggggcggcaggatggagaagtgctgagcaaaagggggaaagccccttataaaaccatcagatctcgtgagaactcactgtcacaagaacagcaagaactcactatcacaagaacagcatgacctcccaccaggtccctcgcatgggaactacaactcaagatgagatttgggtggggacacaaccaaaccatatcagtgtctgattataataactgactcattcataataagtatctttaggggtttgagttacccgcaaatcaaaggtttattgtgtctgaagaacagatttattcagtatgcttctgcctctacaataggttctctttgaagtagatttaacaatgttacatttttaaggacttttatattgtctggtacattgctcttaccctcttatggtaatacaagagattttatacctgtttggaatttcatttgtaaattctaagatttgagccgggcatggtggcttatacctgtaatcccagtgctttaggaggctgaagctggaagtttgcttgaggccaggagtttgagaccaacctgggcaacaagtgagaccctgtctcagatgaatgaacgtaaattataaaattttaaactttgcaatctcagtaaatttatccatatctggaaagaaatcatcagcttgtcttttctcagattgaactacagattattgtttcataaggatccttgataaaactaagtttggatcaaataaaatccggttgcaatatgattcaatattattttcctgaaaaactttgttttctccaggatactatattgataaacataattaagacttatctgcataataatattaataatgtttattgagctctttctgtataccaggcaatgatatgcactatcttattaatcctcaggaccaagactatgagatactgttaaacctcactttacaaatgagcaaactcaggcttgaagaggtcacagactctggtagaggtgtgatttggaactaagtcattttgattcctgttgccaaatcagtcacttgactactaaatgttgcctttcctaatgaatgctgtgtaaagaaggaatgaaaataggatctacctaaattgatgcctttagctccccaaattaggaacatctttcataccttccacagtatatctcatgctttctgcctagtcagtggagtagaacttgaaactccagaggtaaacagtctccaaataccattgaaacctataagaaataagttaatatgtcttagatgccttttaaattaacacctgccaatttggaatctgaagtagttcctattgtgaactatccaagatgaatttcacacttgacatcctcacaggttagtcgtaaattgtgctgttcaagaagtgacatccttttcaagagaagatgacatgaaatggattcagaatgtttctgtatatgatagtcttaacctctcctctaattaaagaatttaatgatgagacttttgttgaatgataagatccccttcagctcagtatggaattccacactgggctgagcgcagtggctcacgcctgtaatcccagctactcgggaggctgaggcaggagaattgcttgaaccttggagtcggagattgcagtgagctgagattgtaccatggcactccagcctgggcaacagagcgagactgtcttaaaaaaaaaaaaaaaaagtagtagtactaagtatgagtactggtatttcttaaaacctataatgaaattacagaaatctcagtcttccttgaatactaatattcagtttttaacttattgaaataaaatggaaataaatattagttagactggaaattctttgttttttttttttttttttttgagatggagtcttgctctgtcgcccaggctggagtgcagtggcgtgatctcagctcactgcaacctccccttcccaggttcaagcaattctcctgcctcagcccccccagtagatgggattacaggtgcgtgccaccataaccagctaattttttgtatttttagtagagacaaggtttcaccatgttagccaggatgatctggatctcctggccttgagatctgcctgcctcggcctcccaaagttctgggattacaggcatgagccaccacacccagccctggaaattcttacatggaaattcatttttaaatgaaaaggtcttgagggtaactaatagataattacatcaaactatctattgcaaaccctgtatttatctgacgttaatttccttccttcctttctttcctttccttccttcccttccttcccttccttccttccttccttccttcctttcttccttcctttcttctttccttccttccaaatttcactcttgttgcccaggctggactgcaatggcatgatcttgactcaccataacctccgcctcccaggttcaagtgattctcctgcctcagcctcccaagtagctgggattacaggcatgcaccaccacgccccactaattttgtatttttagttagagacagggtttctccatgttggtctcaaactccttacctcaggtggtctgcccgcctaggcctcccaaagtgctgggattacaggcgtgagccactgcgcccggccaattttctttctttttttttttattttgagacagaattttgctgttgttgcccaggctggagtgcaatggcacgatctcggctcactgcaacctcctcctctcaggttcaagagattttcctgcctcagcctcccaagtagctgggattacaggcgcctgccaccatgcctggctagttttgtagttttagtagagacagggtttttccgtgttggtcaggctagtcttgaactcccgacctcaggtgaatccggcctcccaaagtgctgggattacaggcatgagccaccgcacccggccctgctattatattctttacggttctctcttagtcaattcctcatcattctagtccccttttatgcttttataggtattccttttttctttctttcttattttgagatggagtcttgctctgttgcccaggcaggagtgcagtggtatgatcttggctcaccacaacctctctctttgggttcaagtgattctcctgcctcagcctcccaagtagctgagattacggctgcctaccaacacgcccggctaatttttgtatttttggtagagacagggttttgccatgttggccaggctgttctcaaactcctgacctcagttgatcagcccgccttggcctccggaagtgctgggattacaggtatgagccaccatgcccagcccccttttgtaggtattctttatgttaaactttctctcttcaaattactttatgctttctctttgatgaaaggaccctgactgatagaggtaggtaatggatcataaaatcaaataaggctgaacagagaattaagcctggagtaaaataagacagccccagtgtcatgatatatggcagctgaccttcagtgtcagtgcctgggagtcattagggagaagtgagaactgtgggcatctaaagggcacatatcatttgatgacaccaaatcttcctatttttccaaagctagaaatctggatttttatatgaagtctcctgaattttatcctttggctacttattcaaatattgtatcagtgcgtgggccaaacaacccatgtttgtgagtctacaagcctctagactgcctgatttctaagccctctgaatgtagaaggggtgggcaagcaagtagaggaagtaagttacagcatggcagtggggatgggagagacagaaaaacattttgaattattacacaacgtcaaagtgcagttgtttagaatcacttagtagaggggaaaacatctctatgttcacattaaagacactatgttctctaatttgactatagtataataattaatgacacatgtcaactgatatgtcaggttctacgttgattttaacagtaaccttgaaagggaagaattcttgtcctgcttgtagataaggaaactgggcctcaagtttagtaagtacaaatcccctatttatataggctttaattaaattaacaattttttaaaagacgctgtggaaaatttggaaaatacggtaacgtataaaaggaaaataaaattatctattatccaactgttcaattagaatcactaataacatttttgtttctttttttctatttgtttgcatttttaacatagttaattatggttgatatgtaccatttacattctcccttttataacctggtagtatatcataagcattttcctttattcttaaaaacttgttctagtcatttgttgttgttgttgttaaggcaaggtctcactttcttacccaggctagagtgcagtggcatgtttgttttggttcactgtagcctccgcaccctgggcccaagcgatccttctacctcaacctccctagtaggtgggactcaggcatgtgccaccaggcccagctaatttttgtatttttttagaggcaaggtctcactatgttgcccaggctggtctcaaactcctgggctcaagtaatcaatcgtcttgtcttggcctcccaaagtgctgggattgccagtaggggaccctgtgccctgccttgggcattttaaaaaatgtcctcattacattcaattatgtacagaaattcttaatatgcatttaatatgtttttacatttttgtcatgataatagtgttgcatgaatattttcttgtctcaagcattgagtgtatttcagattatttttttcagggatagaatgatggggataaagggcatgaatgttcttcagaaggttctcaatctatattaccagttttttaaaatgcatttttacaacaaatgcaaataacgctatattctcacaaacattatcattattcatttttaaaactgtaccaatttcatagaggaaaaggtatatttactattttagtctgctcggttcagttgaactcttatgtatcaatgatatatttgttggcaatgcttttccaggttatttttcaatggatttttgtttgttttggctttgtagttacatcaaacaatcttacgggatttatatttatttcttttatgtttagaaaggaattttatgcaaaaagaaaaataaattaatcttattttccaagattggaggaaatggcattaataaagtacttgcttgttattactgccttagaaggtgttaagtaaccttgatgtcaaatgagttaggaaataggaagcttatatgcccctggcaacatggcagaattgtaacttcgttcactggaactttcattattcttgcagtggaggtgcttagaagcttttttttgcatgctactgatgatgttgaagacaagtaataacaacccctactctgctaagtgcactaatatatcctgctcctacacaataataatactagtagcagtagccccttcttacagaggaggccatgaagcccaggaaggttaaagacttgtcctgtttcacacagctgctccttagagccaggaagcttttgggcatcttgtttcagctgtaaggacttgaagaaccaaattagatctgagttttctttattatctgttactaacacttagcagcagataatgtagtggctaaattgacattaagaaatatctctttcttgaagcaggtttgtttgtaagaatatgggggaaaactttgttgcctgaacaagagttacttcatagcctgtgatattttatctcttcagtgcctaaaactttgaagggatcaatcttatgataagagatgtacctttgatttttttttttttttaggaagctgtagttgacactttgactactaaaatgggcatggcacaaggaaaattgagataaaatgttttccgtatcaaaagcttttaaagactggatgcggtggctcatgcctgtaatcccagtactttgggaggccaaggctggtggatcacttgaggtcaggagtttgagacctgcctggtcaacatggtgaaaccctgtctctactaaaaatacaaaaattagctgggcatgatggcacatgcctgtaatcccagctactcaggaggctaaggcaggagaatcgcttgaacctggaaggtagaggtcgcagtaagccaggttcacaccactgcattccagcctgggtcatagagtgagattccatctcaaaaaaaaaaaaaaaaaaaaactttaaaaattgttggcttgtctttaggtgaaccaatttgttgactgtttctgtgagcagggaaagaaagaccatttaattaccttggtgtctgccaagaaatattaaactgacttcaaagcttgtgctgatggttaacggcatagagtgcaagctgttgttttaattaatgtatctagcagatcctttggttcagtcaggctgcaactgtgaacttctaaaatgagataacataaaaccaatggcattgcacagttcatgcctctcctgagcaaatacttcatttcactgacagaaactgttggtttgggaactgtcttttgatcttgaatgacacttggaatttgtagttctccatttaaataaactttttagtgatttaccataagcaaaagaaagaacctgtcagcattttgttaactttaatataaacacaacttgagattgaatcccaagttgtgtgaaagaatacagccatacaaatacatgaagccacaattctagcgcttaaaataaatcagattgagtctaaaatgatcaggtaaagaatttttttttttttttttttgagacggagtctcgctctgtcgcccaggctggagtgcagtggcgggatctcggctcactgcaacctctgcctcccaggttcaagcgattctcctgcctcagcctcccgagtagctgggactacaggcacatgccaccatgcccagctcatttttgtatttttagtagagatggggtttcaccatgctggctaggattatctcgatctcttgacctcgtgatccgcctgcctcaacctcccatagtgctgggattacaggcatgagcaaccgcacccagcctatggccctttattaaatgtatttgccggctgggcacagtgactcacgcctgtaatcccagcactttgggaggccgaggcgggtggatcacgaggtcaggagatcgagaccatcctggctaacacggtgaaatcctatctctactaaaaatacaaaaaattagccgggcatggtggcgggcgcctatagtcccagctgctcaggaggctgaggcaggagaatggcatgaacccgggaggcggagcttgcagtgagccaagatcacgccactgcactccagcctgggcgacagagcaagactccatctcaaaaataaataaataaataaataaataaataaataaataaataaataaatgtatctgcatgccccttgagtgaaactatcaattctgaatcaactaatcactgaaaattcttgatatagttacaaggaatatatgaggtctatttcctggcacaaatattctaaagaggttccgctacatttgtgtaattgtttgtatcagagcccagtggccggtaccaagtccccagtgctttgcttggtggtgggcatttaattcattctttcaataaatatttaggggaaactgctgtgtgccagatacttccttataaattgagaattcagcagtaaattaaagatctctgccctgacagaattggtaattttgtggggaaggggttacagggacaaacagtaaacatagtgttgagtggatatttaacttcatttggtaaataaatgcacttaatttcaaagtgaactgaaaacaatacaatagttttacctcacgctgcctttcttcgaaggaaatactgcaaagctagatgattcattcagatttaccttgatggtctcatcctacaaactcaaattctttgtttctgaatgtttgatggcattataatttcatgtttgcacttagatcagggttttccagcttttgggtttcatagatcagtcatatatttaaaatttcaaagactcggccaggcgcagtggctcacgcctgtaatcccagcactttgggaggccgaggcaggcagatcacaaggtcaggagatcgagaccatcctggctaacatggtgaaaccctgtctctactaaaaatacaaaaaataagccaggcatggtggcaggcacgtgtagtcccagctactcgggaggctgaggcaggagaatggcatgaacccgggaggtggagcttgcagtgagccaagatcatgccactgcactccagcctgggcaacagagcgagactccgtctcaaaaaaaaaaaaaattttttttcaaagaatcgatacaggattacctccttttaattttgccatgtaaggacactaaaaataaaaacaaaaactgttgtcaccatcatttcttaaaagaaaggacattataaccaaaattaggtaggatataatctcagaataaaaaatagatctttatattgaagaaataaagctttatgatgtgctcactgtattgtccttattttattttgtcatgaaccattagaaactgtcaatagagaagaattacaactatttatgattttgttttttctctcggtgttgctgagggattttgctgattcatactattttgaaaggttgcatgaatatcatcttttttggagataaatttttttataatggattgtatgtattatgctatgcagtgagcattgtcatggagtgcaatgctgaatctaatcatccctgtaaccactaactagcttagtcatgtgatcttgggcaaatcacttctcatctttggccttcgattctccatctatatattgagagaaaatcattttttatattttctcccagttctttaatttgaattgataactttggtagctaatatccctatttttaaaacatgggtctaaagattaataaaaacctttactgtggctttctaaaaacttgcaccaaactcctgtttatatttcatattcttttttttttttttttttgagagagggtatcgctctgtcacccaggctggagtgcagtggcacagtctcagctcactgcaacctccgcctcctaggttcaagcgattctctctcagcctcctgagtagctgggactacagttgtgcaccatcatactcggctaagttttgtatttttagtagagacagggtttcgccatgctggccaggctggtctcgaactcttttcctgcttttaaaacttatctcaatgtagtttttcatgtgaccctagggtagagtattatgaagcacttggtaagtgcctagtgaattgtgggttgatccagaattgtgaacaccactggtttccccataatgttactgacataaaattgtggtgaattatttttgagaagtatctgaatggcagatgagattgtttaaggaaaatttttggaagggccttttagtattcgaattagatctctgaccttgatttcagagaactgccgtgaggaaagaagccttgttaaaactgaatattctaaaatgaatcctttcagaaatcctggctaagtaaattactgcccagttaatttttttataaatagataattttatagaatgaaaggtacagatcttaatataggttgatgaattttagcaaatgtttacaaatgtaacatcccaatcaagatttagaacatatctgttattctagaaagtaacctgatgccactttccagtgaatccccactgtgtggccaccctctcatcactggtcaccagaggcagtcactgttctgatttcaatctttatagattagtttggcctgtttttaaacttcatatacatttattcatacagtatatactcctttgtgtaaagcttctttcactcaaacatcaggaaaatgtttatgagatttgttcatttatgtgctgtatgtagccgcagtttattcctttttattaccaagtggtattccattgtttaaatataccacaatttgtttatccattctcctgtcaatggacatctgatccagattgtggctattcttgatgtagcttctatgaatattcttgtacaagttttttgtggacatatgttttcatttcttttggggaaatgaaaaaggggaatgctagtttaactttataagggactgctaattttccaaagtggttgtaccattttatgctgccaccagcaatgtgtgagttttccagttgctctatatcttgtaattatttaaagttgtcagtcttttcaattttggccattttaatgggtatgaaaaggtatcttgcatagttttgatttacatttttctgatgactaaatgatgttgagcaccttttcatgggcttattagccattcatacatcttttgtgaagtgtctgtgcagtgttttacccatttttaattggttgtttgtcttttattattgagttgtagaagttctttctacttcaaatacaaatcctttgtcagcgtcatggagtctgttctgcctcccaagccagtaccccaaccactggaatactctcagtttacaagtacctagtagccattctgaatgtataagggttgacctggctgtgtgctggggatcaggggggattcttctcttgctatatggcaagtattaattggtgttgacgttgcagctttagtttcccctttttcaatagatacctagatccctttcttcctctccaaacaaggagggagtgatgtttcaaccagcctttcagctaaaaaaaactattttcccatagagataatatttacaaaagctagttaggctcccagcccctcagtcagaagttcagtaatgtatcagagataatagagctactgtttttgctaactaacctctttattattattattattatacttttaagttatagggtacatgtgcacaatgtgcaggtttgttacatatgtatacatgtgccatgttggtttgctgcacccattaactcgccatttacattaggtatttctcctaatgccatccctcccccagcccccaccccacgacaggccctggtgtgtgatgttccccaccctgtgtccaagtgttaccccatgacaggccctggtgtgagatgttccccaccctgtgtccaagtgttctcattgatcagttcccacctatgagtgagaacatgctgtgtttggttttctgtctttccgatagtttgctcagaatgatggtttccagcttcatccatgtccctacaaaggacgtgaactcatcctttttcatggctgcatagtattccatggtgtatatgtgccacattttcttaatccagtctatcgttgatggacatttgggttggttccaagtctttgctgttgtgaatagtgctgcaataaacatacgtgtgcatgtgtctttatagcagcatgatttataagactttgggtatatacccagtaatgggatggctgggtcaaatggtatttctagttctagatccttgaggaatcaccacactgtcttccacaatggttgaactagtttacactcccaccagcagtgtaaaagcgttcctatttctccacatcctctccagcatctgttgtttcctgactttttattgatcgccattctaactggtgtgagatggtatctcattgtggttttgatttgcatttctctgatgaccagtgatgatgagcattttttcatgtgtctgttggctgcataaatgccttcttttgagaaatgtctgttcatatcctttgcccactttttgatggggttgtttcattttttcttgtaaatttgtttaagttctttgtagattctggatattagccctttgtcagatgggtagatgcaaaaattttctccccttctgtaggttgcctgttcactctgatggtagtttcttttgccgtgcagaagctctttagtttaattagatcccatttgtctattttgacttttgttgccattgcttttggtgttttagtcatgaagtccttgcccatgcctatgttctgaatggtactgcctaggttttcttctagggtttttatggttttaggtgtaacatttaagtctttaatccatcttgaattaatttttgtataaggtgtaaggaagggatccagtttcagctttctacatatggctagccagttttcccagcaccatttattaaatagtgaatcctttccccatttcttgttattgtcaggcttgtcaaagatcagatggtttgtagatgtgtggtgttatttctgagacctctgttctgttctattggtctatctttctgttttggtaccagtaccatgctgttttggttactgtagccttgtaatatagttggaagtcagatagtgtgatgcctccagctttgttctttttgcttaggattgtcttggcaatgcgacctgttttttggttctatatgaactttaaagtagttttttccaattctgtgaagaaagtcattggtagcttgatggggatggcagtgaatctgtaaattaccttgggcagtatggccattttcatgatattgattcttcctatccatgagcatgggatgttcttccatttgtttgtgttctcttttatttcgttgagcagtggtttgtagttctccttgaagaggtccttcacatcccttgtaatttggattcctaggtattttattctctttgtagcaattgtgaatgagagttcactcatgatttggctctctgcttgttatttgtgtataggaatgcttgtgatttttgcacattgattttgtatcctgagactttgctgaagttgcttatcagcttaaggagattttgggctgagatgatgggttttctaaatatacagtcatgtcatctgcaaagaggacaatttgacttcctcttttcctaattgaataccctttatttctttctcttgcctaattgtcctggccagaacttccaacactatgttgaatgggaacggtaagagagggcatccctgtcttgtgccagttttcaaagggaatgcttccagtttttgcccattcagtgtgatattggctgtgggtttgtcataaatagctattattttgaggtacgtcccatcagtacctagtttattgagagtttttagcatgaagagctgttgaattttgtcaaaggccttttctgcatctattgagataatcatgtggtttttgtctttggttctgtttatgtgatggattatgtttattgatttgcgtatgttgaaccagccttgcatcccagggatgaagtcaacttggtcttggtggataagctttttgatgtgctgctgcatttggtttgcatcctcagtattttactgaggatttttgcatcgatgttcatcagggatattggtctaaaattctcttttttgttgttgtcgtgtctctgccaggctttggtatcaggatgatgctggcctcataaaatgaattagagagaattccctctttttctattgattgaaatagggtttcagaaggaatggtaccagctcctctttgtacctctggtagaattcagctgtgaatctgtacctctgctagaattcggccgtgaatctgtctggtcctggacgttttttggttggtaggctattaattattgcctcagtttcagagcctgttatttgtctattcagggattcaatttctttcctggtttagtcttgggagggtgtatgtgtccaggaatttatccatgtcttctagattttctagtttatttgcgtagaggtgtgtatagtattctctgatggtagtttgtatttctgtgggatcagtggtgatatcccctttatcattttttattgcatctatttgattcatctctcttctttattagtcttgctagcggtctatcaattttgttgatgttttcaaaaaaccagctcctggattcattgatttttttgaagggttttttgcatctctatgtccttcagttctgctctgatcttagttatttcttgccttctgctagcttttgaatgtgtttgctcttgcttctctagttcttttgtgatgttagggtgtcaattttagatctttcctgctttctcttgtgggcatttagtgctataaatttccctctacacactgctttaaatgtgtcccagagattctggtacattgtgtctttgttctcattggtttcaaagaacatctttatttctgccttcatttcgttgtttacccagtagtcattcaggagcaagttgttcagtttccatgtagttgtgcggttttgagtgaatttcttaatcctgagttctagtttgattgcagtgtggtctgagagacagtttattgtgatttctgttcttttacatttgctgaggagtgctttacttccaactatgtggtcaattttgggataagtgcaatgtggtgctgagaacaatgtatattctgttgatttggggtggagagttctgtagatgtctattaggttggctttgtgcagagttgagttcaagtcctggatatccttgttaaccttctgtcttgttgatctgtctaatattgacagtggggtgttaaaacctcccattattattgtgtggaagtctcagtctctttgcagttctctaaggacttgctttatgaatccgggtgctcctgtattgggtgcatatatgtttaggatagttagctcttcttgttgaattgatccctttaccattatataatggccttgtctcttttgatgtttgttggtttaaagtctgttttatcagagactaggattgcaacccctgcttttttttgctttccatttgcttggtagatcttcctccatccctttattttgagcctatgtgtgtccctgcatgagagatgggtctcctgaatacagcacactgatgggtcttaactctttattcaatttgccagtctgtgtcttttaattggggcattgagcccatttacatttaagattaatattgttatgtgtgaatttgatcctgtcattatgatgttagctggttgctttgcccgttagttggtgcagtttcttcctagcattgatggtctttgcaatttgttatgtttttgcagtggctggtactggttgttcctttccatgtttagtgcttccttcaggagctcttgtaaggcaagcctggtggtgacaaaatctctcagcatttgcttgtctataaaggattttatttctccttcacttattaagcttagtttggctggatattaaattctgggttgaaaattcttttctttgagaatgttgaatattggcccccactctcttctggcttgtagagtttctgctgagagatacgctgttagtctgatgggcttccttttgtgggtaacctgacctttctctctggctgcccttaacattttttctttcatttcaaccttggtgaatctgacaattatgtgtcctggggttgctcttctcgaggagtatctttgtggtattctctgtatttcctgaatttgaattttggcctgccttgctatgttggggaagttctcctggataatatcctgaaaagtgttttccagcttggttccattctctccatcactttcaggtacaccaatcaaacgtagatttggtcttttcacatagtcccatatttattggagggtttgttcatttctttttactctttttttctctaaacttctcacttcatttcattaatttgatcttcaatcactgatactttcttccacttgatcgaatcagctactgaagcttgtgcatgtgtcacgtagttctcatgccatggttttcagctacatcaggtcatttaaggtcttctctacattgtttattctcgttagccatgcgtctaatcttttttcaaggttttaagcttccttgcgatgggtttgaacatcctcctttagcttggagaagtttgtttttactgaccttctgaagcctacttctgtcaacttgtcaaaggaatttccatccagctttgatccattgctggcgaggagctgcagtcctttggaggagaagaggtgctctggtttttagaattttcagcttttctgctctggtttctccctgtatttgtggttttatctacctttggtctttgatgatggtcacctacagatggggttttggtgtggatgtcctttttgttgatgttgatgctattcctttctgtttgttaacagttttccttctaacagtcaggtccctcagctgcaggtctgttggagtttgctggaggtccactccagatgctgtttgccttggtatcaccagcagaggctgcagaacagcaaacattgctgcctgatccttcctctggaagcttcgtctcagaggggcacctggctgtatgagttgtcagtcggcacctaccgggaggtatctcccacttaggctacacaggagtcagagacccacttgaggaggcagtctgtctattctcagagctcagacaccattctgggaaaaccactgctctcttcagagctatcagtcaggaacgtttaagactgcagaagtttctgctgccttttattcagctatgccctgcccccagaggtggagtctacggaggcaggcaggcctccttgagctgcagtgggctctacccagttcgagcttcccggccattttgtttacctactccagcctcagcaatggcagacgcccctcccccagtcaggctgcctccttgaagttggatcttggactgctgcgctagcagtgaataaggctccatgggtgtgggactcgctaagcaaggagcgggatataatctcctggtgtgccgtttgttaagactgttggaaaagcgcagtatttgggtggcaatgtcccgattttccaggtacagtctgtcatggcttcccttggctaggaaagggaaatcccctgaccccttgcgcttccctgggtgaggtgtcaccccgccctgcttcagctcaccctccctgggctgcactcactgtccaacccgtcccagtgagatgaaccaggtacctcagttggaaatgcagaaatcacctgtcttctgcgtcgatcacactgggagctgcagaccggaattgttcctattcggccatcttggaatggaccgcttgtttgctaactaacctcttaaaagaaacaaacagatgaagttcatgatgtaccattaaattattgaaactttttcataaacaacatatataattattcccttgtggttttgtttattttcaaaaatggggtctctttatgttgcccaggcttgagtataattcagtgagatcatagctcactatagcctcaccctccccatatctgggacaacaggtacgtactaccatgcctggcttcttgtagttttttattattttttatttttttaaagacagctcttactatgttgcccaggtgggagtgcagtgattatagcagatgtgattatagcacactatagccttgaactcctgggtttaaacgatcctctgcttccaccacccaagcagctgagactacaggtgcacaccaccgggcctggctctccttgccggtttttttgttttgttttgagatggaatcttgctctgtcacccaagctggagtgcagtggtgcaatctctgcttactgcaaccttcacctgctgggttcaagtgattctcctgtctcagactcccaagtagctgggattacaggcacacaccaccacacccagctaatttttgtatttttgtagagacggggtttcaccatgttggccgggctggtctcgaactcctgacctcaggtgatccacccacctagttgtagtttttaagatcatttttcatacttctaagatcccagtaagtcatattagggtatactgctgcttcaagaaactttgaaacctaatctttttgtatgacaagagggagtccctcaaacttggctaaaaagaagacaattaggattaagttggattaaaaccacagaagaattttagcattgatgtctaaatacatttttttcatcgtatgagtaatacatgtttattgtaggtaaattataaatgttttaaaagttatgtatttatatattgcaagttataaattttaagtaaaaaattgttaatgtttaatataacttgttctacttataaatattttttataaatatgagattatcaatacatattgattgccatcagctttttcctcatagcagcatattgtgacttcctatatccattaacatatttatttcttaatttttaatggctgagtggtgtggtactctgatgaaatttatagtttatttagccagtctcctttattggacatttattttcaggtttgcattagtaataagcacagtggtcatctttgcacaattctttcttaggatgaatttctagaagtaaaatttctggatcaaagagttcacatttttgaggctttaaatctaaatgccaaactgtagtctccagaggttgtagcaattcacattccttccagtattaaagtgtactcattcttcctatcatggatagtagacattttcccaaatcattgttaacctggtcatttaaaaaatttcatctcagtcaggcacagtggctcacgcttgtaatctcagcactctgggagaccgaagcgggcggatcacctgaggtcaggagttggagaccagcctgggcaacatggtgaaaccccgtctctactgaaaatacaaaaattagccagatgtggtggtgcacgcctgtaatcccagctacccgggaggctgaggcaggataatcgctggaacttgggaggcgaaggctgcagtgagccgagaccacgccactgcctcaagcctgagcgacagagcaagattctgtctcaaaaaaaaaaaaaaaaaaattcatctctttgttttacttggcattactcatgcaattgatcatttttcatcttcgctgtctattgtagatgttggtctcacaaatgagcagctcacagtcttgattacagatacttgagaaactttttcccattaattaatcaaagtttgcaattatttcttttgctttctccccaggaacgactgaagctggtgactgttttgggtgctggccttctctgtggaactgctctggcagtcatcgtgcctgaaggagtacatgccctttatgaagatattcttgagggtgagaaagggaagagcattatttgagatatgttattgacttggagggttagcaggatgaagcttagtggtatgttttctgagcacagttcatgtttaccatagagttctaccctgagaagatttgttgagagatatcttgatatctttgatattgacacatccttagcagtttgtcaactgaatgtcccaattcatgaataccacttaatgtttatttgccacagtgcatgaatgagtcattttaagttatgacagttcttttttaatgcttactcaaacacttcccaaatcccacatgatagtggctgcattttttgtttaatttaaaaatatatagatataaatatttaaatttaaggaccctttacagtaaactttatagataattgatgaggacccatgcagtaaaggataactgaaaaaattaaagaggcctttcctgaccctaatagcaacaagcagagggaacagtatagctgtgtgagagtaaatgcttggtggtcagcttggcttactcaccagcaaagtaatttggtccttcacacagctgaaaagcatacttgattcacatttgtgacttagcaaaatccgattactacatgtcatgaaacttcacagttacctgtgaaggattgacaccacagctgttaaatccatgagctgaatcctcaagtaccaagtctaccagatgttaagaatagtataaagaggtaggcacttccaaatttcttactagatacaatataataaatactttttcagatcttggtagaggaaaagaactgtgtcctttatccagaatggtgatgctcttaggcctggggtttgatagacaaagagttttggcagatataaatgaggattgcagaagtgttgcaagataggacaggggctgaggagtggtcagctgcattggggaacagtaataaatcaggagccttaaagcagtggtctctactttttttatggtcacacatcctacagagggagggaggaatgatttacatgcactattgcactgatttaatgtgtacattataaaatacactcctaaaacaggaatatttttgagacctgagatttaaatatacatagaacagtattttctttcatattctagtgggtcatcttgaatttttctgggatgtgattccactatagaaatcactatcctaacatttgtccttttatgggtggcagttgttttctaaagttgtctgataatgaaaattccttgaggaagaggcacattttaaaagtatgatttcctgacctccaggaaggatcccgggaatatctatttttaacaagctgtctgcaattcttatgaaacaagtttcagaaacactggagtagaggaaagaagtgcttcaagtatagtttctttgtgttatttttaatatcaatttgagatataatttacataccctgtttcaggtatagttgggggttttgggtttttttttttatttgtttgttttgagacatggtctcactctgtcgcccaggctatagtccagttttgccatcacagctgaaatctcttgggtttaagcaatcctcccacctcagcctcctgagtagctgggactatagtatagatgcacactgctatgcctgactaatgtttaatttttttttgtagagatagagtctccttctgttgcctaggctggttgccaattccgggactcaagcgatcctcccaagttggcctcccaaagtgctgggattacaggtgtgagacacctcacccagcccaggtgtagtttaagactaaaattatctaccgtgtgttaggttgtgtgtagagaaaaactctctctaaccgtgtttttcctgtgctctcacaccacaacaatcataaacacagaagaaaaacttctgtaaccagatgcgtggcaatatctccccactaccaagcagtggacaccagccaggtgtcctccaatttaattctgacgctgtctacctggaggcagtatcagatcccacagatctagggctcagtccccaagactgctccctccttcacccatcaccagtcgcaagcctgggcctctggaacttctgaccaactggcttcaagttggggttcccacaaccccctctttgggttcagtcaatttgcaagagtgggtcacagaactcagagaaacacttacatttaccagtttactaagaatgatattttaaaggatacagataaacagccaaacagccagatgaagaaatacaaagactaagtaaggtatggaagggtcctgggtcctggagcttctgaccctgtggagttggggtgcgccaccctcctggcacatggatgaattcttcacctttctatcagccttcatatatgttcagctagccagaagttccctgaaccctgtcctcttgggtttttatggaagtttcaagatgttagcattcctcccccaagggtttaggatcgtaccctctcatgggagcttaagaccccaagtcctgccttggggcaggtgaaaagagggcaggagaaggtcagaagcctgctgttgaggcctaacacacccaacagtataacaaaagactgcaacaaaggctatgtaagttatgaaccaggaactgtggacaaaaaccaatatatacacataacgtttgtgtgtgtgtgtatatgtttgtaagtgtatagtgtatatactatgtatatatgtgtttacatatatacacatatgtacacacatacacacacacacatacataaaataacaccacaggttgcattcccttattttcagttttcctgatttttgacccaaaataatttttttttttttttttttcagacagggactcactctgtctcccacgctggagtgcagtggtgtgatcactgcagccttgacttccccaggttcaggtgaccctcctacctcagcctcccaagtagctgggactacaggctcatgacaccacacccagctaattttcagatttttttatggagacaggatttcaccatgttgcccaggctggtctcgaactcctgggctcaagtgatccacccacctcagccttccaaagtgctgggattacaggtgtgagccactgtacccagccagagtaattttgtggtgtcatttgaaaacagattacaaagtgctttataagtctcttctgaaaataagcattctggtctctttaacctttcatcatagattagtttccagccctaagtcatttaaattttttaaaaaatattttcatttatatatttatcattcacactttaggtgtacacatctacaagttttgacaaatgcatagagagtgatgttatcaccactacaatcaaaatacagaatagttttgtcaccctaaaaagtatgcttgtgctgtccatttgtaatgttttctccactctcaacccctggcaaccactgatctctgtctatatagttttgccttttcagaatgtcataaatggaatcatgtaacctttgggtctggcttcttacttagcataatgcatttgagggtcagtatatgaagggaaaatgtgtattatggaaaaactatgcatggatttcaaaaaacttttttgcactaaaatgaacttgcgctaacttgttataacatgtctgaacaggatctacttagaggcactaagaaggttaagacagcagtttgaaaagagcccatattggagcaacatgaattctgctaagatagaaacaagaataaacatcaaatttatggggaaggttgggtgtaagaatgataaaatcattgatggtttacaaaaagtttatgggggctgggcatggtggctcacgcctataatcccagcactttgggagtcaaggcgggtggatcacaaggtcaagagatcgagaccatcctggccaatatggtgaaaccccatctctactaaaaatacaaaaattagctaggcgtgctggcgcatgtctgtaatcccagctactgggagactgaggtaggagaatcgcttgaacctgggaggcggaggttgcagtgagccgagattgtgccatgcaccccatcctggcgacagagcgagactctgtctcaaaaaaaaaaaaaaaaagtttatggggacagtgccccaaagaattcagcagtttacaaatggctaacttgttttaagaagggacaagatgatgttgaaaatgaagcctgcagcagcagaccatccacacctattttcaaagaaaaaattaattttgttcttgccctaactaaagaagaccaacaattaacaacacaaaaaatagccaaccccatagccctctaaattggttcagcttacacaattctgactgaaaattttacactgaacaaactttccactcgatagatgccaaaacagttgtgcccagatcagctgcagacaagagcagaactttgaatggaaatgggacccaagtgggatcaagatcctggaggtttttttcaaagaattgtaacagaagatgaaacatggctttaccaacgatcctgaaggcaaaccacattcaaagcaatggctactgagaagtggaagtggtcagtcaaagcagaagtgggtcggttaagagcaaaggtcactggcaacagtatttggggatgtgcaagacattttacttgttgattttctagagtgccaatgaaccataacatctgcgtattatgagatgcgtattatggtttttaaaaagttacccaaagttttagcagaagaatgcccagaaatgcttgatcagagtcctccaccacgacaatgttcctgctcattgctctcatcagacaagggcaattttgccaggttttcaataggaaagttttgggcatcagctttatagtcctgatttggctccttccaacttctttttgtttcctaatcttaaaatctataaagggtacccatttttcttcagttaataatgtaaaaaagactgcattgacatggttaaatttccaggaccctcagttatttaggggtgaactaaatagctggtatcatcatttacaaaagtgtctcacacttgatagagcttatgttcagtaataatgtttatatttttaaatttttttaatcttttaattccatttttccacaagctttttgaagtccccttatattctgtgtatcaatagtttgtaccttttttttttctgagtggtatttcattgtttgcatgaaccatgtttggctattccttcaccagttggaagatgtatatatgggtggttcctggtttgggtgactatgaataaagtcactattaatgtactggttgttgtatgaacatgagtttttatttttcttgcatacttacaggtgccagcctgggcaacatagtgaaaccctgtccttacaaaaaattagccacgcatggtgcctcacacctgtagtcccagttactcgggagactgaagtggggggattgcttgagcctgggaggcagaggttgcagtgagctgagattgtgccactgcactccagctttggcatcagagcaagacaaaagaatacttgcaagtaggattgctgggtcacatgacaaatatatgtttaatttcataaagaaactgacaaactcttcctaaagtggctgtaatattttgcattctcatcaataatagatgagagttccagttctccccttccttgtcaacacttagtgttgtctgttttgttttagttttttattttagccattctaatagcagcatagtgatatctcagtgtggttttaatttgcatttccctgtgatgatgctgaacatcttttcatatgcttaattgccattgttatagcttctgtggtgatagcaaacattttgttcattttaaaaattgagtttccttattactgagttttgagagtcctttatatattctagatacaagtcctttatcagatacatgttctgcaaacattttctcctagttcatggcttatcttttcattctcttaacagtatcttttagagagcagtttttaattctgatgaagtccaatttatcagttacttcttttgagattttgcttttggtgtcatatctaaaaccccttgctgagcccgaattcacaaagttattctcttttgttttcttctagaacttttatgattttcagttctacatttaatcctatgatctattttgaatgcaggtgaaagttcattttttggcatatgggtggatattcagtagttctaacactattttttgaaaaaaaatcccttctctattgaattatctttgcacttttgtcaaaaatcaattaactgtgtttgtgttggtctatttctggattctctgttctgttttattgatctgtatgtttaccttttaccagcactacgttgtcttgatgtagctttatagcaaatcttgaaatcaagtagtggagtccttctttgttcttatttttctttctttttttttttttttcttgagacaaggtctcactctgtcacccaggctggagtgtgcagtggcatgatcatagctcactgtgaccttgaactcctgtgctcaaacaatcctcccacttcagcctctccagcagctaggactacaggtgcatgccaccatgtctggctaattatttaaactgtttatatagagacagcctcactctgttgcccaggctggtcttgaactcctgggctcaagtgaccctcctaccttggctggggttataggtgtgagccaccccagccagcccactttgttcttatttttgaaaattgttttggctttccataaacttctttgcctttccataaacattttaaaatcagcttgtcaaatatctatggaataaatcatgctgggattctaaccaagattaatctataaatttgggggagaatagacatcttaagaatattgtattttccaacccatgagcccagtgtatctctccatttatttagatcttctttgatttatttcatcagtgttgtaattttagcatacagatctgcagatagtttattgatttatgcctaaatatttcatgtttttagtaattgtaaataatacttttataatgttttcaatttctagtattctagtatataaaaagttctaatataagaaatttcattacgtataggcacttttttgtagattccttgggatttgctacgtaaataatcatgtcgtctgtgaatagggacagcttaaccttttcctttcctatctgcctttttttttttttaccttccttattgcattgactagactatccattatgagattgattagggatgaaaatgaacattcttgccttactttcattcagtctttcaccattaaatatgaggttagatataggttttttatggattccctgtttctcttttttttttttcaacttttattttagattcagggggtacatgtacaggtttgttacctgggtctatttcacgatgctgaggtttggggtacaaatgatcccatcacccaggcactgagcataccaatagtttttcaccttttactgtcttcctttcctccccttctagtagtccccagtttctattattgccatctttatgtctatgagtacctgatgtttagttcccacttgtaagtgagaacatgtggtatttggttttctgttcctgcattaatttacttaggataatagcatccagcttcatcctccttgctgcaaagaacatgatttcattctttatatggctgaatggtattccgtggcgtatatgtaccacattttctttatccagtccaccgttgatgggcaactaggttgattccatgtccttgctatcgagaatagtgctgtgatgaacataagagtgcatggtgtctttttggtacagtgatttgttttcttttggatagatatgcagtaacgggattgcagggttgaatgttagctctgttttaaattcttcgagaaatctccaaaactgctttccacagtgactgaactaatttacattcccatcaacagtgtataagtgttcccttttctccctagccttgccagcatgttgttttttgactttttaataatatccattctgattggtgtaagatgatatcttattttggttttgatttgcatttctctgccgattagtgatttggagtggtttttcatgtttgttggcagcttatatgtctttttgagaagggtctgtttatgtcttttgcccattttttaatgtggttgtcttttacttgttccgttttttaagttccttatagattgtggatactaaacctttgtcagatgtgtagtttgtgaataatttctcctattctgtaggttgtctgtttattctcttgatagtttactgtgtagaggctgtttagttttattaggtcctacttgtcggtttttgtttttgttgcaattgcttttgaggacttagtcataaattctttcccaaggctgatgtccagagtggtttcctaggttttcttctaggattcttatagtttgaggtcttacatttaaatctttaatccaccttgagttagtttttgtatttggtaaaaggtaggggtccagtttcattcccctggatatggttagccaactatcccagcaccatttattgactagggagtcctccatggtcactttgttgaagatcagatggctgtcagtatatggctttatttctgggttctctgttctgttccattggtatatgtgtctgtttttctaccaggaccacactgttttggttactatagtcttatagtgtagtttgaaatcaggtaatgtgttgcctctggctttgtcctttttgcttaggattgctttggctatttggtctgttttctggttccatatgaattttagaatagttttttttagttctgtaaaaaatgatgttggtagtttgatataacattgaatctgtagattgctttgggcagtatggccattttaatgatataaggaagttccattctgttcctagtgtgctgagagtgtttatcttgaatggttgttgaatttcatcaggtgcttttttcagtctgttaatggagtgaattgcagtgattgattttcaaatgttgaactagacttgcatatacccacctcctagttattatatataattctttttatatgctgctggattcaatttactaatattttattaaggatttttgtgtttctgttcatgaagaatactggcctgtggttttcctttctaacaacatctatgtatggttttatcagggtaatgctggcctcttagatttgggaagtgttcccttctcttttatatcctagaagagaatatataaaatcaataatatttcttccataaatatttgttagaatttattagtgaatttgcaatcttggcctggcattttctatgatggaaggttattaactatgaattcagttttttaaatagatagatataggactgttcaagttacctgtttcttcttgagtatgctttggaagttgtgtctttcaagtaattgatttatttcctcgtactttttaaagtttctttaggtgaagctcattgatttgaggtttctcttctcttctcttgtcttctcttctctttgcttttctttcttttcttctttctttgaggcagggtctcactttgtcgcccaggctgggtacagtggcacagtctcagctcactgcaacctccacctcccaggttcaagtgattccaatgcctcagcctcccaagtagctgaaactacaggcatgtgccaccaggcctagctaatttttgtatttttagtagagacggggtttcaccatgttggccaggctggtctcaagctcctggcctcaagtaatcctcccacctcggcctcccaaagtgctgagattacaggcatgtaattcttttcttttcttttttttttttttttgcgcgacagagtcttgctctgttgcccagactggagtgcagtggcatgatctcggcacactgcaacctccatcttccgggttcaagcaattctcctgtctgagcctcccaagtagctgggattacaggcgcccaccaccgcgtcctgctaatttttgtatttttagtggagacagggtttcaccatattggtcaggctggtcttgaactcctgacctcaggtgatccacctgcctcggcctcccagagtactgggattacaggcgtgagccaccacacctggcctattcttttctaagaatttaggctaggcatggtggctcacgcctgtaatcccagtactttgggaagctaaggcagctggataacttcagaccaggagtttgagattaacctgagctacatatgaagaccctgtatttacaaaaaaatttgaaaaattaggtgggcgcagtgactacagaaaaattaggtgggcgcagtgacacacacaccaggaggctgaggctgcagtgagccatgccatgattatgccgctgcactctaggctgggtgaaagaacaagaccctccctgaaaaaagaaaaaagaatttaatgctataaatttctttctaagcactgctttatttgcatctcaaaattttagtgtgctatatttttatctttatttagttcaaaatattttctaatttttcatgcaacttcctcttttacccgtgtgttacttagaattgtgtgatttaatttgcaaatttttgagtggtggtttttaaaatttggttggttgcttggttttgcccccgattctttctgttactgatttctagtttaactttattatggtaagaaaatatacttagtatgatttgaaaacttacagatttgtaaatgcttttttaatggtccagaatatggtttatcttgtggaacgttccatgcacacttgaaaagaatgtacattctcttgttctgtaaatttcaagtcaagttgtttggtcttctatatctttgctgattttctgcttctattactaagacaggagtattgaagtcttcaaatatgattgtggatttatctgtttctcttcatttctattagcttttgctttatgtatgttgaagctctttggttaggtacctacatgtttaggagtgctatgccatggtgaattgacctttttaatcattgtgcaatatccctctttattcctggtaatatttcttgttcacaagtctacttcatctaattttaatataaccattcagttttctcttgatcagtgtttccatggttatatctttcccttctatccttttatttttagccagtgccattcatttaaagtggacttcttacagatggcatatagttgtatcattttttttaaactctagtttgacaacctctgtcttctaattgatgtgtttagacgagagattagcaaactttttctgtaaagcatcagatagtaaatattttagactttgtgagccacgtgatcttaatttgtacttcttacctcggccattgtagccagattccctgattctttcctctgtcctttccagtctactattttcttttttttttgagacagggtcttgctcttttgcccaggctggagtgcagtggtgtgatctgggtttgctgcaacctctgcctcccgggttcaagcgattctcctgcttcagcctcacaagtagctgagattacaggggtgtgccaccacgcctggcttatttttgcatttttagtagagacaggatttcaccatgttgcccaggctggtctggaactcctgacctcaggtgatccacctgccttggcctccaaaagtgctgggattataggcgtgagccactgtgcccagccatttccagtctattattgatctcatccagtgaatttactactttagatattatatttttcagttctaaaatttccagttcgtttctttttataagtgtctgtttctctgctgaggatgttcatttatttgaggaatttttacctttcggccaggcgcagtggctcacgcctgtaatcccagcactttgggaagctcaggtgggggaggatcacttgagtataggagttccagaccagcctgggcaacatagcaagaccctgtctctattttttaaaaattatttttccaaaagtatgttatttttagcttagagaacatagttagagtagctgctttaagtaagtctttgaatgttccagtatctgagtgatctgtgggttgggttgattgtcttttccctcggtaattggtcaaaatttcctgtttctttgtatgtcaaataacttttggttgtatgctggacattttgaatatgataacttgagaatctgagtcccgtcaaaatctctggagaatgtttatttcttttgttttagcaggaagttaacctatttagattcagcctaaaagttctgttttgtttttgttttttgttttttggatgatggttctcattttagctgagttttcaaagcctttacaatgctgctttggctatgtcctgtgtatactgagttcaggggtgagcctgggacttgtgccgtttatacataggattaaagaacccctctctcagctctttcctctccagtgttccttccacattgttttgcaaacagaccccattttcctggtcctctgtcaagaaagacaaggtttctctatagagctgtggctgcatgcaacactacatgtgttgccaccacatagttccatgtgacttgggcttctatcaaaagaaagtaacagcagaaaaggcagaacagcataaccaggtttcccccatacacttcagaccactgggatcccttgctagctccgcctcccgggttcatgccattctcctgcctcagcctcccgagtagctgggactacaggtgcctgccaccacacccggctaattttttgtatttttagtagagacggggtttcaccatgttagccaggatggtcttgatcttctgacctcatgatccacctgcctcggcctcccaaagtgctgggattacaagcgtgagccaccgcgcccggcctgggatccctttttctatttgctctggccagaaagatggggttttaactgcctttgttgccaccatgcagttctgcaactggggctgccttaaaggcaggaccaggaaagaaaaaagaggaggtagagaaaaaaaggggagactttcctgtacttcactacctcttagcaacctcttttcctggtcctttggccggaaagacagggtttttctagaagtttttgctgccttgccttcacttgctgttgtttactttttgtagtcctgaagtagttgttttttggtgtgttttgtccagtttttgttgtaatcagtgggtgattgacgtcaaaatgctcttactgtaacatggccagcatcagatgtctccaacattccttttaaaatgtaaaatgttaatacctctgttaaagaagtttttttgtttgtttttttttttttgagacggagtctcactctgtcgcccaggctggagtgcagtggcaccatctcagctcattgcaccctccacctcccgggttcaagcagttctctgcctcagcctcccaagtaactgggattataggtgcctgccatcatgcccagctaatttttgtatttttaatagagatgggtttcaccatcttggccaggctggtcttgaactcctgacctcgtgatccacctgcctcaacctcccaaagtgctgggaagagtaactcaaaaaaatctgtgaagtaacttaaccatgatattacctttcagctaagctgtctccagattttttacatctttcttcatactgatgagtttagacatatcattgtaattttgtttttgctgctttactctctcttttcttaccctcttcccttacccttttttttttttttgagacagagttttgctcttgtcacccaggctggagtgcagtgacaccatctcggctcactgcaaccaccgcctcctgggttgaagtgattctcctgcctcagcctccctagtagttgggattacaggcacctgccactaggcatagctaatttttgtattttagcagagacggggtttcaccatgttggccaggctggtcttgaacaactgaccttaggtgatccacctgccttggccgcccaaagtgctgggattacaggcatgagccaccgcgcctgacccccctctttctttattgtagaccaaaacaacttttcttcgtacttcaagaaagacgtttgtatacatgttactacagcctatggtttcgttcttctgtggaccttataattataatacattgttttcagaactcagtatatcatgttaactaagtgctctgatgctttaataagcattattaaatactaattaatgtaaaaaggaacctcttactcttctgtaattatagctctaaaatcactggaattagatgattatcagctttcacgtaaaaaaaaactgtctatagaaacaagttttaagaacttcaaagattgttgggtaatgcagcactttactgtgcagccaaaatttgaaaacatctcaaaattctttggactgttagaattggtatgtttaggaaggtagactattgggtcaaagatgaaaatataaatgtgatgtattgtcaaaactgctattgtcagccatggctcaatgtagattatcccactcatttttatcagttctgtaagaatgccatgtatcagattctttatagaggtatgattaactgtggctttttctgtcactttactctacattaaataaaatatagggggccctagccagaacagtcaggcagacaaaaaagatagaaggcattcacattggaaaggaagaagtaaagttgtctctgttttcaggtgagatgatcttatgcatagaaatacctaaggattccacacacaaaaaaattagaactaataaacaaatgcagttaagttgcaggatacaaaatcagcatacaaatatcagttgcatttttatacactaacaatgaactatttgaaaaagaaactatgaaaacaatttcattcataatagcatcagagggggagggaaagcattaggagatatacctaatgtaaatgaggagttaatgggtgcagcacaccaacatggcacatgtatacatatgtaacaaacctacacgttgcgcacatgtaccctagaacttaaagtataatttttaaaaaaataataatagcatcagaaaataaaataaaataaaatacttgggcataaatttaaccaaggaggtaaaagatctatatgctgaaaactataaaacattgatttaaaaaattggagaaaatataagtaaggtattctgtgttcatgaattggaagaattaatattgttaaaatatccgtagtacccaaagtgatctacagatttaatgcaacccctatcataattccagtggcatttgctatggtttggatatttgtcccctccacatctagtgttgaaacttgatcccagtgttggaggcggggcctggtgggaggtgtttgggtcatgagggtggatccgtcatgcacatattggtgctatccccttgctgatgagtgagttctccctctataatttaacaagagaactggttgtttaaaagagcatggcacccctcccctctctcgtcttgtgaaatactgactcctcttccccttctgcaatgattggaagcttcctgagatcctcagattcgtgcttcttggacagcctgcagaactgtaagccaaataaaccttaatagaacgatcctaaaattcatatgtaaccacaaaaggccctgaagccggggtaatttataaaggtcaattaaagaggtttagttgactcacagttcagcatggctggggaggcctcaggaaacttacaatcgtggcggaaagcaaaggggaagcaaggcaccttcttcacaaggccgcgggaaggagaagtgctaaatgaagaggggaagggccccttaaaaaccatcagatcttgcaagaactcaccatgtagtacacctgtaaacccagctactcgggaggctgaagcatgagaaccacttgaaccctggaggcacagggttgcagtgagccgatatcatgccactgcactccaacctgggtacagagtgagactctgtctcaaaaacataagaatagtgtcaggcacggtggctcaagcctgtaaccccagcactttgggaggtcaaggtgggcggatcacttgagctcaggagtttgagaccagcctgggcaacatggcaaaactacatctccacaaaaacaatataaaaattagcaggacttggtagctcacatctgtagtccagattcttgggggactgaggtaggaggatgacttcagtccaggaaatggaggttactgtaagctgagattgcaccactgtagtctagtctgggtgaaagggccatacctgtctcaaaaagaaagaaagagagagagacagagaaagaaacagaagagtacattgtaactgttgtaaggttggatattattttgtgaaactgttttgttttgttttgtttttttgagacagagtctccctctgttgccaggctggaaggcagtggcgtgatctcggctcactgcaacctccgactccctggttcaagcgattctcctgcctcagcctcctgagtagctgggattacaggcacgcgccaccgtgcccagctagtttttgtatttttagtagagacggggattcaccatgttggccttgatctcctggcctcgtgatctgccccccttggcctcccaaagtactacgattacaggcatgagccattgcacctggcctgttttgttttgtttttaagagacaggatctctaggctggacacagtggctcatacttgtaatccaccactttgggaggtcaaggtgggaggatcacctgagccccagatttcaagaccagcctaggcaacatagggagaccacatttctacaaaaaaattttcaaattagctggttatggtggtacttgcctgtggtttcccagttacttgggaggctgaggtaggaggattgcttgagcccgggaggtcgagggtgcagtgagccataattgcaccactgctgtactccagcctgggtgaaagatgagaccttgtctcaatttttaaagaaggcttaaactgcttaatctgattataaatgataaatgtctagtatgttattctctattcatgaaatatagcaaagataagctttttggccttttgaagcatttatgttttaaatgacaaatatgttactgtaaactgggattatcagctggccaggtatcatttactgcagttcagagtctcccaacctccatatttctagaactgaatttagactgaaggatgtgcctcttaaactgctctgcccttttggtttcttgctggcaattgtctgctgatattttataaagctaaaaattttctactcaatttgttccttattttacatttttatctcagcctaggtataaactagatgaatttgattgcaattattttcattgttactgctcttcatttgcctattttcatcagaaaaaaacagtgtattttctggtgagattggcatgaatttctcagataaaggaatatttggggatggtgtccctttgggaatatgattgctttcttgcatggtgatttgcttccacttcccaggtgttgagaataataggcagtcagaaggtctgcatgccaaaggcagaagacatttgggaattttttcatcatgaactttaagttgaaggagttaatgattggctggattacaatataaaaagtggatgtctttacagtaaagtaagtagagcttgaaatacaaagaatggaaactcctacatgaaaatgtttttaggggaaaaacatattttctctttatggtttattctgctctaggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacggtgagtggctccaaggctttctgggcagtgcaatacatttgcagttgagaaagttacaaacgatcaaatatttcagtctgtatcagtggccatatttagtgctaaaactcttgtcttccttgggttctagtgaacatttaactaagtggggagagctagtgagttgtggcatgtggcgcaaagaagtgtttattggtttattactttgcttgtcttaaagttgtcacatttggttgagagtctagggcagaagttcttaacttagttttttgctgtggagcccttaggcagtctaaagactgtggaccttttattggaatattgtttttaaatgtataaaacatagtacataagatcaaagagaaaaccacctttgttgaaatacagttactaaaacatcagaacaaatttgtgatatagtaatgtatgtctttatcagtgcattaaataatgagataatacatttaaatcctaaacaagttagagttgaattttattttctaggacattagtatgctagctattacataataatatgcttggcttaagaacattaaattatgaggtagtctgtaacaaggcaacatgtatgtcaagttaaacatctagttgattttgggtttttgttttgatggttattggtgtagaaaatcttgatttacaaaggtattttcttacaaatgtacctaaacacatttgtagcttgctttttaaggaatcataagcttctctaaaggacaactagaattccccaagacttttcaaatttgactccagtcatagtaactgttttgttttaagatcaatgaatttatctttggctaggtcaacatttttcatacgatttatattaataaaaaaggattctgatacatgatacacttcgatcctgtggtgatagaaataaatttgagagttataaaacttctccagggattgatgtgtagacatattttttcagatatgtcagcagggaattttgcagataggaaatattggaaagcagcataagtatcttggtccccaatgggagagccttgtgactatcactgtttggtggctgagtgactgttagatgcagagctacttgatagttgcccagctccatcacatgagcatctgcagacaggaaagctgtaatcatgcagtatggcagcagttctataagtccttaatttaaagtagtgatgagtgaaagcgataatttaaagataatctacaactgtaaaataacctgattagtctgatttctactggcagtaaagatagtgctgatattacttgtggtttattgtctgcattcataattaaaggaaatgagggggcagtcaccatgactcacctgtaatcctagcactttgggaggccaagatgggcggatccttttgagttcaggagtttgagaccagcctgggcaacatggcaaaactccatctctacaaaaaatacaataattagctgagcatagtggtacgcacctggagtccctgctactgggggactgaggcgggaggaacgcttgagcccaggaggttgaggctgcagtgagctgagatcacgccactgcactccagcctgggtgacaaagtgagaccctgtctcaaaaataataatgataataaaaataaaggaaatgtggccaagcgtggtggctcatgcctgtaatcccagcactttgagaggctgagggggaaggttcacttgagaccaggagttcaagatcagcctgggagacatggtgagaccccatctctacgaaaaaaaaataaattacccaagcatgatgaggcatgcctgtagtcgcagctactcaggaggcttaggtggtaagatcacttgagcccagaaggttgagactacattgagccacgatcacaccactgcactccagttcagcctgagcaagagaacaagatcccatctcaaaaaaaataaagacaaaggaaatgctaaatttcagaggttagtaaaaataaaaacgcatttttttcaagttaaagtcacagacatcccctgaattctacctgtactcacctctatagaccccaggctaagaatctttggtcgacagaaaaatctgcagaaaagcagacaaaagacatgaacagataatcgcaataagatattaaaatggcccttaaacttatgaaaagatgttcaatttcacttgaatacaagtcaaagctatgctgagataccgtttcttacctgtcaggcaaaaattcagaagcttaacaatacacccgattggcaaagctgtgatagaataggcactcatatattggggtggcaatgcaaaatggtacaatgcccatggagaggaatttggcagtatcttacaaaactacatatatgtttaccctttgaaatcccacttctagggatttactcaaatacagctccaatatgaaaatacatatgcacaagattattcaatgcagcattatttatcattggaaaatacttaaatgttcagtcatggagattggctgaatgaactatggtatgtacacataatggagtactatgtagctgtagaaaagaataaagattcaggcagagcgcagtggctcacccctttaatcccagcattttgagaggctgaggtaggatgattacttgaaactggagttcaaggctgcagtgagctatgatcgcataactgcactccagcctgggagacaatgcgaaaccctgtcgctctaaaaaaaataataataaaagaataaagattcaggtatctgtgaactgatagggagagatttccaggaggtattgttaaatggaaaaaaaaaagcaaaaaatgtaatgatcatctagcatatactatgttttatgtaagaaagaaggggaaataagaaaaacatacagttgacctttgaacaatatgagtttgaactgtgtgagtccatttatacatggattttctttcaataaaagttacactgagtgtggctgcctctcctgccccccttccacctccttcacctcttctacctctgccacccctgagacagcaagaccaacccctcctcttcctcctcatcctcctcagcctactcaatgtgaagatgatgaggatgaaaacctttatgatgatccacttccacttaatagtaaatatattttctctttcttatgatttttaaataacattttcttttacctagcttacttttttgtaaaaatacagtattaatacatataacaaataaaatacgtgttaatcgactttgttatcattaagacttctgatcaacagtaggctattagtggttaagtttttggggagtgaaaagttgtatgtggatttttgactgtgtagggggtcaacactccaacatccacattgttcagtgcagtggtcaagtgtatctacttacctttacaaaaaagaaacagaagaagaactggctagaaaacaaaagacatttattaactgcatggggtgaggtggaggagttgagagggcaaaagggttttgggagcacatgatattcccctgagcatgcctttttggtataattctgacttttggaaacatgttaatgttctacatattcaaaaaatagaatgaaaccaatatggatgggagcgctaactgaaacagatgaattgtatttcaagtgaataatacaatcacactgaagggatttaacaaaaactaattcaagtaaattatgaatgtagtatttgactacatatgtttagtcttgggtagagttgggagaaaaccataaacaaatactgaactcgttgttgttgttgttgttgttgttgtttgtaatggaatgggcaaaacagttctgaagctgctttagatgttttataggattgagtcaatgggtcatgttgatgttggtggagtcagggttctaagtgtggaagaaggaacacacaagtatggagtggaggaaggcaagaaagaacccctatagggacttattggaattggaagtattggactcgggatttctaaatgtatttggttttgtatatatatttatatatacatatatatatatatatgtcctagctctgtctgaagatggggcctagaaataaagacatcccactagcatgagcaagccagggcctttcagagaagactcagggctgattccaggacaggggcagggtaagtacaagtgagcttggaacatctagaactgaaaaaaacagaaggaaggaagaagatgggagcatgtcataggatataggaaccctcttaaaagggttcccactggccacatgtgggataagttgagcaccaacataattaagaacagtaataaagcataaaccattcaaaaaatgggaatctggctgggcgcggtggctcacacctgtaatcccagcactttgggaggcctaggcgggtgcatcacctgaggtcaggagttcaagaccagcctggccaacatggtgaaaccccatctctactaaaaatacaaaaattagccaggtatggtggcacacgcctgtaatcccagctactggggaagctgagacaggagaattgcttgaacccaggaggcagaggttgcagtgagccaagattgtgccattgcactccagcctgggagacaagaactaaactctgtctcaaaaaaaaaaaaaaaagaaaaagaaaaaaaaatgggaatccatgagcccatctgtgatatatatatatatatatagagagagagagagagagagcgagagagagagagagagcacttgcttatagtagaatgctccaattattaaatgtagaaagagtgctggagttggaaaaatactcatttttgcaaccctccttaaaggttggctcaggcacgcatcatcaatgaatgttaaatgtagggggcaaatttttatttccttattggcttcaaggggaaagaagtaactaaatgaagaaatcagatgataccttgatcggatagtcaaaattaaggtcacaagcattctgcttttgatatgaccaagtaagctctcagatcagcctccttacaggtaactaaaaatgctggacagaattcaaaaaaccagtggagagcaacccaaagcaagcaaattctggaagggagtcaacacttagaacagggtgcatttcctatttttactgctttcagtagtcagccccctgtgggacagctaaaactctgatagaaaactcagtctttctggactgaagaaccagaggacagagttcaggagtttcagtggttacagcactgaaaataagggagaatcctagaacgaagagaaactcagccccaaattctgtatatgaactgcctcggtctccagctgaccctgaaccatgcttggcagactccaggtagctcagctgaagataattatgaactaaactgggctggatgcagtggctcatgcctgtaatcccaggactttgggaggccaaggtgggtggatggcttgagcccagaagtttgagaccagcctgggcaacatgtcaaaaccttttttctacaaaaaaatacaaaaattagctggtcgtggtgacctgcgcttgtactcccagctacttaggagactgaggtgggagggtagcttgagaccaggacagggaggttacagtgagccaatattgtgccactgtattctagcctgggcaacagagggaggccctgtctccaaaaaaaaaaaaaaaaagtgatggggcacagtcactcaggcttgtaatcccagcactttgggaggccgaggcaggtggatcacaaggccaggagatcgagaccatcctggctaacacggtgaaacctcgtctctactaaaaatacaaaaaaattagccaggcgtgttggcgggcgtctgtagtcccagctactcgggaggctgaggcaggagaatggcgtgaacatgggaggcggagcttgcagtgagccgaggtcacgccactgcactccagcctgggcaacaaagtgagactctgtctcaaaaaaaaaaaaaaaaaaagcacaaaaaaaaattaaactgaaaattgagcagcaacccaaaagacattttgcagttttaatccaaccaagctacttaaagcaaaacaaacaaaaaagtcactctttggaggaatataacaaaatctgactatccatgagataatgttggcaatgtccaggatataattcagaattaacaccaccagtgagcagcagatgtacatcctgcacctctagatgtgatacccggagaagcatcatcaccattataacatttcatccaagaacccgtagtcttaaggacatacacacaaaagtttttattactaaaaaaacaagaaaggaggagaatatattatccaaaaatggcaatgtcataaaagtcaaagcgagaggaaatgttccagattaaaggagactaaagagttacaagtaagtgaaatgtgtgattctagactggatccttcctggaaaggaaacatgccctgaagtaagtactttattgagcagttgacaaaattacaatatgcaagaaaattagaaaaagtgtcagtgttgataactgtactgtgatgatgtaagaaaatatcttttctcttagaaaatacacattgaagcatctggggataaagggttattgatgtgtgcaacttacttttaaatgttagagaaaaagaatgtgtgtgtgtacagagagcgtgagtataaatgatgaagcaaatgaggcaaaatgttaatcaatatattggtccatctgagaaaaggatgtatgaatttttttttactattcttgcaactttactgaaggtttaaaattatttccaaattagagtttaaaaaaattatgggagtaagcttaaaacaaaacaaaataattttggtctagaacggtttttaatctccttgtatttactatgtgttaaatttttttccatagagttatattttttaataaaatcttatcttggaaagttgatgtaagaataaatggttttattgtgccttactccaaacagcaaatgagaagcactgttgggtggtattggactctggctgtatcacacagttggccacactgggctccaagacatttttcttgtgattcttgtcagtttcaatttaacgtaggctgagcatggtgactcacgcctgtaatcccaagcgatttgggaggccaagacgggaagattgcttcagcccaggagtttgagaccagcctaggcaacaaagcgagacgccgtctctacaaaaatcttaaaaattagctgggcatggtggcatgtgcctgtaatcccagttacttgggaggctgagatgggaggattgcttgagcccaggaattcgagactgcagtaagctatgattgtgctactgtacttcagcctgagtgacagaggaagaccctgtgtcttaaaaaaagagagagaaaaagaaacaaggatggtcgaatttcacacttgtgaacctatagttcagggagttgtaaatttctcctacctgaccttattcatggtcaggacagtgttgtgagttcaagaacagagagtagctgcagaaagtaatgaccttttctgtgttctctgatcctgggaaggggcaagtggctctagtttccctctgacatcctgctctgtgtgtgtgtgtgtgtgtatacacatgtgtgagtgtttgcttatgcaagaaaggaagggggctgggcacggtggctcacacctgtaatcccagcactttgggaggccgaggcgggtgaatcatgaggtcaggggttcgagaccagcctggccaacatagtgaaaccccgtctctactaaaaatacaaaaaaattagctgggcgcagtggcgggcacctgtaatctcagctacttggtaggctgaggcaacaagaatcgcttgaacctgggagacagaggtttcagtgagccaagatcacgccactgcgctccagcccgggtgaccatgcaagattccatctcaaaataaaaaaaaaaggaagaaaggaaggaagaggaccgagctggggcaaagctagccttctcccagggtatctttcttccataccattctactttctcagaatccttgatctgccaaagagaaatttggaaaatgatgaaatggccacttcacttctatgtgttttgaaacatgtatgtaaatgtaaacatgttaaatatgtgaaataaaatttttcctcctcagtaagttgaaagaaatttccatttaacgaatgattttttaaaaaaaacctgattctaaagatatatatggtgattgtcaggccagtcacaatggtgcacgcctgtaatcccagcactttgggaggccaaagtgggaagatggcttgaggtcaggagtttgagaccagcctggacaacacagcaagacccatctctacaaaaaagtactttaaaaattagccaggcatagtggcacttgcctgtaatcacagctactcaggtggctgagatgcgagggagaatcatttcagttcgaggctgcagtgagctgtgatcgcaccacttcactccagcctgggcaacaagcaagactctgtctctaaaaaaataaaaataaaatgtgtgggcgcagtagtagccagtaatcctatacagagagttaaatgtagcttgtgttccattattcttcttcctgttttatctctgaagtcattatttttgctggctttcgtgtctgatgacctggttttacctattttctgcagagttttatgtattataaaatgtcaataaaatgtatttattaaatttatgctaaactgcagtctttataggtttataaaaactttctaattttaaagcctctaattgtttaagatcctaagtataactggatgataagcctttgtataaaaaaaggccagagccagcttgcacacagtgtaatttgactgttccttccagttcagggtagcattgagctatttgctggcgcagagtgattagggtctttagcttcccttctttgcagtgttttaataggaaaatatcatttattaataagaggtaatatcttactttacttgtatactttttccattgtaaaccccttccttttgtatgctggactcctaagaagattaaatcccctgtaacttacttgactgatgttcatctgtcattttacctggcattttgatgtccccatcttttaactttatttacttgtatgtttcctacaagagcagtaacatctttatttaatacacataaatgcttttttcactcttcagcaaggatttattaagtaactattgggtgcctagtgctgtgctacattctgtcagacatgttaaaggaaaagagaggtagaaaatttaatgctttagcatttacagtccatctggggatagaaaacattcaagtgaaaatggctttgtatatctgaggtggtgtatagaggaacctttgaagactgcctgcatagatcactaggtctaggcaaggggagagttgctttgagctggaatcaattttttaaatttatttttaatttttcttgagacaaggtcttgctctgtcacccgggctggagtccagtggcatgagcatagcttgttgcagccttaaactcctaggcacaagtgatccttccaccttaacctcctagatacctgggactacaggcatgcaccaccacacttggctaaattttaaaaattttgtagagatagggtcttgtgatgttgcccaggctggtctcaaactcctggcctcaagtgatcctcccccatcgacctcccagactgctgagattacaggcatgagccaccatgcttagtcttcaattttttattctttcttgagggaagtggttctgtagttagactttgattgatgtccaagttttggcttaacaagctgagaagttcagtatgtgccaagaattacaggtgaggagacttggggaaaggagaataagaaggttttgttcgatggtgttaagcaaactggtttaactagactggacattgagaaataagttggaactagttgataaagggcttaagaacctatctaatatagcagtttgccctgaatttgaaaagcagcagattcttaaatggtaactgacacatcataagggtggtgggttttttgtttgtttgtttttgagacggagtttcactcttgttgcccaggctggagggcaatggcacaatctcggctcattgcaacttctgcctcctgggttcaagcagttctcctgcctcagctcccaagtagccgagattacaggcgcccgccaccatactcagctaatttttatattttttagtagaaacgtggtttcaccatgttggtcaggctggtctcaaactcctgacctcaggtgatccacctgcctcggcctcccaaagtgctgggattacaggtgtgagctactgtgcccggccaagggtggtgttttcaaacgatgaatctgacacggatgtgtaagattaattatattagggaaaaatgagagtagggaacctgatgctaatttaggtttgagtgatgaaaatttaggttagggtgatggcaataaaaatgtgacagatgttagaatgaagataaagttgcaggatgctaaggaagagatagacaatgacaattagattggtctggaaagaaatgatcagaggccatagatcactttccttggaatagtagaggaagaggattaaggaataggaggaagttggggccattgggggttacacatttcagtgatttttctgttaaggtagggctgagtcaaatgaagagttccctcttagccacctcttcaggacagggaaatcttctaagggtttgaagcagaaagaaaaaagatagtggccgggtgcggtggctcacgcctatcatctcaacactttgggagggtgaggcgggcggatcattggaggtcaggagtttgagaccagcctggccaacattagtgaaattctttcacctccagaccaatgtttgaacagtttctgtctcacatagcttaacgctgtctttctcattttcactttagatccagaagcagcaaggtctagcaattccaaaatcaccaccacgctgggtctggttgtccatgctgcaggtagggttggattgcagtggaacttctttgttttctatcgcacaggggagaccttagtgtttatatttcagggaccgtcctcattgaatgctcttggactggcctttgaggaaaaggtttcttaatgaagtcctccaacacaagcacaagcttggtgtgctcagtgtcaggggtttgcaagctaagaatggtttctatactttttaatggtttaaaaaaaaaaagagagagaggaacatactgtagcacatgagaattatataattcaaattaaggaagttttattggaacacagccttgcccatgtatttatgtattgtttgtgacagtgaatttgattagggaaaaatgagagtagggaacctattgctgatttaggtttgtttgagtgatgaaaatttaggttagggtgatggcaataaaaaatggagaaaggcaaatgtgactgatgttagaatgaagataaagttgcaggaggctgaggaagagatagacaatgacaatgatccatctcttttgtttttgtgcaacagtggcagaattgaacagttgcaagagaccaaataactgcaaagcctcaaatatttactgtctagctcttaagaagaagtttgctcttttcattcttggctctagaatgtcatctggaaaagagccttggcgcttctgtcctgaacagctctgttaccagtttatatgcaaaacaccagtttaagcagaagtggtatgcagtggaatgcagagatcttagcattgctgacagggtacactttagaatcataacccaaacctagtcctagtaatagaattctgtcagtggcaaagaaaggcatgtgaaaggtggtacactgttacctggccctttctaagtataatatgcttttctaacaaatttcattcattcaaccagtgtttacttattaagtagtaatcatctatatagagttctagtatctttattttatttatttctttttttgagacggagtctcactctgttgccgaggctggagtgcactggcacgattcggctcattgcaagctccacctcccgggtttaagcaatcctcctgcctcagcctcccaagtagctgggactattttgtttcttaacctataagattaagagatgcttcctttgaaattcttctttggtatttcccttgttagaatttgattaactaatcaatggatttttgattagttggaaaattgaatgttagttttccaataacaacaacagcaaccaaaataactaacattgaatactctgggccagatgctatgctctttacataagttatctcatttaatcctcatgaaaaccctaagaaatacatacttcattgaacacattttaaagataaggctggcatgtagaaaggttaagtaacattactagatccagctggacctgactgtaaagctcatacactcaaccactacactgttattgttgttgttgtttatagtattttatgtttccttgtttccaaatatagctgatggtgttgctttgggagcagcagcatctacttcacagaccagtgtccagttaattgtgtttgtggcaatcatgctacataaggtaagcaacattttggtgtaaggtttggtattgagtgtattcataattaaaatttctcatggtccttaatgtttttcctggaatgggaacattttcttcatttcataattgctattcattttggaaaattgaataaatctgttcatagcttcttgttcccattttcttaagcttttccttgaggggtttcaatttttttgtgtagacatatacacaaattgtcaaattctcctcagatttttatatttcatagtaataatttctgttcaaaagtatttttcttttcttgactgtttctcttttttactatccaagaaacacacaaataggatcttttcttggcttagaacattaattcctaagaggcatagctcagcgtttgtactctgcctggttttgttttttggttttttttgtgtgtgtgtgggttttttgttttttgtttttgagatggagtttgctcttgtcacccaggctggagtgcaatggtgtgatctcggctcactgcaacctccgcctcctgggttcaagcgattctcctgtctcagcctcccaagtagctgggattacaggtgcccaccaccacacatttttgtatttttagtagagacggggtttcaccatgttggccaggctggtctcgaactcctgaccttaggtgatccacccacctcgacctcccaaagtgctaggattacaggcattagccactgtgcctggccttttgtgagtttttctttgtatgagaaatcatagtcaaatggcatatacttcttgatgtagaagcaacccatacttctagaatgataataagagatgattttttatttccaggcaccagctgcttttggactggtttccttcttgatgcatgctggcttagagcggaatcgaatcagaaagcacttgctggtctttgcattggcagcaccagttatgtccatggtgacatacttaggactgagtaaggtaagctaatctattcccagctatctaaaccagtgtcttgtgatctcttagaatttatgatctcttagattgaatttttccaatacattactctctcaaactaaagataaaattaggagtaaaaactatacagggtaaatatcttaattccaatgcgtcctcttcatattagcattttcttattcatttaatttgaaaacttcttccctatcaatcagttccaagaatatttgcataaatatgatagcgcttcaatatttaaaatagtataacgtaaccagccatgctagcttcatttgacagatatctaataagtcaaatctgtccatatttaatgtgaggtagacacctgaagcgtgagtaacaagccacatagccgctttgagaagagcagcagctgggcagagattgctgtcaagagtttaaaaaactgacattgattactgaagtgatagagtaatcttttaaagggaacaacatactgctcactgaaagaagagaaggcttttcaggtaaatggaaagggtttttataacacactgttagcaactaagatcaacaaacccttccttaacgggaacttagccattcttggtctcatttttcacgttcctcctcttctcccagctctcacgtccccagatagtaactgtacagttctttctattgaatactttgtactgaacatagcttcagacctgaggtaacatgtgctcttctgactccaagctggaccttcccatgccttataatcctgtctgtagctctgagcaacaaccctccgcattttacccagatgtcaactggcaggcaactggaggaaaatcttagaagcaaactgactcagggctagttgatgggaactgctttccccaacaccctctctaaaggtcattgattcttctgagcatcagtcaattcagtatttggcagtaaaacccatattaataggaacatgtgaaaaatgagataaagaatggctaagttcctgttaagcaagggtttgttgatcttagatgctaagagtgtgttataaaaaccctttccatttacctgaagagccttctcttctttcagtgagcagtatgttgttccctttaacagattactctatcacttcagtaatcagtgtcagttttttaaccttttgacaggaaggtgctgataattctggagacatggagttacttgctgcatctatgggatgtccttttcttaaaattttaattagttgtcttagtccataggtctacttttttaacagaaaaggttgaaattagttttataaagattagcttatgagatatacatatatatacacacacacacacacacacacattttttttttcctttgagatggaatcttgcctgtcacccaggctggagtacaatggcgcaatcttggctcactgcaacctctgcctcccaggttcagacgattctcctgccccagcttccggagtagctgggattacaggcgcccgccaccatgcccggctaatttttgtatttttagtagagacagggtttcaccatgttggccaggctggtctcgaactcctgacctcgtgatccgcccaccttggcctcccaaagtgctgggattacaggcatgagccaccacgcccggctgcttaagagatatttctaggctctatgaggtcaactactgcatcttgattaccactgtatctcaagcacctggcccagagcctggtgcatagatgatgcttgttaaatattagtagaataaataaatttatgtctgaaatttaatatctgcaataatatattgttgattctatctcaagaataatacaagccaaacctgttgaaccagcacttaaagttcgttttaaaaagcaattgtgaaccaggagcagtggcgcatacctgtagtcccagctacttgggaagctgagacaggaggattgcttgagcccaggagttccaggctgtagtgtgttatgattgtgcctgtgaatagccactcaactccagcctgggcaacatagcgagacctcatctctaaagacagatacagtcaatgaatggatggacagaatgatggaactgtggtgaatatagtttaataatagtgtgtggtacatatcaaaattgctaagagtaaatttcagatgttctcaccacaaaatatgataaatatttgagatgacagatgttagttttatttaattagtccacattttattcatgaatcataatgtcactttataccctataaatatatataattataaattgttgatttacaataaattttttaaaaaatcaattgcgtacatcactgatattcttaaacccttatttggaagcttcccatgaataacttaaagttgctgtgttctctagatgtccccagtgtcctagacagcaccagttaagaacagtgagtgttttttaactgggacttcttcctgaccctgaattttacttgacttagtttttcctctttctctcttctaattcacagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgc

SEQ ID NO: 38231 - DNA, 3916 bp, Homo sapiens
cctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtggtgagagcgcagggccactggggctgggtcttgctgcgggctggcggcgattccagggtggccggggggtcgcggggcgggccacactccagcttcgggccctgcccacttctgttgggaagacccgcttgcctgacgcccaggggcgaatttcagtcgagaactcagcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagcggcgagagtggtgcatttgggtttaggctaagttccttccctctcctgagcttcaccctgttctgtaaaatagaggtaataatcccagtcctgctcactgtgtagatttgtgaggcccaaatgagagaaaaaagactcgagaaacccttgtgaactagaacgtgcagaaagcaaaggggtaagacatcagactcttccctaaacgtgctctctgggcacccctgaacttgctcatccgggttccccctcccacagcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggtgaggagctccctctctacccccttggggaaagggttgaacgagtaaggtcactcttggtgtctctaaagaagtgggtctggaagtagggttttggtagcaagctagaagttgtatgggcacctgccatggagagaggggccagtactccttactgtagaagcctggaacctggccaagtgtttgtgttacaggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgtgggtttgcagggttagggagggtgaatgtcagtagcaacaggatcaaaattgtgagaagttgaacgtggcatctgggaaacttgtgaatgaagcttgcattgaggggccattagaaggggtggcgtgggcatcagtcacagtgtacttgctggacacctgagttaaccatggtggttgtttggctacaggtgcccagcctggagaaggttctggagttcaaagcccacgaaggggagattgaagacctggctttagggcctgatggcaaggtgaggggctgggggtgggaggaggatggagaaaggagagaggaggtgcttatgctgcttgcccagtaagtggatcccctaactgtccatccttggaatctttattcctaactagttggtaaccgtgggccgggaccttaaggcctctgtgtggcagaaggatcagctggtgacacagctgcactggcaagaaaatggacccaccttttccagcacaccttaccgctaccaggcctgcaggtgtgaagactttgggtggtggctgaaagaggcatagcccagctgtggtgggggagagggaaaagactggggatgggagagctggggaggaacttgttgagtgttaccccaggtctgaccagggtgcaggtggtgcacaaacctctgaggagggttgggcaggccctaggagctgaatagcccctcatccggcccccaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcaggtgtgagacattgctgccttggctaggtagggggtccctgagggagcttggaaaggagtcctgcctgggtccctacggaccggtattggggtatgagggttgctgcacaagcctccaggacaatgagctctttattgtttgttgcagtgaatccggcaccttcctaggcctgggcacagtcactggctctgttgccatctacatagctttctctctccaggtaatgggtggaggttggcatggccctgtgggtggactgtaggcctgtctctaccctgagtttgcaggaaggagtctggcccatcctatcgagggaaatcctgggggtggggaacatgctttccagaaagagagttcccagctaggcctttcctcactggtattccttctgcccacagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcgtgagtcattggggcagggcaggcaggcaccaccccacgtttaatgaccagaaacgtgccccccggaggctgggctctttgtgccactcctcctttgaagggttctggttttcaggctgggaagcccttttgcccgctgacctcctccctttccctcctgcagggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagacccc
